United States Patent 8,362,325 (NUCLEOTIDE SEQUENCES AND CORRESPONDING POLYPEPTIDES CONFERRING MODULATED PLANT CHARACTERISTICS) - sequence listing, part 7

SEQ ID NO: 12079 - DNA, 1227 bp, Sorghum bicolor
  misc_feature: Ceres ANNOT ID no. 6054085
  misc_feature: Encodes the peptide sequence at SEQ ID NO 12080
atggctggcagctggaagatggttgccggggttctgctcctactttcactccttccgttggcctcgtcgtccatggtgttcaagcttgacggcagcgtctatcctgtaggccacttctatgtgaccatgaacattggggagcccgcggagccctacttcctggacatcgacaccggcagcagcttcacctggctcgagtgccacgcaaaggatggtccctgcaaaacgtgcaacaaggtgccacacccactgtaccgactgacacggaagaagctagttccatgcgcagatcctctctgcgacgcactgcacaaagacctgggtacaaccaaaaagtgcacagatgtacggaagaaccaatgcgactacaaagtgaagtaccaagatggattgtcatctcttggtgtgctcctccttgacaagttctcgttgcctacgggcggtgcgcgcaacatcgcctttggctgtgggtatgatcagatgaagggctccaagaagaaggcccccgagaaggtgccggtcgacggcatccttgggcttggaaggggctcagtagacctggcctcgcagctgaagcacagtggagccgtctccaagaatgtgataggccattgcctcagctcaaagggagggggctacctcttcattggggaagagaatgtgccctcttcacatgtaacctgggtccccatggctccaacaacacccggggaacctaatcactactcgccgggccaagcaaccctgcatttggatagtaatccgataggcacaaagccgttgaaggcgatcttcgacagtggcagcacttacacctacttgcctgagaatctacatgctcagctcgtttctgcactgaaggcctctctcagcaagtcgtcactcaaacaggtgtctgatcctgcactgcctctatgctggaaaggacctaaacctttcaaaactgtgcacgacaccccgaaagaattcaagtcactggtcactctgaaatttgaccttggagtcaccatgattatccctccagaaaactacctcattatcactgggcatgggaatgcatgctttggcattcttgatatgccaggcttggatcagtacataattggagacatcacaatgcaggaacagcttgtgatatatgacaatgagaaagggaggctcgcatggatgccatcaccatgtgataaaataccaaagtccaaagctgcgatcatttcgcgcatctga

SEQ ID NO: 12080 - protein, 408 aa, Sorghum bicolor
  misc_feature: Ceres ANNOT ID no. 6054085
  misc_feature (38)..(390): Pfam Id: Asp Pfam Desc: Eukaryotic aspartyl protease
  misc_feature (19)..(400): NCBI GI: 62954888 NCBI Desc: nucellin-like aspartic protease [oryza sativa (japonica cultivar-group)]
  misc_feature (45)..(400): NCBI GI: 21805926 NCBI Desc: nucellin-like aspartic protease [zea mays]
  misc_feature (1)..(408): NCBI GI: 114152773 NCBI Desc: aspartic proteinase asp1 precursor (osasp1) (osap1) (nucellin-like protein)
  misc_feature (1)..(408): NCBI GI: 37542275 NCBI Desc: aspartyl proteinase [oryza sativa]
  misc_feature (1)..(408): NCBI GI: 37542277 NCBI Desc: aspartyl proteinase [oryza sativa]
MAGSWKMVAGVLLLLSLLPLASSSMVFKLDGSVYPVGHFYVTMNIGEPAEPYFLDIDTGSSFTWLECHAKDGPCKTCNKVPHPLYRLTRKKLVPCADPLCDALHKDLGTTKKCTDVRKNQCDYKVKYQDGLSSLGVLLLDKFSLPTGGARNIAFGCGYDQMKGSKKKAPEKVPVDGILGLGRGSVDLASQLKHSGAVSKNVIGHCLSSKGGGYLFIGEENVPSSHVTWVPMAPTTPGEPNHYSPGQATLHLDSNPIGTKPLKAIFDSGSTYTYLPENLHAQLVSALKASLSKSSLKQVSDPALPLCWKGPKPFKTVHDTPKEFKSLVTLKFDLGVTMIIPPENYLIITGHGNACFGILDMPGLDQYIIGDITMQEQLVIYDNEKGRLAWMPSPCDKIPKSKAAIISRI

SEQ ID NO: 12081 - DNA, 1404 bp, Sorghum bicolor
  misc_feature: Ceres ANNOT ID no. 6054455
  misc_feature: Encodes the peptide sequence at SEQ ID NO 12082
atggagctggatctgaacgtggccgaggtggcgccggagaagccggcggcggcgatggaggcgagcgactcggggtcgtcggagtcgtcggtgctgaacgcggaggcggcgtccgcgagcgccggggccgccgcgccggcggaggaaggctccagctcgacgccggccgtgctcgagttcagcatcctcaggagcgacagcgacgcggccggcgcggacgacgacgacgacgccacgccgtcgccgcctcctcaccatcaccagcatcaccaccaccagcaccaccaccagcagcagctcgtcacccgagagctcttcccggccggcaccggcccgccgctcccgtcgccgcagcattgggccgagctcggcttcttccgcgccgacccgccgcgcccgcatcagcagcagccggacatcaggatcctgccgcacccgcaccagcacccgcacgccaccccgcccgtggctcccccgccgccggtgcagccacagccggccaagaagagccgccgcgggccgcgctcccgcagctcgcagtaccgcggcgtcaccttctaccgccgcaccggccgctgggagtcccacatctgggcgtacgatcgagcggcgatcaagttccgcggcgtcgacgccgacataaacttcaatctcagtgactacgaggacgacatgaagcagcagatgaagagcctatccaaggaggagttcgtgcacgtcctgcggcggcagagcaccggcttctccagaggcagctccaagtacagaggagtcaccctgcacaagtgcggccgctgggaggcgcgcatggggcagttcctcggcaagaaggcttacgataaggccgcaatcaaatgcaatggtagagaggccgtgacgaatttcgagccaagcacatatgatggggagctgctgactgaagttagcactgaagttgctgaagttgatctgaacttgagcatatctcaaccggcatctcagagccccaaaagagataagagctgcctaggcctgcagctccaccatggatcatttgagggctccgaatcgaaaaaaacaaagattgatactccctctgagctgtcgggccaccctcatcggttccctcttatgactgagcatccaccggcctggcctgctcaatctcaccccttcttcacaaatcatgagagtacatcatcgagagaccttaacaggaggcctgaggggggtgctcctagctgggcatggaaggtgacagcagctcctcctcacaccctgccattgccgctgttctcttcgtcatcgtcatccgctgcagcatcatcaggattctccaataccgccacgacagctgccccatcggcctccctccggttcgatgcaccgccatcgtcgtcatcgagccatcatcatcgccgctga

SEQ ID NO: 12082 - protein, 467 aa, Sorghum bicolor
  misc_feature: Ceres ANNOT ID no. 6054455
  misc_feature (1)..(326): NCBI GI: 58432890 NCBI Desc: transcription factor ap2d23-like [oryza sativa (japonica cultivar-group)]
  misc_feature (199)..(466): NCBI GI: 5360996 NCBI Desc: apetala2 protein homolog hap2 [hyacinthus orientalis]
  misc_feature (199)..(440): NCBI GI: 2281639 NCBI Desc: ap2 domain containing protein rap2.7 [arabidopsis thaliana]
  misc_feature (199)..(332): NCBI GI: 74053661 NCBI Desc: apetala2-like protein [dendrobium crumenatum]
  misc_feature (199)..(277): NCBI GI: 115456217 NCBI Desc: os03g0818800 [oryza sativa (japonica cultivar-group)]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 467 in the 10/374,780US patent application
  misc_feature: Useful for making plants with altered alkaloid content
  misc_feature: Useful for making plants with modulated growth and phenotype characteristics
  misc_feature: GREAT-hit functional homolog of the protein sequence given in SEQ ID NO 13222
  misc_feature: The sequence is a functional homolog of SEQ ID NO 12 in the 20040045049 US patent application
  misc_feature: The sequence is a functional homolog of SEQ ID NO 467 in the 20060162006 US patent application
  misc_feature: The sequence is a functional homolog of SEQ ID NO. 274 in the 11/188,298 US application
MELDLNVAEVAPEKPAAAMEASDSGSSESSVLNAEAASASAGAAAPAEEGSSSTPAVLEFSILRSDSDAAGADDDDDATPSPPPHHHQHHHHQHHHQQQLVTRELFPAGTGPPLPSPQHWAELGFFRADPPRPHQQQPDIRILPHPHQHPHATPPVAPPPPVQPQPAKKSRRGPRSRSSQYRGVTFYRRTGRWESHIWAYDRAAIKFRGVDADINFNLSDYEDDMKQQMKSLSKEEFVHVLRRQSTGFSRGSSKYRGVTLHKCGRWEARMGQFLGKKAYDKAAIKCNGREAVTNFEPSTYDGELLTEVSTEVAEVDLNLSISQPASQSPKRDKSCLGLQLHHGSFEGSESKKTKIDTPSELSGHPHRFPLMTEHPPAWPAQSHPFFTNHESTSSRDLNRRPEGGAPSWAWKVTAAPPHTLPLPLFSSSSSSAAASSGFSNTATTAAPSASLRFDAPPSSSSSHHHRR

SEQ ID NO: 12083 - DNA, 1095 bp, Sorghum bicolor
  misc_feature: Ceres ANNOT ID no. 6054632
  misc_feature: Encodes the peptide sequence at SEQ ID NO 12084
atgtcgagcgcagcggtgaacgggctggccggcgccggcggcggcatcatcgctcagatcatcacctaccctctgcaaaccgtgaacacccggcagcagacggagaggtcagcgaagaagaggaaggccgggagcggcggcagcgccacccacacctccaccctcttccagatgctccagctgatacaaaccgaaggatggggtgggttgtacagtggtctcaagccctctctaatcggcactgccgcgtcgcagggaatctattactacttctaccagatcctcaagaacaaggtggaagatatagcagctgctcgtagtaagaagggccatggggatggtactgttgggatgctttcttggcttggtattgcagctgttgctgggtcaatcaatgttcttctaaccaatccaatatgggtccttgtgacacgtatgcagacacatactcaagcgaaaaggaaaatattggagtctaagagcgagcttttactgaaagaaatgtctagggccaattcattggaggttgcagttctgaaggataggctggttaaactggagtcggaaaaacctcgtccatatggtactcttcaagcgatccaggaggtttatcgtgagtctggtataagaggattttggaaagggcttgttccaacattaatcatggtatgtaatccatcgattcagttcatgatctatgaaacattggcaaagcgcctgcagtcaaagcattctggaaagcaactaccaaaaaggaacctcactgctatggaggtttttttattgggtgcaatagcaaagcttggagctactgtagtcacttatccattgctagtcgtcaagtcaaggttgcaggcaaaacaagaaattggcagcaatgcgatgtccagatacacaggtacactagatgcgataataaagatggtccgctacgaaggactgcatggattttacaaaggaatgggtacaaagattgtacagagtgtctttgctgcctcggttctattcatggttaaagaggaattggttaagttagcagtgcttttagttgcaaggagtaggactatgcttattactacatccaagaaacaatag

SEQ ID NO: 12084 - protein, 364 aa, Sorghum bicolor
  misc_feature: Ceres ANNOT ID no. 6054632
  misc_feature (3)..(103): Pfam Id: Mito_carr Pfam Desc: Mitochondrial carrier protein
  misc_feature (120)..(244): Pfam Id: Mito_carr Pfam Desc: Mitochondrial carrier protein
  misc_feature (255)..(350): Pfam Id: Mito_carr Pfam Desc: Mitochondrial carrier protein
  misc_feature (1)..(364): NCBI GI: 115480061 NCBI Desc: os09g0508900 [oryza sativa (japonica cultivar-group)]
  misc_feature (1)..(364): NCBI GI: 115445117 NCBI Desc: os02g0225000 [oryza sativa (japonica cultivar-group)]
  misc_feature (201)..(344): NCBI GI: 145356747 NCBI Desc: mc family transporter: peroxisomal membrane protein [ostreococcus lucimarinus cce9901]
  misc_feature (178)..(345): NCBI GI: 73531020 NCBI Desc: folate transporter [arabidopsis thaliana]
  misc_feature (178)..(345): NCBI GI: 21537040 NCBI Desc: contains similarity to peroxisomal membrane carrier protein [arabidopsis thaliana]
  misc_feature: The sequence is a functional homolog of SEQ ID NO. 398 in the 11/188,298 US application
  misc_feature: The sequence is a functional homolog of SEQ ID NO. 517 in the 11/188,298 US application
  misc_feature: The sequence is a functional homolog of SEQ ID NO. 385 in the 11/188,298 US application
MSSAAVNGLAGAGGGIIAQIITYPLQTVNTRQQTERSAKKRKAGSGGSATHTSTLFQMLQLIQTEGWGGLYSGLKPSLIGTAASQGIYYYFYQILKNKVEDIAAARSKKGHGDGTVGMLSWLGIAAVAGSINVLLTNPIWVLVTRMQTHTQAKRKILESKSELLLKEMSRANSLEVAVLKDRLVKLESEKPRPYGTLQAIQEVYRESGIRGFWKGLVPTLIMVCNPSIQFMIYETLAKRLQSKHSGKQLPKRNLTAMEVFLLGAIAKLGATVVTYPLLVVKSRLQAKQEIGSNAMSRYTGTLDAIIKMVRYEGLHGFYKGMGTKIVQSVFAASVLFMVKEELVKLAVLLVARSRTMLITTSKKQ

SEQ ID NO: 12085 - DNA, 1419 bp, Sorghum bicolor
  misc_feature: Ceres ANNOT ID no. 6054759
  misc_feature: Encodes the peptide sequence at SEQ ID NO 12086
atggatgatctcccagaggcgatgcatgcagagattgtcaagcggcttacctgtccaaatgatcttaagtctctttctcttgtgtcaaagcgactatatgccattgagggagagctgaggaattctatttgcattggctgtggcgttttccctgtgacagtggccttgattcgtctgtgctcccggtaccccaatttgtgcaaagtggaattcaattactctggttggacttccaaccatgggatgcagttggacaaacatggcctccaggtgttttcatcttgctgtgcctcattgactgatctcaccttaagcttctgcacgaatgttgatgactcaggccttcgccttttagcgtgcttcaagaagatgatgtctctgaggttgaacacattaccagcaataacttcgtctgggcttctccaagtggctgttggctgtaagaatctatcttgtctccaccttattggctgcaacaaagtaggtggcgcaatgtggctggagtaccttggcaggtttggatcattgaaagaacttgtattgaatcgctgtgagaagatcagccagtttgaccttctaaagttcggtgcaggatggatgaagcttcagaagtttgagtttcagatcaaaggttgcctctgtgtatctgatccttgtgatccttcatgtgtggagcactgtcagtatagatatgatttcagctgtgagagtttggaggatttgacattagcaagagtcttaactgagaaggaaataggactccgttgtctcctgaggaagtgcaaggcattaaagaacttgtgcctttattatgttcatggtttacaggacaatgacatggttacgctctccaacaactgcaccaaccttacaagcatctcacttcggttgatacctcagcacactgaaggttatattttcaggacatcattgactgatgatacccttaaggctctagccctcaggtgccgtaagcttcagtcttttgaactcatactttgtggatgtgatgaaaggtggccagaaatagggttcacacaggagggccttgtcatgcttattcagtcttgtccgattcgtaatctcgtgctaagtggtgctcacatctttgatgacgaggggatgaaggccatctcatctgcacaattcctagaatcacttgaacttatgcattgtataaatgtaactaatgctgggatgcgcctcctcgcacattgcccatgtttgattaacctcacactgcggcattgtcatcgtttctctgatgctggagtgactgaggtagcacgtgcacggaagctggagaccctggttattgaaggctgttctcaggtccctccagaagctgcgcggggggctgcaacatcagttcactacaaagaagatggcccaggcttggtcggacttggcagagtgtga

SEQ ID NO: 12086 - protein, 472 aa, Sorghum bicolor
  misc_feature: Ceres ANNOT ID no. 6054759
  misc_feature (1)..(460): NCBI GI: 116309296 NCBI Desc: osigba0134j07.3 [oryza sativa (indica cultivar-group)]
  misc_feature (1)..(459): NCBI GI: 116309295 NCBI Desc: osigba0134j07.2 [oryza sativa (indica cultivar-group)]
  misc_feature (1)..(462): NCBI GI: 42572201 NCBI Desc: f-box family protein (fbl14) [arabidopsis thaliana]
  misc_feature (32)..(301): NCBI GI: 38605924 NCBI Desc: osjnbb0076a22.3 [oryza sativa (japonica cultivar-group)]
  misc_feature (32)..(301): NCBI GI: 116309297 NCBI Desc: osigba0134j07.4 [oryza sativa (indica cultivar-group)]
MDDLPEAMHAEIVKRLTCPNDLKSLSLVSKRLYAIEGELRNSICIGCGVFPVTVALIRLCSRYPNLCKVEFNYSGWTSNHGMQLDKHGLQVFSSCCASLTDLTLSFCTNVDDSGLRLLACFKKMMSLRLNTLPAITSSGLLQVAVGCKNLSCLHLIGCNKVGGAMWLEYLGRFGSLKELVLNRCEKISQFDLLKFGAGWMKLQKFEFQIKGCLCVSDPCDPSCVEHCQYRYDFSCESLEDLTLARVLTEKEIGLRCLLRKCKALKNLCLYYVHGLQDNDMVTLSNNCTNLTSISLRLIPQHTEGYIFRTSLTDDTLKALALRCRKLQSFELILCGCDERWPEIGFTQEGLVMLIQSCPIRNLVLSGAHIFDDEGMKAISSAQFLESLELMHCINVTNAGMRLLAHCPCLINLTLRHCHRFSDAGVTEVARARKLETLVIEGCSQVPPEAARGAATSVHYKEDGPGLVGLGRV

SEQ ID NO: 12087 - DNA, 1722 bp, Sorghum bicolor
  misc_feature: Ceres ANNOT ID no. 6054791
  misc_feature: Encodes the peptide sequence at SEQ ID NO 12088
atgtataagaaccagctccaggagcttgcgcagaggagctgcttcaatctgccgtcctattcctgcatccgggagggaccggatcatgcaccccggtttaaggccacagttaatttcaatggggagatgttcgagagccccgcgttttgttctactttgcggcaggcggagcatgcggcagctgaggtagcgctcaatgagttatcgaagaggggcccttcgtcgacgctggctgccaaagttctggatgaaaccgggatatacaagaatcttcttcaagaaactgctcatcgagctggtctaaaactccccatctatactactattagatctgggccaggtcatacacctgtgttcacatgcacagtggagttggcaggaaagacatttactggcaatcctggaaagaccaagaagcaagctcaaaaaaatgctgcaatggctgcctggtctgacttgaagcaactgcccaggataggtgagccgtcatcgtcatcatgtccggctgatcaggatgatgaagagcaggaacaggtcatagttactcgtactcttgcaagcttgaaccaggcaaatattggtaaggtgccacatcaaaaggaaaaacagcaaacaaataaccgcccatcatcacagagatcttatcctaagccaaatacatcattctaccggccatatatgcaaaatcaggcttatcctagtgttccaccagatcaagctatgtaccatctatgggatcggatgcaagcgacacagccaacgcctcgctttccagtggtaccaactatgggtaatacaaggtttcccccaccagcagctatgctccccatgtaccctccacctcgagggcaattctccaatccggctaaccaggatgctctaggtcttcttccatgttttcctgaagctgctcctgccgtgccacggtacttctcaccttaccctgtctcctatgtgccaagaagtcctttgccagttactgttcacaaaattcatgagaaaaggcaggaccacactgaaacagtcgagcttcctgacgctgcagtattctcgccatgcactacctttgattcctttaggacatcagaatgtggtggtccaccacgcaaggttcaagaaccaaccaaaaatgggaaagaaggctgtactgggagcagtacttcccctgcggaagaacataacactctcactgtcccaagctctaccacacaatcgtcattgcacaaattggaaccaaatgaagatgagcaaacattgcaggcaggtttgaagcaggcccatgaacaacaactaatgccatcctcgtcttgtgttagtcctttagttacagcacagaactctgtccagcgaaagcattatgctagctccatccagcatgagcctatacatagaaggaatcctcctcatactaacccacctgcattgcctgatctgtggtcttcccactcgcaagctctacccagatttggatctgcacctcctgtaaactcaagttcagttttccagcagcgacctccttggttggctgcactggtcacagttcgtacagctgttcctgtctgctcagccaggccaaatgtgggaacagctccagcaagacctgcttcccagaaccgctctgcaccagctagggctgagcccgaatctcgtacccataatggggagagagatctgaacagtgcggcaatatcgagttctgaattcaataaactccacatttga

SEQ ID NO: 12088 - protein, 573 aa, Sorghum bicolor
  misc_feature: Ceres ANNOT ID no. 6054791
  misc_feature (2)..(68): Pfam Id: dsrm Pfam Desc: Double-stranded RNA binding motif
  misc_feature (88)..(153): Pfam Id: dsrm Pfam Desc: Double-stranded RNA binding motif
  misc_feature (1)..(525): NCBI GI: 115462131 NCBI Desc: os05g0150400 [oryza sativa (japonica cultivar-group)]
  misc_feature (1)..(392): NCBI GI: 102139807 NCBI Desc: double-stranded rna-binding (dsrbd) domain-containing protein [musa acuminata]
  misc_feature (1)..(403): NCBI GI: 92875779 NCBI Desc: double-stranded rna binding [medicago truncatula]
  misc_feature (1)..(331): NCBI GI: 92872274 NCBI Desc: double-stranded rna binding [medicago truncatula]
  misc_feature (1)..(149): NCBI GI: 27262839 NCBI Desc: dsrna-binding protein [brassica oleracea var. gemmifera]
MYKNQLQELAQRSCFNLPSYSCIREGPDHAPRFKATVNFNGEMFESPAFCSTLRQAEHAAAEVALNELSKRGPSSTLAAKVLDETGIYKNLLQETAHRAGLKLPIYTTIRSGPGHTPVFTCTVELAGKTFTGNPGKTKKQAQKNAAMAAWSDLKQLPRIGEPSSSSCPADQDDEEQEQVIVTRTLASLNQANIGKVPHQKEKQQTNNRPSSQRSYPKPNTSFYRPYMQNQAYPSVPPDQAMYHLWDRMQATQPTPRFPVVPTMGNTRFPPPAAMLPMYPPPRGQFSNPANQDALGLLPCFPEAAPAVPRYFSPYPVSYVPRSPLPVTVHKIHEKRQDHTETVELPDAAVFSPCTTFDSFRTSECGGPPRKVQEPTKNGKEGCTGSSTSPAEEHNTLTVPSSTTQSSLHKLEPNEDEQTLQAGLKQAHEQQLMPSSSCVSPLVTAQNSVQRKHYASSIQHEPIHRRNPPHTNPPALPDLWSSHSQALPRFGSAPPVNSSSVFQQRPPWLAALVTVRTAVPVCSARPNVGTAPARPASQNRSAPARAEPESRTHNGERDLNSAAISSSEFNKLHI

SEQ ID NO: 12089 - DNA, 798 bp, Sorghum bicolor
  misc_feature: Ceres ANNOT ID no. 6054991
  misc_feature: Encodes the peptide sequence at SEQ ID NO 12090
atgcctcgatacgatgatcgatatgattacaacgatcgatatgatcgccatggtcgatatggaagtaacaccaagttgtacgtgggccaaatttctccacatacccggacacaggatcatgaggaccttttcagcaaatatgggagattgcgtaatgtggatctgaagagggactttggctttgttgagttcagtgatcctcgggatgcagatgatgcaaggcatgaccttgatggccgaagatttgatgggagttacatcattgttgaatttgctagaggggcccgacggggtccaggaggtgttcctctagatgtcagaggaccaccttttcctggacgctgctataactgtggaatggatgggtgggttcgtgattgcaaagctgatgactggagagataggtgctttcggtgtggagaactgggccatatagaaagaaactgcaagaacagtcctaaggatctgaagcgcgggaggagctactcgaggtctccatctcctcaccatgggaagggccgagggagaagctactcgaagtctctatctcctcaccatggaaggggccgagggagaagctactcaaggtctccatctcattgtcgtgggaggggcagaagttggagttacagtcggtcgctttcgccaaggaacaaatttaaggctgatggtgaagaattgccaccaagaacctctggttacagccgcagccccaggaggagctccccaccaagggagcaaggttcataccatggtggtagccccatgagaggtgaagctcaggggaagtgtcagtga

SEQ ID NO: 12090 - protein, 265 aa, Sorghum bicolor
  misc_feature: Ceres ANNOT ID no. 6054991
  misc_feature (26)..(89): Pfam Id: RRM_1 Pfam Desc: RNA recognition motif. (a.k.a. RRM, RBD, or RNP domain)
  misc_feature (134)..(151): Pfam Id: zf-CCHC Pfam Desc: Zinc knuckle
  misc_feature (13)..(258): NCBI GI: 68035567 NCBI Desc: alternative splicing regulator [triticum aestivum]
  misc_feature (13)..(238): NCBI GI: 9843663 NCBI Desc: splicing factor rsz33 [arabidopsis thaliana]
  misc_feature (13)..(255): NCBI GI: 9795142 NCBI Desc: splicing factor-like protein [arabidopsis thaliana]
  misc_feature (55)..(255): NCBI GI: 24111329 NCBI Desc: at3g53500/f4p12_200 [arabidopsis thaliana]
  misc_feature (55)..(238): NCBI GI: 42571091 NCBI Desc: splicing factor rsz33 (rsz33) [arabidopsis thaliana]
MPRYDDRYDYNDRYDRHGRYGSNTKLYVGQISPHTRTQDHEDLFSKYGRLRNVDLKRDFGFVEFSDPRDADDARHDLDGRRFDGSYIIVEFARGARRGPGGVPLDVRGPPFPGRCYNCGMDGWVRDCKADDWRDRCFRCGELGHIERNCKNSPKDLKRGRSYSRSPSPHHGKGRGRSYSKSLSPHHGRGRGRSYSRSPSHCRGRGRSWSYSRSLSPRNKFKADGEELPPRTSGYSRSPRRSSPPREQGSYHGGSPMRGEAQGKCQ

SEQ ID NO: 12091 - DNA, 1971 bp, Sorghum bicolor
  misc_feature: Ceres ANNOT ID no. 6055014
  misc_feature: Encodes the peptide sequence at SEQ ID NO 12092
  misc_feature: Down-regulated in shoot tissues in response to salicylic acid treatment
atgcgagctctcgcggcagcagcaactgcagtggcggcgcctacccccgcgcgcctccgtttccgtctcccgctcctcccccgcgccccgcgctccggtcattgtagagctgcttcttcctccaggcttgtgcggttctcgtacagtgccaccaccatgggagatgagacctcgacctccattgctccccaggagcaggaatccaccgtgcgggctgggagtgtcaagcaacagctctccaggcttgtcctttcatccctccgggctaccgtgcctgatgtggaggtagaacccatggttgaagtttcagccaagtttgctgactaccagtgcaacaatgctatgggattatggtcaaaggttaaaggatctggaactagtttcaaaaaccctaatgccattgggcaggccattgctaagaacttgccttcttctgatattattgaatccacatctgttgctggacctggttttgtgaacattaccttatcaaaccgctgggttgcacagagaatacaagacatgcttgttaatggtatcaagacttgggcaccaactctgccagtaaagagggcagtgattgatttttcatcacctaatattgcaaaggaaatgcacgtgggacatttaaggtctacaattattggagatacattagcacgcatgtttgagttctcgaatgttgatgttctgcgaagaaatcatgtgggagattggggtacacagtttgggatgctaatagaatatctttttgagcaatttcctaattggaaggagataggtagccaggccattggggaccttcagattttctataaagcatccaagcacaagtttgacaatgatccagagtttaaagcaagggctcaacaaggagttgttcggctacagggaggggaggaaaaatatcgagaagcatggaaaaagatttgtgacattagcaggagcgaatttgacttggtctacaagcgcctaaatgtggtgcttgaagaaaagggggagagtttctataatccttatattcctcaagtgctggaggaattgaataacaaaggcttgatcaaggagagtgagggtgcccgagttatatttattcaaggtcatcaaatccctttgatagtggttaagagtgatggtggcttcaactatgcctcaacagacttaactgctctttggtatcggctcaatgttgagaaggcagaatggatcatatatgtgacagatgttggtcagcagcagcactttgacatgtttttcagtgctgcaaagatggccggttggctcccagatccaagtgaaaagaagtttccaaaaacaagccatgttggatttggtcttgttcttggttcagatggcaagcggttccgaacccgcagtactgaggttgttcgattggtagagctacttgatgaggctaaatctcggagcaaatcagaactacaacaacggctcactgaaaatggcaaaattgttgactggacggatgaggaattagagcaaacttcagaggcagttggatatggtgctgtgaagtatgctgatctcaagaataatcggctgactaattacacatttagttttgaacagatgctgagcgataagggaaatactgctgtgtaccttcagtatgcacatgctcgtatttgttccattattcggaaatccaacaaggatgtggaagagctgaagatgagcggagccatttctctcgaccatccagatgagcgtgtgttggggctatatcttatccgatttgcagaggttgttgaagaggcctgcacgaatctacttccaaatgttgtatgtgaatacttgtacaatctatctgaaatgttcacaaaattctataccaactgccaggtggtcgggtcaccggaggagacaagccgcctgttgctttgccaagcgactgctgttgtcatgcgacagtgcttcaacctgctcgggatcacaccagtctacaagctttga

SEQ ID NO: 12092 - protein, 656 aa, Sorghum bicolor
  misc_feature: Ceres ANNOT ID no. 6055014
  misc_feature (171)..(527): Pfam Id: tRNA-synt_1d Pfam Desc: tRNA synthetases class I (R)
  misc_feature (541)..(656): Pfam Id: DALR_1 Pfam Desc: DALR anticodon binding domain
  misc_feature (77)..(163): Pfam Id: Arg_tRNA_synt_N Pfam Desc: Arginyl tRNA synthetase N terminal domain
  misc_feature (71)..(656): NCBI GI: 9757672 NCBI Desc: similar to arabidopsis thaliana arginine--trna ligase (t06014) [oryza sativa (japonica cultivar-group)]
  misc_feature (73)..(656): NCBI GI: 2632106 NCBI Desc: arginyl-trna synthetase [arabidopsis thaliana]
  misc_feature (73)..(656): NCBI GI: 2632103 NCBI Desc: arginyl-trna synthetase [arabidopsis thaliana]
  misc_feature (74)..(656): NCBI GI: 140051251 NCBI Desc: arginyl-trna synthetase, class ic; dalr anticodon binding [medicago truncatula]
  misc_feature (74)..(656): NCBI GI: 92890568 NCBI Desc: arginyl-trna synthetase [medicago truncatula]
  misc_feature: Down-regulated in shoot tissues in response to salicylic acid treatment
MRALAAAATAVAAPTPARLRFRLPLLPRAPRSGHCRAASSSRLVRFSYSATTMGDETSTSIAPQEQESTVRAGSVKQQLSRLVLSSLRATVPDVEVEPMVEVSAKFADYQCNNAMGLWSKVKGSGTSFKNPNAIGQAIAKNLPSSDIIESTSVAGPGFVNITLSNRWVAQRIQDMLVNGIKTWAPTLPVKRAVIDFSSPNIAKEMHVGHLRSTIIGDTLARMFEFSNVDVLRRNHVGDWGTQFGMLIEYLFEQFPNWKEIGSQAIGDLQIFYKASKHKFDNDPEFKARAQQGVVRLQGGEEKYREAWKKICDISRSEFDLVYKRLNVVLEEKGESFYNPYIPQVLEELNNKGLIKESEGARVIFIQGHQIPLIVVKSDGGFNYASTDLTALWYRLNVEKAEWIIYVTDVGQQQHFDMFFSAAKMAGWLPDPSEKKFPKTSHVGFGLVLGSDGKRFRTRSTEVVRLVELLDEAKSRSKSELQQRLTENGKIVDWTDEELEQTSEAVGYGAVKYADLKNNRLTNYTFSFEQMLSDKGNTAVYLQYAHARICSIIRKSNKDVEELKMSGAISLDHPDERVLGLYLIRFAEVVEEACTNLLPNVVCEYLYNLSEMFTKFYTNCQVVGSPEETSRLLLCQATAVVMRQCFNLLGITPVYKL

SEQ ID NO: 12093 - DNA, 879 bp, Sorghum bicolor
  misc_feature: Ceres ANNOT ID no. 6055051
  misc_feature: Encodes the peptide sequence at SEQ ID NO 12094
atggccgcgccgctgctccggcaatggcgccgcctcgccgtgctcggcgccctcctcgcgctccacctcgccgccgccgtggcgcagtcgccaccagctgcacccacgacccctgctgctcccacgaccccggctgcacccacgacccctgccgcacctacgactccggctgcacccacgacccctgccgcacccacgactccggctgcaccgacgacccctgccgcacccacgacaccggctgcaccgacgaccccggctgcacccacgacccctgccgcacccacgactccggctgcaccgacgacccctgccgcacccacgacgccagcgacgccggcgcccactgccaccccgacaacgccagcgccgaccgccacccctgtggcgccagcaaagccgccgccggtcgcgccagccaaaccccctccggtggcgccaccaccggtcacgccaccccccacgacgccacccgcggtgctcccacccgccgtgcagccgcccgccgcggcgcctccgccgacggccacgcccccggccgaggcgcccgcgtcgctgcctcccgctacgacgcccccgcccgtggctgaggcccccgcgccgcccgcggagataccgcccgccgaggcgccgtccaagggcaagaacaagcacaagaggaggaagaagcagcacggcaagaaggaggcgcccgcggaagcgccgcagccgctgagcccgcctgctcccgccgcgccgtcgccggctgatctcgaggacgtgtccggccctgcaccgtcagcgtccgatgtgaatgcgagcaaccggcagcaccagcactgggcctccgtcgtcctgcagaccgccatggcggcgcttttgctatcgctagcgtggtaa

SEQ ID NO: 12094 - protein, 292 aa, Sorghum bicolor
  misc_feature: Ceres ANNOT ID no. 6055051
  misc_feature (12)..(260): NCBI GI: 117606933 NCBI Desc: vegetative cell wall protein [chlamydomonas incerta]
  misc_feature (24)..(263): NCBI GI: 31414574 NCBI Desc: large tegument protein [cercopithecine herpesvirus 1]
  misc_feature (30)..(260): NCBI GI: 12018147 NCBI Desc: vegetative cell wall protein gp1 [chlamydomonas reinhardtii]
  misc_feature (23)..(259): NCBI GI: 30844278 NCBI Desc: very large tegument protein [cercopithecine herpesvirus 1]
  misc_feature (25)..(259): NCBI GI: 41400381 NCBI Desc: minus agglutinin [chlamydomonas reinhardtii]
MAAPLLRQWRRLAVLGALLALHLAAAVAQSPPAAPTTPAAPTTPAAPTTPAAPTTPAAPTTPAAPTTPAAPTTPAAPTTPAAPTTPAAPTTPAAPTTPAAPTTPAAPTTPATPAPTATPTTPAPTATPVAPAKPPPVAPAKPPPVAPPPVTPPPTTPPAVLPPAVQPPAAAPPPTATPPAEAPASLPPATTPPPVAEAPAPPAEIPPAEAPSKGKNKHKRRKKQHGKKEAPAEAPQPLSPPAPAAPSPADLEDVSGPAPSASDVNASNRQHQHWASVVLQTAMAALLLSLAW

SEQ ID NO: 12095 - DNA, 1989 bp, Sorghum bicolor
  misc_feature: Ceres ANNOT ID no. 6055079
  misc_feature: Encodes the peptide sequence at SEQ ID NO 12096
atggcggcggaagcgccaccgtcggcgtcctcctcctcctcctcggccccgcggccgcctgccgcggccgcggccgggtccggcggcggcggggcggccgggtccgcggagtcgtacatcgggagcctcatcagcctgacctccaagagcgagatcaggtacgagggcgtcctctacaacatcaacaccgaggagtccagcatcggcctccgcaatgtgaggtcctttgggaccgaagggcggaagaaagacggaatgcagattcctgctagcgacaaagtttacgagtacatcctctttcggggaactgatatcaaggacttgcaagttaagtcatcaccaccaccgccaccaccaccacaagcagcttccctgcacaacgatcctgccataatccagtcacattattctcaaccagcatcaacttcgtcaagtttgccttcagctgggggtgcagttttaccagacctcagctcccaggcagttcaatatgggcttcagaggccagcttttcagagtaaccttcctctataccaaccagggaatgctgctccatggggctcttcagtggcacctccagcaggaaatgctccgtggggctcttcagtggcgcctccagcaggaaatgcttcaacactttcagttccctcaatgtactggcaaggatactatgcgccttcaagtgggctgccacctcatttgcagcaacctcctttgcttcagccaacaccaggattgtcagttccccagaatcttcaatatccaggactaaatccttctttgccatctgggccacaaaagctgtcagaactccaaccctcattgatgccacctattactagtcaaggtccttcgacaggtgtcctgcctgctacaacagctcctgcttctgctaccttattagctccagaaagctcaaagcctctgttgccaaacatggggtcattgtttactcctcctgcaacatctcttggcgcaacttttccttttccaagccagccaacttccgtggctgaaactagtgcaacagtgtcacataacttaacttcattcggtagcaacaaggctactgctcttccaggctcaacactggcataccaaactgtatctcagtctgtttcttcaactattgccccatctagctcagcccaagtggagatgcccgtgcctttgttggcaccatcaggtcaactattgcagaacacatcatctgtgctctcatcgtcgcactccatgcaggcaccattacaggtggccagcaaagaagtcaagccagttgagcctaaggctaaggttgcagaaccattactacctgaccctttgctaccagacccaccatcacgggctctgcctgaaaataaggagcctatattgccattgccaaaacagacacctcagaagtacaatggatctggttcgcacaaccatcacaactttaggggccgtggaaggggtagagggagcgcgttttcacagtctgtaacagcattcactgaagaatttgatttcacggccatgaatgagaagtttaacaaagatgaagtctggggtcatcttggtaagaaatcccagtcaagggacaaggatggtgaggtgggagatgatgtgtttgatgaagacctggaggttgaggaaactgacaacccagagctagctgttaagcctgtttatgtcaaggacgacttttttgattccctctctagtggaacatttggacgtggagggccaaatggaaggggcagaccttctgaacggcgtagagtagacacagagacgtttggtgaatttccaaggcacaggcagccttatcgtggtggcgcccgaggttaccgtggtggagggcgttctcgtggttcatattatggtggcagaggctatggaaacacagggatgggaggctatggaaacacagggacaggtggctatggaaacacaggggcaggtggccctggaaattcgtatcctcaccggggctatgggagagattga

SEQ ID NO: 12096 - protein, 662 aa, Sorghum bicolor
  misc_feature: Ceres ANNOT ID no. 6055079
  misc_feature (24)..(639): NCBI GI: 18700276 NCBI Desc: at1g26110/f28b23_21 [arabidopsis thaliana]
  misc_feature (32)..(471): NCBI GI: 52077401 NCBI Desc: alphasnbp(b)-like [oryza sativa (japonica cultivar-group)]
  misc_feature (329)..(652): NCBI GI: 52851170 NCBI Desc: nod factor-like protein [plantago major]
  misc_feature (39)..(148): NCBI GI: 50540536 NCBI Desc: zgc:77202 [danio rerio]
  misc_feature (39)..(148): NCBI GI: 47550811 NCBI Desc: zgc:55754 [danio rerio]
MAAEAPPSASSSSSSAPRPPAAAAAGSGGGGAAGSAESYIGSLISLTSKSEIRYEGVLYNINTEESSIGLRNVRSFGTEGRKKDGMQIPASDKVYEYILFRGTDIKDLQVKSSPPPPPPPQAASLHNDPAIIQSHYSQPASTSSSLPSAGGAVLPDLSSQAVQYGLQRPAFQSNLPLYQPGNAAPWGSSVAPPAGNAPWGSSVAPPAGNASTLSVPSMYWQGYYAPSSGLPPHLQQPPLLQPTPGLSVPQNLQYPGLNPSLPSGPQKLSELQPSLMPPITSQGPSTGVLPATTAPASATLLAPESSKPLLPNMGSLFTPPATSLGATFPFPSQPTSVAETSATVSHNLTSFGSNKATALPGSTLAYQTVSQSVSSTIAPSSSAQVEMPVPLLAPSGQLLQNTSSVLSSSHSMQAPLQVASKEVKPVEPKAKVAEPLLPDPLLPDPPSRALPENKEPILPLPKQTPQKYNGSGSHNHHNFRGRGRGRGSAFSQSVTAFTEEFDFTAMNEKFNKDEVWGHLGKKSQSRDKDGEVGDDVFDEDLEVEETDNPELAVKPVYVKDDFFDSLSSGTFGRGGPNGRGRPSERRRVDTETFGEFPRHRQPYRGGARGYRGGGRSRGSYYGGRGYGNTGMGGYGNTGTGGYGNTGAGGPGNSYPHRGYGRD

SEQ ID NO: 12097 - DNA, 780 bp, Sorghum bicolor
  misc_feature: Ceres ANNOT ID no. 6055090
  misc_feature: Encodes the peptide sequence at SEQ ID NO 12098
atggcggagaaagacttcgccgacggcgttggcgccgtggacgagcaggacttggagcggtcttgccgtgaccaggatgatccagccgccgctgcagatggtgtcagcagaggcctagccatcggtcatttcgtacgggaggagatgcacggcacgctgacgttccccatggtgtgcctcgtcgtcgctctcaccgtcggcttcgtgctctgctggctcggccccgcgcacttcaaccccgccgtcaccctcaccttcaccgtcttcggctacctcccgtggcccaagctggccggctcgctgctcgcgtgcgtggcggcgaacggcgtcatgaagccgcgggaggagcacttctacgggacggccccgatgatggccggcggccacaccaggctgccgttcctcctcgagctcgtcgcctccgcggtgctcatgatcgtcatcgccatcgctgccagaggctccaatcagacagcaggagggctggccatcggagccgccgtcggcaccctgggtctcgtcatcgggccagtgtccggagggtcgatgaacccgatcaggacgctgggtccggccatcgtgctcggcaggtacacctccgtctggatctacctcgtcgcgcccgtcgccggcatgctcatcggcgcgctctgcaaccgcgtcgtcaggggctccgacgccatcctcgccttcctctgcggcaccaagccgacgagagcggtggcgcccagagccacgccgcgcgccgttggatcacttgcgtcgtcgccgcactactag

SEQ ID NO: 12098 - protein, 259 aa, Sorghum bicolor
  misc_feature: Ceres ANNOT ID no. 6055090
  misc_feature (24)..(219): Pfam Id: MIP Pfam Desc: Major intrinsic protein
  misc_feature (45)..(256): NCBI GI: 13447785 NCBI Desc: nod26-like membrane integral protein zmnip1-1 [zea mays]
  misc_feature (51)..(244): NCBI GI: 10177172 NCBI Desc: pollen-specific membrane integral protein [arabidopsis thaliana]
  misc_feature (45)..(223): NCBI GI: 50251783 NCBI Desc: major intrinsic protein [oryza sativa (japonica cultivar-group)]
  misc_feature (45)..(223): NCBI GI: 440869 NCBI Desc: major intrinsic protein [oryza sativa]
  misc_feature (45)..(235): NCBI GI: 115435140 NCBI Desc: os01g0202800 [oryza sativa (japonica cultivar-group)]
  misc_feature: Useful for making plants with modulated drought sensitivity
  misc_feature: Useful for making plants with modulated silicon content
  misc_feature: Functional homolog of the protein sequence given in SEQ ID NO 13421
  misc_feature: Functional homolog of the protein sequence given in SEQ ID NO 13422
MAEKDFADGVGAVDEQDLERSCRDQDDPAAAADGVSRGLAIGHFVREEMHGTLTFPMVCLVVALTVGFVLCWLGPAHFNPAVTLTFTVFGYLPWPKLAGSLLACVAANGVMKPREEHFYGTAPMMAGGHTRLPFLLELVASAVLMIVIAIAARGSNQTAGGLAIGAAVGTLGLVIGPVSGGSMNPIRTLGPAIVLGRYTSVWIYLVAPVAGMLIGALCNRVVRGSDAILAFLCGTKPTRAVAPRATPRAVGSLASSPHY

SEQ ID NO: 12099 - DNA, 1230 bp, Sorghum bicolor
  misc_feature: Ceres ANNOT ID no. 6055962
  misc_feature: Encodes the peptide sequence at SEQ ID NO 12100
atggcaccgccgtcgctgctcggcagcaccgacctctggcggcccgttgccgccgcccgcgggggaggctgggccacggccgccgcgctcctcctcatcctcgcctcccacctcgtcgtcctcctcgtccgccgccgcctccgcctccgcctccgcggcggggggcgaatcgcgcaaccggaggccgccgtggcacccgcgcctgcctccgcgtccaccggttccgcctcaggaatagagggactagtgacggagggcgatctgaggcagctggtgggcagtctgggcttgagcgcgcgtgagccagagacgcagggctgggagcacgtcatctccaagagcaacgacgacgtctcctacaaggcctggtgcgacaagcccacagctggccctcctaaatatctgagtattacaacatacgagagatgctcgactgagcagttgagggacttctacatggataatgagtacagaatggagtgggataacactgtcacaaaacatgagcagctgcagtatgatgagaacagtggggtggaggtagggcgaacaattaagaagtttccacttctcacaccaagagaatacatattggcatggcgagtctgggaagcagatgacaagtctttctattgctttatcaaggaatgtgaacaccctcttgcggcacggcagagaaagtttgttagagtgcgacttctaagatcaggatggtgtattaggaaaatcccaggcagggatgcatgccaaatcacagtgctgcatcatgaggacaatggaatgaacatagagatggcaaaactagccttttccaagggcatctggagctacatatgtaaaatgaacaatgctctacgtcggtatcctcagcatcgcagtccatcactgtcgattctgaccatgcagaaacttatgaagaagtttccccaggacctggaggccaccgatgcaagcctttctgcttcacagaatactgcagcatcggtcattccttcaacaccaactgccaggacttcaccatgcaagcttccggggaagaagtcatctcgccaaatgattgcgagcggacttctgctggttggaagcatcgtttgtctatctcgaggccgatccaacctcggggcgcagctcgcgatggccttcttcttgaagaaggccttcaagcaagagagggaatcaggctcatcgacatcaagggcaaaaacagacgtgcatagatgcaggcggtag

SEQ ID NO: 12100 - protein, 409 aa, Sorghum bicolor
  misc_feature: Ceres ANNOT ID no. 6055962
  misc_feature (31)..(388): NCBI GI: 92892068 NCBI Desc: lipid-binding start [medicago truncatula]
  misc_feature (24)..(242): NCBI GI: 8778323 NCBI Desc: f14j16.24 [arabidopsis thaliana]
  misc_feature (24)..(335): NCBI GI: 10172593 NCBI Desc: protein kinase-like protein [arabidopsis thaliana]
  misc_feature (33)..(337): NCBI GI: 115470931 NCBI Desc: os07g0185200 [oryza sativa (japonica cultivar-group)]
  misc_feature (67)..(402): NCBI GI: 10178166 NCBI Desc: membrane related protein-like [arabidopsis thaliana]
MAPPSLLGSTDLWRPVAAARGGGWATAAALLLILASHLVVLLVRRRLRLRLRGGGRIAQPEAAVAPAPASASTGSASGIEGLVTEGDLRQLVGSLGLSAREPETQGWEHVISKSNDDVSYKAWCDKPTAGPPKYLSITTYERCSTEQLRDFYMDNEYRMEWDNTVTKHEQLQYDENSGVEVGRTIKKFPLLTPREYILAWRVWEADDKSFYCFIKECEHPLAARQRKFVRVRLLRSGWCIRKIPGRDACQITVLHHEDNGMNIEMAKLAFSKGIWSYICKMNNALRRYPQHRSPSLSILTMQKLMKKFPQDLEATDASLSASQNTAASVIPSTPTARTSPCKLPGKKSSRQMIASGLLLVGSIVCLSRGRSNLGAQLAMAFFLKKAFKQERESGSSTSRAKTDVHRCRR

SEQ ID NO: 12101 - DNA, 741 bp, Sorghum bicolor
  misc_feature: Ceres ANNOT ID no. 6056072
  misc_feature: Encodes the peptide sequence at SEQ ID NO 12102
atgagtaataagcttggaaacatgttctcggctctgtgtctggatgctgaagatgaccgagttgaagtaccacaggcgcctcccagcacagacgaaactgctccaagcaaacctgataaaaatgagcagaatgacacaactgcagtaaagtatgaggaggcagcacttgtatcatcatctggtgattacagaatgcctttggtatggatagacttggaaatgaccggtttggatattacaaaagatcggattttggagattgcttgtatcataacggatggtaaacttacaaaacaaattgagggtcctgacttggttataggccagagcaaagattgtttagataatatgggtgaatggtgcaaaactcatcatgcagctagtggtttgacagaaagagtgctgcagagtgaactttctgaacatgatgcagaggcaaaagttttagactttgttaggaagcacataaattcaggcactccattattagctgggaattctgtttatgtggatttactatttctgaagaagtacatgccacagcttgcagctgtcttctctcatgtaattgttgatgtgagcagtataatggctttatgcgtacgatggtaccccaaagaaaggaaacaaactccaagaaagcaaaaaacccacagggcaatggatgatattaaagaaagcatcgccgaactgaagtactataaggacaacattttcaaaccacagaaatcaaagcggtag

SEQ ID NO: 12102 - protein, 246 aa, Sorghum bicolor
  misc_feature: Ceres ANNOT ID no. 6056072
  misc_feature (67)..(231): Pfam Id: Exonuc_X-T Pfam Desc: Exonuclease
  misc_feature (3)..(245): NCBI GI: 38344589 NCBI Desc: osjnba0079m09.9 [oryza sativa (japonica cultivar-group)]
  misc_feature (3)..(245): NCBI GI: 116308941 NCBI Desc: osigba0092o07.3 [oryza sativa (indica cultivar-group)]
  misc_feature (61)..(243): NCBI GI: 79323145 NCBI Desc: exonuclease [arabidopsis thaliana]
  misc_feature (46)..(240): NCBI GI: 62901864 NCBI Desc: cgi-114 [synthetic construct]
  misc_feature (52)..(240): NCBI GI: 85397892 NCBI Desc: small fragment nuclease [homo sapiens]
MSNKLGNMFSALCLDAEDDRVEVPQAPPSTDETAPSKPDKNEQNDTTAVKYEEAALVSSSGDYRMPLVWIDLEMTGLDITKDRILEIACIITDGKLTKQIEGPDLVIGQSKDCLDNMGEWCKTHHAASGLTERVLQSELSEHDAEAKVLDFVRKHINSGTPLLAGNSVYVDLLFLKKYMPQLAAVFSHVIVDVSSIMALCVRWYPKERKQTPRKQKTHRAMDDIKESIAELKYYKDNIFKPQKSKR

SEQ ID NO: 12103 - DNA, 951 bp, Sorghum bicolor
  misc_feature: Ceres ANNOT ID no. 6056960
  misc_feature: Encodes the peptide sequence at SEQ ID NO 12104
atggatcacgccgccgagcacctcgaccccaccactccggcaccctcgtctgcctcctcctccgccgccgtcgccgaggtaaatgcgtggctggcctccctcgccgcggaggcgggaggcccgggcggggccggagggcgaggcggcggcggaggtgcggtggcggagctgtcgctggggtccgaccccacaccgcgcggggtggcctacctccgcgcgctggcctctgcgtcgcaggcgcggtcccgcgccgccggaatcgcggctgcggggctgcgtgcgcaggcggccgagtaccgcgccgaggcggcgcggttgcgggaggctctcgagcgggcggggctcgcgagggacgcgctcccaccacccgcagccgcggcggcacgagctgtcgctgcagtcgctaacctcctcgccatccgtgacaccgagatgagcagctttgtggtagcaagtgcagacttgtctctgaggcgagcagaggtggaggagaagagggacaaagtgcataaggagtcaaaggcactacttgattacacgcggaaggccataaacaagcttactgagctgaagaagatgctggaaaaattcaaaaatgatgtggagaagcaacaagtggaccaaatggcagattggcaaacaaagcttgttatgatggactccaaggagcggcagtatatcctccaagtctcaaattataaggcaatgcttaatcgagtgggttatacgccggagatcaatcatggtgtgttgatggaaatggctgagcataagaaggatctcgagaggaagacaaaacccatagccgatacattaaggagctaccaggatttgcctccagataaagctctagctgcactagctatagaggacaaaaagaggcagtatgcagccgcagagaagtacctagaagatgtgttgcaatctgctctaaccacaactggcctataa

SEQ ID NO: 12104 - protein, 316 aa, Sorghum bicolor
  misc_feature: Ceres ANNOT ID no. 6056960
  misc_feature (1)..(234): NCBI GI: 115475475 NCBI Desc: os08g0240600 [oryza sativa (japonica cultivar-group)]
  misc_feature (16)..(234): NCBI GI: 140059868 NCBI Desc: helix-turn-helix, arac type [medicago truncatula]
  misc_feature (66)..(303): NCBI GI: 119850966 NCBI Desc: coiled-coil domain containing 5 [rattus norvegicus]
  misc_feature (65)..(303): NCBI GI: 34328690 NCBI Desc: enhancer of invasion-cluster [homo sapiens]
  misc_feature (39)..(144): NCBI GI: 455743 NCBI Desc: brn-3.0=pou-domain protein [mice, trigeminal ganglion, peptide, 420 aa]
  misc_feature: The plant flowers significantly late compared to wild-type.
  misc_feature: Useful for making plants with modulated flowering time
  misc_feature: GREAT-hit functional homolog of the protein sequence given in SEQ ID NO 12906
  misc_feature: Useful for making plants with modulated flowering time
  misc_feature: Functional homolog of the protein sequence given in SEQ ID NO 12906
MDHAAEHLDPTTPAPSSASSSAAVAEVNAWLASLAAEAGGPGGAGGRGGGGGAVAELSLGSDPTPRGVAYLRALASASQARSRAAGIAAAGLRAQAAEYRAEAARLREALERAGLARDALPPPAAAAARAVAAVANLLAIRDTEMSSFVVASADLSLRRAEVEEKRDKVHKESKALLDYTRKAINKLTELKKMLEKFKNDVEKQQVDQMADWQTKLVMMDSKERQYILQVSNYKAMLNRVGYTPEINHGVLMEMAEHKKDLERKTKPIADTLRSYQDLPPDKALAALAIEDKKRQYAAAEKYLEDVLQSALTTTGL

SEQ ID NO: 12105 - DNA, 2064 bp, Sorghum bicolor
  misc_feature: Ceres ANNOT ID no. 6057032
  misc_feature: Encodes the peptide sequence at SEQ ID NO 12106
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
atggactcggcgacgacgtcgggggcgatggagctggtggcggcgctgctgcggggccgggtgccgccggagctgatgggcggggacggcgccgagggccgggcgctcgtcgccacgctcgccgccgccgtgctcggcgccgcgctcttcgtgctctggaggcgcgccgccgccgggaagaaccccaagcaggaggccgccgccgccgccgcggccgacgacggcaggaagaaggtcaccgtcgtcttcggcacgcagaccggcaccgccgaggggttcgccaaggcgcttgctgaggaggcgaaggcaagatatgacaaggcaatcttcaaagttgtggacttggatgattatgcagcagaggatgaggaatatgaggagaagttgaagaaggagaagctagcattgttcttcgtggcaacgtatggagatggtgagccgaccgacaatgctgctaggttctacaaatggttcactgagggaaatgagaggggtgtctggttaaatgactttgagtatgctgtctttggtctgggcaatcgacagtatgagcatttcaacaaggttgccaaggtggtagatgagatcctaacagaacaaggtggaaagcgccttgttccagttggtcttggagacgatgaccaatgcattgaggatgacttcaatgcatggaaagaagctctctggccagagttggatcgattacttcgggatgaaaatgatgcctctacaggcactacatacacagctgctattcctgaataccgggttgaattcatcaaacctgaggaggcagctcatttggagagaaacttcagccttgcaaatggccatgcagtccatgatgcccagcatccttgccaggctaatgtggctgtgcggcgggagctccacacccctgcttctgatcgttcatgcacccatttggagttcgacattgctggaactggtctcacgtatgagactggggaccatgttggtgtatacaccgagaactgccctgaggttgtagaggaggcagagaggttgttgggctactcgccagacacatttttcaccatccatgcagacaaagaggatggtactccactaagtggcagttctcttgctcctccattcccctccccaatcacagtgaggaatgcacttgctagatatgctgaccttctaaattcaccgaagaagacttctctggttgcattagctacttatgcttcagatccggctgaggctgaccgcctgagattcttggcctctgccgctgggaaggatgagtatgctcaatgggttgtggcaagtcagaggagcctgttggaagtcatggcagagttcccttcggcaaagcctccactaggtgtcttctttgcagctgttgcccctcgtcttcaaccaagatattattctatttcatcttcacctagtatggcagcaaccaggattcatgtcacatgtgcgctcgtgcacgaaacaacacccgctggaagggtacataagggagtctgctcaacttggattaagaatgctgttccatcagaagagagcaaggattgcagctgggctccgatatttgtgaggcaatcaaacttcaaactacccgctgatccttcagtgccaatcatcatgattggccctgggaccggtcttgcacctttccgcggcttcttgcaggagagactagctcaaaaagaatctggagctgagcttggtccatccgtgttcttcttcggatgcagaaatagcaagatggacttcatctatgaggatgagctgaacaatttccttgagcaaggagcactgtctgagctggttcttgccttctcgcgtcagggccctactaaggaatatgtgcaacacaaaatggcacagaaagcatctgaaatctgggacatgatatcccaaggtgcttacatctatgtctgtggtgatgccaaaggcatggccagagatgtacatagagttctccacaccattgttcaggagcagggctccctcgacagttctaaggccgagagctttgtgaagaatctccaaatggagggcagatatctgagggatgtgtggtaa

SEQ ID NO: 12106 - protein, 687 aa, Sorghum bicolor
  misc_feature: Ceres ANNOT ID no. 6057032
  misc_feature (279)..(504): Pfam Id: FAD_binding_1 Pfam Desc: FAD binding domain
  misc_feature (81)..(224): Pfam Id: Flavodoxin_1 Pfam Desc: Flavodoxin
  misc_feature (540)..(652): Pfam Id: NAD_binding_1 Pfam Desc: Oxidoreductase NAD-binding domain
  misc_feature (56)..(687): NCBI GI: 115475499 NCBI Desc: os08g0243500 [oryza sativa (japonica cultivar-group)]
  misc_feature (1)..(687): NCBI GI: 18103933 NCBI Desc: cytochrome p450 reductase [triticum aestivum]
  misc_feature (36)..(687): NCBI GI: 13183564 NCBI Desc: nadph-cytochrome p450 oxydoreductase isoform 2 [populus balsamifera subsp. trichocarpa x populus deltoides]
  misc_feature (9)..(687): NCBI GI: 38345905 NCBI Desc: osjnba0060d06.20 [oryza sativa (japonica cultivar-group)]
  misc_feature (36)..(687): NCBI GI: 13183566 NCBI Desc: nadph-cytochrome p450 oxydoreductase isoform 3 [populus balsamifera subsp. trichocarpa x populus deltoides]
  misc_feature (36)..(687): SWISSPROT Homolog: EC 1.6.2.4 NADPH--cytochrome P450 reductase
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
MDSATTSGAMELVAALLRGRVPPELMGGDGAEGRALVATLAAAVLGAALFVLWRRAAAGKNPKQEAAAAAAADDGRKKVTVVFGTQTGTAEGFAKALAEEAKARYDKAIFKVVDLDDYAAEDEEYEEKLKKEKLALFFVATYGDGEPTDNAARFYKWFTEGNERGVWLNDFEYAVFGLGNRQYEHFNKVAKVVDEILTEQGGKRLVPVGLGDDDQCIEDDFNAWKEALWPELDRLLRDENDASTGTTYTAAIPEYRVEFIKPEEAAHLERNFSLANGHAVHDAQHPCQANVAVRRELHTPASDRSCTHLEFDIAGTGLTYETGDHVGVYTENCPEVVEEAERLLGYSPDTFFTIHADKEDGTPLSGSSLAPPFPSPITVRNALARYADLLNSPKKTSLVALATYASDPAEADRLRFLASAAGKDEYAQWVVASQRSLLEVMAEFPSAKPPLGVFFAAVAPRLQPRYYSISSSPSMAATRIHVTCALVHETTPAGRVHKGVCSTWIKNAVPSEESKDCSWAPIFVRQSNFKLPADPSVPIIMIGPGTGLAPFRGFLQERLAQKESGAELGPSVFFFGCRNSKMDFIYEDELNNFLEQGALSELVLAFSRQGPTKEYVQHKMAQKASEIWDMISQGAYIYVCGDAKGMARDVHRVLHTIVQEQGSLDSSKAESFVKNLQMEGRYLRDVW

SEQ ID NO: 12107 - DNA, 180 bp, Sorghum bicolor
  misc_feature: Ceres ANNOT ID no. 6057568
  misc_feature: Encodes the peptide sequence at SEQ ID NO 12108
atggcaggtggtggcgccaacgacgatgacgtggtggaggtgagctgcggcggcagaggcggcggcgaccccgacgcgtacgccgcagtgctcaagaggaagcttgacctgtactgcgccgccgtcgccaaatccatggtgtggtttctcctcttcttcctctcttccttcaaagattag

SEQ ID NO: 12108 - protein, 59 aa, Sorghum bicolor
  misc_feature: Ceres ANNOT ID no. 6057568
  misc_feature (17)..(46): NCBI GI: 115489448 NCBI Desc: os12g0601600 [oryza sativa (japonica cultivar-group)]
MAGGGANDDDVVEVSCGGRGGGDPDAYAAVLKRKLDLYCAAVAKSMVWFLLFFLSSFKD

SEQ ID NO: 12109 - DNA, 1530 bp, Sorghum bicolor
  misc_feature: Ceres ANNOT ID no. 6057830
  misc_feature: Encodes the peptide sequence at SEQ ID NO 12110
atgagatcagtcgttcggtcgcttcgacagcgtcatcgtttcacccagcatcatgcagagaggcagtcaccagccaccagattgatcaggcagcagaatgctttaatcatgtgcagttcgacaactcgttcactgagcatgttatgccgtaatagtgaaactagcagatttgcaagccctgccgtggagttgatgaagtccatgttctccactatagcggctgattcgatcaaagatattagaggaggtggtccgatggtggaatatgataggagaatagcatcaggagagctagtagatggtgatagctttcaggttgatacaattcaacaattacaaaggctctataaggagttgattgagaatgaagaagattgcaagctggacagatataagtcatctgagaaatcaggacggagtcgatggctatggtcccgcctcattactcagccttctacctatgctccagttaaggggctttacctctatggtggtgtcggtacagggaaaacgatgcttatggacctgttctatgaacagctgccatctaactggagaaaaaaacgtattcactttcatgatttcatgttgaacgtacatagtcatcttcagatgcataaaggtgtttcagatccccttgatgttgtagcagctgagatttcagatgaggccatcatattatgtcttgatgagtttatggtaactgatgttgctgatgctatgattctgaaccggctgtttagacaattgttcagcaaaggcgttattcttgtttcgacttctaaccgcgctccagataagctttatgaaggtggcttacagcgggaccttttcttgccattcattgataccttgaaagaaaggtgcatcgcgcaccccattggatctgcagtggactatcgccaaatgggttctgctgagcaaggtttctatttcgtcggaaaacattacaatacacttctgaaacagaggctccagtctttaattggagatgacgaacccagcccacaaactgttgaagtaattatgggaaggaaattaccggttccccttggagcaaatggttgtgcgtattttccttttgaagacctttgtgataaacctttaggcgcagcagattattttggactttttaaaaaatttcacaccctggcacttgatggtgttccaaagtttgggtctagtaacagaacatcagcttatcggttcgtcacactgattgatgttatgtacgagaacaaagcaaggttgttatgtacagctgaggctggaccaatagatctgtttgagaatatcgtgactgttgctgaagcacagaaggtttcaccaagatcttcgcgctcacagaaaagtgacaatcctgacctgtgtgtggacaatgagctaggatttgccaaggatcgtacgattagcaggttgacagagatcaacagtagagaatatttggaggacttcgaaatgagattgcggcaacagcagcagctgtccttgcaaggtctggataatggtggccatgttgttctagcataa

SEQ ID NO: 12110 - protein, 509 aa, Sorghum bicolor
  misc_feature: Ceres ANNOT ID no. 6057830
  misc_feature (83)..(489): Pfam Id: AFG1_ATPase Pfam Desc: AFG1-like ATPase
  misc_feature (84)..(496): NCBI GI: 79325316 NCBI Desc: atpase [arabidopsis thaliana]
  misc_feature (84)..(496): NCBI GI: 42567204 NCBI Desc: afg1-like atpase family protein [arabidopsis thaliana]
  misc_feature (182)..(508): NCBI GI: 115475609 NCBI Desc: os08g0265500 [oryza sativa (japonica cultivar-group)]
  misc_feature (89)..(455): NCBI GI: 82700694 NCBI Desc: atp/gtp-binding site motif a (p-loop):afg1-like atpase [brucella melitensis biovar abortus 2308]
  misc_feature (89)..(455): NCBI GI: 82616795 NCBI Desc: atp/gtp-binding site motif a (p-loop):afg1-like atpase [brucella melitensis biovar abortus]
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: GREAT-hit functional homolog of the protein sequence given in SEQ ID NO 13557
  misc_feature: Useful for making plants with modulated biomass
  misc_feature: Useful for making plants with modulated flowering time
  misc_feature: Functional homolog of the protein sequence given in SEQ ID NO 13557
MRSVVRSLRQRHRFTQHHAERQSPATRLIRQQNALIMCSSTTRSLSMLCRNSETSRFASPAVELMKSMFSTIAADSIKDIRGGGPMVEYDRRIASGELVDGDSFQVDTIQQLQRLYKELIENEEDCKLDRYKSSEKSGRSRWLWSRLITQPSTYAPVKGLYLYGGVGTGKTMLMDLFYEQLPSNWRKKRIHFHDFMLNVHSHLQMHKGVSDPLDVVAAEISDEAIILCLDEFMVTDVADAMILNRLFRQLFSKGVILVSTSNRAPDKLYEGGLQRDLFLPFIDTLKERCIAHPIGSAVDYRQMGSAEQGFYFVGKHYNTLLKQRLQSLIGDDEPSPQTVEVIMGRKLPVPLGANGCAYFPFEDLCDKPLGAADYFGLFKKFHTLALDGVPKFGSSNRTSAYRFVTLIDVMYENKARLLCTAEAGPIDLFENIVTVAEAQKVSPRSSRSQKSDNPDLCVDNELGFAKDRTISRLTEINSREYLEDFEMRLRQQQQLSLQGLDNGGHVVLA

SEQ ID NO: 12111 - DNA, 1236 bp, Sorghum bicolor
  misc_feature: Ceres ANNOT ID no. 6060488
  misc_feature: Encodes the peptide sequence at SEQ ID NO 12112
atggcgacgaacccgggcgtcctctgccgcgcttcaccccgaccaccgcctgcgtcaacggccgccgcccatttgcactccctctcttcctcctccgcctccgaacacattccccattcgactcagcgcggccgcctcgccgcagctccaccaccaccaccccgttgtgtagctagtcctacaattgctagtgtgaaagaccaaactgaggccgaagttgcaatggggtacactatgactgaaatctgcgacaaattcattgagttattcatgtataagaaaccagaaacaaaggactggagaaagttattggtgtttagagaggagtggcgaaggtacagggaacacttctacaagcgttgtcaagtccgcatagatatggacactgatccttcactgaaacaaaagttggttgtacttgctagaaaagttaagaagatagacaatgaaatagagaagcacatggaactcttcaatgagctcagagagaaccctgcagatattaatgctattgttgcaagacgacggaaggatttcactggggagttcttccgccatcttaatttccttgtgaatgcttataatggccttgatgagcgagatggaatagtcaggcttggagccaaatgcctatctgcaattcatgcatatgattgtacactggaacagttggatatcgaatctgctcagttgaagtttgatgatatactgaattcctcttcactagatggtgcttgtgacaagatcaaaagcttagccaaggctaaagaacttgattcatctctaattcttcttattaacagagcttgggctgctgcaaaagaatctaaaactatgaacgataaggtcaaggacataatgtatcatatttatacaactacaaaagaaagcctcaagagcatctcacctcctgagatgaagcttctgaagtatttgctgaatattgaagagcctgaggagagatttggtgctcttgcaactgctttctttcctggagatgagcatgaagccaaggatgaagatgctctttacacaactcccaaagaactccacaaatggatcaaaatgctgctcgattcataccatctcaacaaggaggagacggattttatggatgggagaaagatgagcgacccggtgatcatccaaaggttaactttgctgaaggagacgatcgaggaagaatacatgaagcagtatatacatcctgaggaggaatccatggacgacaactag

SEQ ID NO: 12112 - protein, 411 aa, Sorghum bicolor
  misc_feature: Ceres ANNOT ID no. 6060488
  misc_feature (26)..(410): NCBI GI: 52077520 NCBI Desc: endoribonuclease e-like protein [oryza sativa (japonica cultivar-group)]
  misc_feature (26)..(250): NCBI GI: 52077521 NCBI Desc: endoribonuclease e-like protein [oryza sativa (japonica cultivar-group)]
  misc_feature (56)..(232): NCBI GI: 115475868 NCBI Desc: os08g0320800 [oryza sativa (japonica cultivar-group)]
MATNPGVLCRASPRPPPASTAAAHLHSLSSSSASEHIPHSTQRGRLAAAPPPPPRCVASPTIASVKDQTEAEVAMGYTMTEICDKFIELFMYKKPETKDWRKLLVFREEWRRYREHFYKRCQVRIDMDTDPSLKQKLVVLARKVKKIDNEIEKHMELFNELRENPADINAIVARRRKDFTGEFFRHLNFLVNAYNGLDERDGIVRLGAKCLSAIHAYDCTLEQLDIESAQLKFDDILNSSSLDGACDKIKSLAKAKELDSSLILLINRAWAAAKESKTMNDKVKDIMYHIYTTTKESLKSISPPEMKLLKYLLNIEEPEERFGALATAFFPGDEHEAKDEDALYTTPKELHKWIKMLLDSYHLNKEETDFMDGRKMSDPVIIQRLTLLKETIEEEYMKQYIHPEEESMDDN

SEQ ID NO: 12113 - DNA, 1299 bp, Sorghum bicolor
  misc_feature: Ceres ANNOT ID no. 6061603
  misc_feature: Encodes the peptide sequence at SEQ ID NO 12114
atgaagcaacaagtcccgagcagcaacggccatggcagcagcatccattccaagtctcctgtgccacaaacgcggacatcaagagcaccaccacccaaagtgaagcaacctcctgctactccaggcccaggggtgaaggccagaccaagaccggccgcctccatggtagcaacgaggaggcagcctgctgtgcccgtgaccgtgaggagggtgacgatgagcaccacggagtcggagaccgtagaggaggaggtggtgcggttgcgcggggaggtggatgccttgcggagggaggtgcagcgcctgctccgccttaatcaacaccaacagcatgatgctgcaaccaacaacattccacaacctcctagcaagatttcaatttccggaggagtcgttgcagctgcaccaccgccgccaccgccaccgccaccgccaccgccaccgccgcggtaccaaaaccagcgagtcccttcagctccgagcacaagcccggtgagcaaggccactgccctggttgagatgtacaactcgctgcagaccagcaacaagaagccgtcgaagcacacagacaaaagtagaagccatcatcagcatagcagcattgttgacgagctgcagaaccgctccaggcaccagctagcgatcaaagaggatgtggaaacaaaagcagagttcatcaaccatctcatcaacaaaatccacactagtacttacactggtgtggaacaagtagtcacctttgtggactggctggaccaacatctttctacactgtctgatgagacagccgtcttgaagcacttcaactggcctgagaggaaagctgatgcacttcgtgaagcggcatctgaataccgacacctcaattgtcttctaacagagatctcttccttaagagacgaagacgatggtggtagtggtagtgaggccacagccactcgcaggaagatttcaagcttgctagacaaattggagaagagcatggacagattggtgaatctaaggagattggcgatgccatcctacaaagagtttaggattccaaccgactggatgcttgattcagggatggcctcaaagatgagattggcatcggtgagtctggcgaaaatgtataccgagacagtccttaaggaactggactgcagggatacagctgggactgggaacgaggctgctctggttgctcaaagtgtgcgcttcacctacagggtccaccagtttgctgggggacttgactgcgaagcaatgcatgcctttgaagagctaagaaagcgggttcagctggtctctacatga

SEQ ID NO: 12114 - protein, 432 aa, Sorghum bicolor
  misc_feature: Ceres ANNOT ID no. 6061603
  misc_feature (135)..(427): NCBI GI: 8778962 NCBI Desc: f11a17.16 [arabidopsis thaliana]
  misc_feature (117)..(424): NCBI GI: 125659421 NCBI Desc: chloroplast unusual positioning 1a [physcomitrella patens]
  misc_feature (74)..(428): NCBI GI: 22135814 NCBI Desc: at4g18560/f28j12_220 [arabidopsis thaliana]
  misc_feature (116)..(431): NCBI GI: 140040594 NCBI Desc: pherophorin - like protein , related [medicago truncatula]
  misc_feature (74)..(428): NCBI GI: 7268650 NCBI Desc: pherophorin-like protein [arabidopsis thaliana]
MKQQVPSSNGHGSSIHSKSPVPQTRTSRAPPPKVKQPPATPGPGVKARPRPAASMVATRRQPAVPVTVRRVTMSTTESETVEEEVVRLRGEVDALRREVQRLLRLNQHQQHDAATNNIPQPPSKISISGGVVAAAPPPPPPPPPPPPPPRYQNQRVPSAPSTSPVSKATALVEMYNSLQTSNKKPSKHTDKSRSHHQHSSIVDELQNRSRHQLAIKEDVETKAEFINHLINKIHTSTYTGVEQVVTFVDWLDQHLSTLSDETAVLKHFNWPERKADALREAASEYRHLNCLLTEISSLRDEDDGGSGSEATATRRKISSLLDKLEKSMDRLVNLRRLAMPSYKEFRIPTDWMLDSGMASKMRLASVSLAKMYTETVLKELDCRDTAGTGNEAALVAQSVRFTYRVHQFAGGLDCEAMHAFEELRKRVQLVST

SEQ ID NO: 12115 - DNA, 1269 bp, Sorghum bicolor
  misc_feature: Ceres ANNOT ID no. 6062805
  misc_feature: Encodes the peptide sequence at SEQ ID NO 12116
atggcctccgacggccacccgccggagccggggaagaaggaggaggtcacctccacggccgccgggcctggagccaacgatctggacgacccgcagttcatgtgctgcgtctgtctggatcttctgtacaaaccagtagttttatcatgtggtcatatgtcatgtttctggtgtgtccacaaagctatgcatgttttcctggaatcccattgcgctgtgtgtaggcagccctatatacactttccgagtatctgtcagctcttgcatcatttgcttctaaagcttgaaactactgattacaaaagaagggaaaaagaagtactagaggaagagaagcgcatagaaacatactctccccaaatcattgagtttttgaactccaagaataatgttggaagcgatggggacaacagaaatgaagacagtaaagctagacccccacaagaagtttcattgaatggcagcacttcggatgagcattcgaagaaaattaagttggaggatgtttcatgccctctctgtacggagatgttgtatcaacctgccgttcttaattgtggtcatgtgtattgtgtatcctgtttgtcgtccttgaatgaggaaacactgaaatgccatgtttgtggaagtcctcacccgggagatttccctaatgtttgcctggaccttgatcatttcctggaagaatactttccagcagaatatgaatcgagagggcagaaagttcagtttaagaaggatcagtgcaatcgtgaagcatcatcttcaggtacttcagtcagaaaaggaagcactagggcactgcatgatgagggcatgttaaatattcacattggagtaggatgtgactcatgtggggtatatccgatacgtggtaagagatacaaatgccaggactgcactgagttaattgggtttgacctttgcgaagcctgctacaactccagttcaaagctcccaggacgctttaatcagcggcacacccctgatcacagaatggaagttgacaattcagcactcttgcgtgggatactgagacaccatggcatgcccgaggaaggccctgagggactgatgatggaagaagcggtggttgctcctggtgcattcttgcagatactcgttgatactcaaggaatggaggagggcaataatgagggcccaggagaggcggccattgaagaaccagttggtgctcctggagcgatgttgaatatagtcatccatgatcaagaaatggagggcaacgaggaggatcatgcactctag

SEQ ID NO: 12116 - protein, 422 aa, Sorghum bicolor
  misc_feature: Ceres ANNOT ID no. 6062805
  misc_feature (171)..(208): Pfam Id: zf-C3HC4 Pfam Desc: Zinc finger, C3HC4 type (RING finger)
  misc_feature (276)..(329): Pfam Id: ZZ Pfam Desc: Zinc finger, ZZ type
  misc_feature (110)..(363): NCBI GI: 21592748 NCBI Desc: prt1 [arabidopsis thaliana]
  misc_feature (139)..(208): NCBI GI: 119610291 NCBI Desc: lon peptidase n-terminal domain and ring finger 3, isoform cra_a [homo sapiens]
  misc_feature (126)..(243): NCBI GI: 82705370 NCBI Desc: processed variable antigen [plasmodium yoelii yoelii str. 17xnl]
  misc_feature (126)..(243): NCBI GI: 23482557 NCBI Desc: processed variable antigen-related [plasmodium yoelii yoelii]
  misc_feature (14)..(177): NCBI GI: 49457847 NCBI Desc: zinc finger protein 313 [xenopus tropicalis]
  misc_feature: The sequence is a functional homolog of SEQ ID NO 174 in the 10/225,068US patent application
  misc_feature: The sequence is a functional homolog of SEQ ID NO 1838 in the 11/479,226US patent application
  misc_feature: The sequence is a functional homolog of SEQ ID NO 2646 in the 10/374,780US patent application
  misc_feature: Useful for making plants with modulated growth and phenotype characteristics
  misc_feature: The sequence is a functional homolog of SEQ ID NO 174 in the 20050120408 US patent application
  misc_feature: The sequence is a functional homolog of SEQ ID NO. 468 in the 11/188,298 US application
MASDGHPPEPGKKEEVTSTAAGPGANDLDDPQFMCCVCLDLLYKPVVLSCGHMSCFWCVHKAMHVFLESHCAVCRQPYIHFPSICQLLHHLLLKLETTDYKRREKEVLEEEKRIETYSPQIIEFLNSKNNVGSDGDNRNEDSKARPPQEVSLNGSTSDEHSKKIKLEDVSCPLCTEMLYQPAVLNCGHVYCVSCLSSLNEETLKCHVCGSPHPGDFPNVCLDLDHFLEEYFPAEYESRGQKVQFKKDQCNREASSSGTSVRKGSTRALHDEGMLNIHIGVGCDSCGVYPIRGKRYKCQDCTELIGFDLCEACYNSSSKLPGRFNQRHTPDHRMEVDNSALLRGILRHHGMPEEGPEGLMMEEAVVAPGAFLQILVDTQGMEEGNNEGPGEAAIEEPVGAPGAMLNIVIHDQEMEGNEEDHAL

SEQ ID NO: 12117 - DNA, 1590 bp, Sorghum bicolor
  misc_feature: Ceres ANNOT ID no. 6063959
  misc_feature: Encodes the peptide sequence at SEQ ID NO 12118
atgagccgccctaacgcccgcggcgagcccaaggtacaaaccctagctctcgctcctccctccccagccgcccccgccaagatgggcgcccatcggcgacaacccagctcccgccgccgccttgtcggcgccctctcactcctcgccgcgtccgcgctggcccttctcctcctagcatcccgcccggtgcccccgacctacggcgtcatcatcgacgccggcagcacggggagccgcgtccacgtcatcgcctaccgcgccacggcggggctcccgcagctggactgggcacgcacggcctcgatgaaggcgaccccggggctatcgtccttcgcggcggacccacgcggcgcggggctgtctctggcgccgctagtagagtttgcccggcgacgtgtgccgcgggagagctgggggcaaaccgaggtgcggctcatggccactgccgggctgcgtctgcttgattccgcagtggccgagtccgtccttcagtcttgcagggaagtgcttcggggctcgggcttccaatttcaggacgaatgggccaccgtgatctcaggggctgaggaagggatatacgcatgggttgcagcaaattatgctttggggactcttggcagtgatccaaaagacaccactgggattattgaacttggtggggcttctgttcaggtgacacttgttaccagtgaacctgtgcctccggagttctctcatgtgctcaagtttggtgatgtctcatataacctgtacagccacagctttttgcagcttggtctgaatgtagcatatgaatcattccatgacttgctcagctcacctggccttagcttaatggccacacatttgatttctcaagctaagtacaaagatccttgcactccaaggggatttacacacatagcaggatcagttaaacttcctgttagtgttcttgagccgaaggttgagtacagaccgtttgctcatgctgtggggaacttttctgagtgtagatctgcagcgttaacactactgcaaaaaggaaaggagggatgtacatatcatgaatgtcgccttggagcagcatttgtacctgagttggaagggaaatttttagcgacagaaaatttttaccatacttcaaagttctttggtctgcactcaaagtccttcctttctgatctgatggcggctggagagaaattttgccatggggactggtcaaagattaagaagaagtacagctcttttgatgacggacagctgcttcttttttgcttttcctcagcatatattattgctctgctacatgatacacttaaaatgccactggatcataagaggattgatgttgtaaatcaaatccatggcgtgcctgttgactgggcattgggtgctttcattgtgcagacgacgatgaaccgaacagagtactcagattcatcagtttcatatctaaacaaccactcttctggcttggttccgcttctgttcattactgtggttgtatttacagcattctccatcctaaggtggagaaggcctcggctgaggacgatctacgacatggagaaaggcaggtacatcataacaagggtcagccgatga

SEQ ID NO: 12118 - protein, 529 aa, Sorghum bicolor
  misc_feature: Ceres ANNOT ID no. 6063959
  misc_feature (58)..(480): Pfam Id: GDA1_CD39 Pfam Desc: GDA1/CD39 (nucleoside phosphatase) family
  misc_feature (67)..(439): NCBI GI: 92880822 NCBI Desc: nucleoside phosphatase gda1/cd39 [medicago truncatula]
  misc_feature (80)..(476): NCBI GI: 7262666 NCBI Desc: strong similarity to ecto-apyrase from rattus norvegicus gbu81295 and is a member of the gda1/cd39 (nucleoside phosphatase) pf01150 family. this gene is cut off at the 5' end.
  misc_feature (80)..(476): NCBI GI: 7262666 (continued) [arabidopsis thaliana]
  misc_feature (58)..(480): NCBI GI: 79317964 NCBI Desc: hydrolase [arabidopsis thaliana]
  misc_feature (38)..(481): NCBI GI: 111185885 NCBI Desc: ecto-nucleoside triphosphate diphosphohydrolase-1 [torpedo marmorata]
  misc_feature (41)..(509): NCBI GI: 45580700 NCBI Desc: ectonucleoside triphosphate diphosphohydrolase 1 [homo sapiens]
MSRPNARGEPKVQTLALAPPSPAAPAKMGAHRRQPSSRRRLVGALSLLAASALALLLLASRPVPPTYGVIIDAGSTGSRVHVIAYRATAGLPQLDWARTASMKATPGLSSFAADPRGAGLSLAPLVEFARRRVPRESWGQTEVRLMATAGLRLLDSAVAESVLQSCREVLRGSGFQFQDEWATVISGAEEGIYAWVAANYALGTLGSDPKDTTGIIELGGASVQVTLVTSEPVPPEFSHVLKFGDVSYNLYSHSFLQLGLNVAYESFHDLLSSPGLSLMATHLISQAKYKDPCTPRGFTHIAGSVKLPVSVLEPKVEYRPFAHAVGNFSECRSAALTLLQKGKEGCTYHECRLGAAFVPELEGKFLATENFYHTSKFFGLHSKSFLSDLMAAGEKFCHGDWSKIKKKYSSFDDGQLLLFCFSSAYIIALLHDTLKMPLDHKRIDVVNQIHGVPVDWALGAFIVQTTMNRTEYSDSSVSYLNNHSSGLVPLLFITVVVFTAFSILRWRRPRLRTIYDMEKGRYIITRVSR

SEQ ID NO: 12119 - DNA, 1200 bp, Sorghum bicolor
  misc_feature: Ceres ANNOT ID no. 6064233
  misc_feature: Encodes the peptide sequence at SEQ ID NO 12120
atggggaagagcccaaggcttgcacaaatgatctggccaagatcggcggcgagaagggtgctggtggatcatcaacaattcgtctccgaattctctggcttcgagctggagaagagcagcatgctaggtgagcagagcgagaccgtcaagtacagggtgtttactggtacatggaacgttggcggcgtggcgccgccggatgatctgagcttggaggattggctggacaccaagaccgactcctacgacatctatgttcttgggttccaggagatggtgccactgaacgcgaggaccgtgcttggcccgaaacagagacgggcagccatgaagtggcagctgctcatcggtgacgcattgaacagcacgaggcatggagatggagctgcagcaatgcacgatcaaggacgacagggcggcggcgtgttcaggtgcctcgtgagcaagcagatggtcggcatcttcgtgtccgtctggacgaggaccagcctccgccggcacgccgtccgccaccctgccgtctccagcgtcggcgccggcgtcctcggccggctcggcaacaagggcgcggtgtccgtccggttcttgctccacggcacgagcttctgcttcgtctgctgccacctcgcctcaggcggcgaggagggcgacgtgctacgccggaacgccgacgcggcggacatcctcacgaggaccagcttcctcagctccggcggcgcgccggcagcaccggatgagctccccaagaagattcttggccatgaccgcgtggtgttgttcggggacctcaactaccggatcgccaaggacgacgacgaggaagcacggcagctggtgcgggccaggaaatggagcatgctgctggagaacgacgagctgctgctggagctctccagtggccgtcagttcgacgggtggcacgagggccgcgtcgccttcgccccgacctacaagtatcgccgcaactcggaccagttctgctggtgcgctgacggtggcgtcgccaccggccggctggacaagcagcagcaccgccaccgccgccgcgcgccggcatggtgtgaccggatcctgtggcgcgggaaggggatgaagcaggtccggtacgagcgctgcggtggctaccggctctccgatcaccgcccggtgagggccgtattccacgccgtgtgtgagctagtggaaggcgtggatgcttaa

SEQ ID NO: 12120 - protein, 399 aa, Sorghum bicolor
  misc_feature: Ceres ANNOT ID no. 6064233
  misc_feature (53)..(387): Pfam Id: Exo_endo_phos Pfam Desc: Endonuclease/Exonuclease/phosphatase family
  misc_feature (7)..(399): NCBI GI: 49389208 NCBI Desc: inositol 1,4,5-trisphosphate 5-phosphatase-like protein [oryza sativa (japonica cultivar-group)]
  misc_feature (143)..(389): NCBI GI: 92888214 NCBI Desc: inositol polyphosphate related phosphatase [medicago truncatula]
  misc_feature (128)..(394): NCBI GI: 92883941 NCBI Desc: inositol polyphosphate related phosphatase [medicago truncatula]
  misc_feature (116)..(392): NCBI GI: 8778727 NCBI Desc: t25n20.12 [arabidopsis thaliana]
  misc_feature (116)..(392): NCBI GI: 15220522 NCBI Desc: endonuclease/exonuclease/phosphatase family protein [arabidopsis thaliana]
MGKSPRLAQMIWPRSAARRVLVDHQQFVSEFSGFELEKSSMLGEQSETVKYRVFTGTWNVGGVAPPDDLSLEDWLDTKTDSYDIYVLGFQEMVPLNARTVLGPKQRRAAMKWQLLIGDALNSTRHGDGAAAMHDQGRQGGGVFRCLVSKQMVGIFVSVWTRTSLRRHAVRHPAVSSVGAGVLGRLGNKGAVSVRFLLHGTSFCFVCCHLASGGEEGDVLRRNADAADILTRTSFLSSGGAPAAPDELPKKILGHDRVVLFGDLNYRIAKDDDEEARQLVRARKWSMLLENDELLLELSSGRQFDGWHEGRVAFAPTYKYRRNSDQFCWCADGGVATGRLDKQQHRHRRRAPAWCDRILWRGKGMKQVRYERCGGYRLSDHRPVRAVFHAVCELVEGVDA

SEQ ID NO: 12121 - DNA, 1230 bp, Sorghum bicolor
  misc_feature: Ceres ANNOT ID no. 6064291
  misc_feature: Encodes the peptide sequence at SEQ ID NO 12122
atggggaagcaaggaccctgccgtcattgcggagtcacaagtactcccctgtggcgaaatgggccaccagataagccggtgctctgcaatgcttgtggctcgagatggagaacgaagggttcattggcaaactacaccccaatgcaccgcaaggacgatattgatgatgatgaacccagagttagcaagctgaagccaccgacatcaaagtcgaagtcacagaagaaaaagccaaatcacattatagcagagaatggactattttctggtcagaatttccgaaagatggggggtgttgacccaagctatcagtctagttcgggatctgcagtatcatactctgagagttgtgccccatatggtgctgctgatgcaagtgaaatgactggttcagcacagtcacatgcttgggagtccctagtgccatcaagaaagaggagctgtgttacccgtccgaagccttcacctgtagaaaagcttgcaaaagatctgaactccatcatgcatggagagcagttatataacctttcagggtcatcagaggaagacctactataccatagtgaaactcctgtcggttcctttgagataggctctggaagtgtgcttctaagacacccaaactcaaaattactggaggaagaatcagaagcaagctccattcctgcagataataaatcatacattacaagtgaatcatattcaggctctgtgtcatttgtcgttcacagtggaaacaagtcagcaattaacttaaatgctccaactgcaaggccgaagaagtcgccgctgcatatggaaaacaatgctagaagtggaccggaaggctttaccaagtctaccatgaaaccactcaaaagaccccgtgacacccactttcagagtgatgcagaactagatggtaccatgaggagtcctctacgagttctaaaatctggggctttggctcctcagtttgaaagttcatctttgccaaaatctggctacgccaccaaagattcaacctgcactggaggagcacttaatttattcatgttacccccagaaaagttatcattactggtccctcctgagtatgccgactctgatcaagacttgctgctggagatacctctcaatgcacgacacccagaggcagaacttctctgtcaaccatctcagctgatgagctctataacccgcagctccacctctggtgctgaaggagaagggtgcctgaagctaccatag

SEQ ID NO: 12122 - protein, 409 aa, Sorghum bicolor
  misc_feature: Ceres ANNOT ID no. 6064291
  misc_feature (7)..(42): Pfam Id: GATA Pfam Desc: GATA zinc finger
  misc_feature (1)..(271): NCBI GI: 38345953 NCBI Desc: osjnbb0038f03.10 [oryza sativa (japonica cultivar-group)]
  misc_feature (1)..(246): NCBI GI: 89257425 NCBI Desc: gata zinc finger containing protein [brassica oleracea]
  misc_feature (1)..(225): NCBI GI: 89257552 NCBI Desc: gata zinc finger containing protein [brassica oleracea]
  misc_feature (1)..(228): NCBI GI: 89257582 NCBI Desc: gata zinc finger containing protein [brassica oleracea]
  misc_feature (14)..(46): NCBI GI: 144924872 NCBI Desc: zinc finger, gata-type [medicago truncatula]
  misc_feature: The sequence is a functional homolog of SEQ ID NO 1835 in the 11/479,226US patent application
  misc_feature: The sequence is a functional homolog of SEQ ID NO 2640 in the 10/374,780US patent application
  misc_feature: The sequence is a functional homolog of SEQ ID NO 4 in the 11/375,241US patent application
  misc_feature: Useful for making plants with modulated growth and phenotype characteristics
  misc_feature: The sequence is a functional homolog of SEQ ID NO 2640 in the 20060162006 US patent application
  misc_feature: The sequence is a functional homolog of SEQ ID NO 1835 in the 20070022495 US patent application
MGKQGPCRHCGVTSTPLWRNGPPDKPVLCNACGSRWRTKGSLANYTPMHRKDDIDDDEPRVSKLKPPTSKSKSQKKKPNHIIAENGLFSGQNFRKMGGVDPSYQSSSGSAVSYSESCAPYGAADASEMTGSAQSHAWESLVPSRKRSCVTRPKPSPVEKLAKDLNSIMHGEQLYNLSGSSEEDLLYHSETPVGSFEIGSGSVLLRHPNSKLLEEESEASSIPADNKSYITSESYSGSVSFVVHSGNKSAINLNAPTARPKKSPLHMENNARSGPEGFTKSTMKPLKRPRDTHFQSDAELDGTMRSPLRVLKSGALAPQFESSSLPKSGYATKDSTCTGGALNLFMLPPEKLSLLVPPEYADSDQDLLLEIPLNARHPEAELLCQPSQLMSSITRSSTSGAEGEGCLKLP

SEQ ID NO: 12123 - DNA, 831 bp, Sorghum bicolor
  misc_feature: Ceres ANNOT ID no. 6064379
  misc_feature: Encodes the peptide sequence at SEQ ID NO 12124
atggcggcgggaagagaaaccgacgaacagctgaccgagtatgagaagcagcggctgtcgcggatacgcgaaaacgaggcccgcctcgaggccctgggcctccgcagcctcgcagcttcccctctcctccgcaacccgtcgccgggggcggcaaaggggaagcagaagaagcggtccgccgacgaggacgaggagtacgtcccgtccgatagcggcggcgttgaggaggacgacgagagctcgtcggagagcgcgcaagacgaagaggtggagggagaggggaaatcagcttctaggtcacgcgccaagggaaagaaaaagaaattgtcaaaatctggtaaatctacaaagagcacacctaccaagggtagtgcttctttggctgatgtggtggatgatgatgcagccttacagcaggcaattgctctctccctggcggaatattcagaaaagccagcgactgcattgggtgcagaaacatcaagcacagtaacaggagcgagtgaaagtactccacacaagaacaacagcaaagcatcggttcacgacacagctaagaacaagaagattaaaaagctgggtaagagcaggattcagctgacagaagatgatgtggttgcattcttcttctcatttgacgaagttggtaaaggatatattacgccatgggatcttgaaagaatggctacaataaatgatttcatctggacagattctgagatatctaagatgatccgttgctttgatagtgacagtgatggaaagataaacctcgaggatttccgcagcattgtatctcaatgcaacatgttgcaggagcatgagaagtga

SEQ ID NO: 12124 - protein, 276 aa, Sorghum bicolor
  misc_feature: Ceres ANNOT ID no. 6064379
  misc_feature (240)..(268): Pfam Id: efhand Pfam Desc: EF hand
  misc_feature (11)..(275): NCBI GI: 140039173 NCBI Desc: calcium-binding ef-hand; ubiquitin interacting motif [medicago truncatula]
  misc_feature (201)..(265): NCBI GI: 4959143 NCBI Desc: calmodulin mutant syncam4 [synthetic construct]
  misc_feature (201)..(265): NCBI GI: 4959594 NCBI Desc: calmodulin mutant syncam16 [synthetic construct]
  misc_feature (201)..(267): NCBI GI: 47028285 NCBI Desc: calmodulin [bigelowiella natans]
  misc_feature (201)..(266): NCBI GI: 4959172 NCBI Desc: calmodulin mutant syncam71a [synthetic construct]
MAAGRETDEQLTEYEKQRLSRIRENEARLEALGLRSLAASPLLRNPSPGAAKGKQKKRSADEDEEYVPSDSGGVEEDDESSSESAQDEEVEGEGKSASRSRAKGKKKKLSKSGKSTKSTPTKGSASLADVVDDDAALQQAIALSLAEYSEKPATALGAETSSTVTGASESTPHKNNSKASVHDTAKNKKIKKLGKSRIQLTEDDVVAFFFSFDEVGKGYITPWDLERMATINDFIWTDSEISKMIRCFDSDSDGKINLEDFRSIVSQCNMLQEHEK

SEQ ID NO: 12125 - DNA, 1413 bp, Sorghum bicolor
  misc_feature: Ceres ANNOT ID no. 6064421
  misc_feature: Encodes the peptide sequence at SEQ ID NO 12126
atggtcactcctgcatctccgacgacgatgccggcggcccggaagccgttgcccttgctcctcctctccctctcgctccccgccctcctgctggtgctctccctcgtcttcctcctctcgcacaccacttttagcctcctcatctgccctctcctcccgaggctgtcttcgacgcgcaatgcgacgagcgccagtcgtcgtactggtggtaccagcctcggtgtctccatggacgagaacttgcaagccttccatgcctcgatgccgacgataccttcaaggcgcaatgcgacgagctccaatagtagtaccagcattgctgtctcagtggacaagaccttgcaagaagcattccatgccttcgcggtggcgccaccgccgccgctgccggcggcgtcatggccgccggctgctcctgctgttaagagcagcagcaggaagaaggcgtccgcgaagagaaacaggagtctcctcaagctcctgctcaggaagacaccgcagacgcggcggttcgcggcgcgcgcggacgagctcttcgcggcgccgtgcaccgaccgcttcttcatgacgtggctctcgccgctcgcgcagttcggtcgccgcgagctcctcgtcctggagagcctcttcaggtggcaccgcggcggctgcctcctcgtcgcctccgataccatggactccgcgggcggcagggacaagctgaggccgttcctcgagcgcggcttccgcttagccgtcgcctcgccggactttgcctacctcctgaacggtacgcccgccgaggcgtggctcggcgctgtccagcgcggcggcgtcagcctcgggagcgtcccactcgggcagaacctctccaacctcctccgcctcgcgctgctctacaggtacggcggcatctacctcgacgccgacgtcgtcgtcctcaggccgctctccgacctccgcaacgccattggagcgcaggccgtggacgaggccacgggcgactggatgcgactgaacaacgccgtgatggtgttcgacagggcacacccgctgctgcacgagttcatcgccgagttcgccgccgcgttcgacgggagcaagtggggccacaacgggccgtaccttgtgtcccgggtggcggcgaggctacgccaccggagcccggggcccgccttcacggtgctgccgccgcgggccttctaccccgtgcactggagcaagatcggtgggctgtttgttgcaccaaaggacaggaaagacaagaggtgggtgaaggccaaggtggagaacatcaaaggcgagagctttggcatccatctttggaacagggagagcagtaggctggaaatggaggaggggagtgttattgggacgttaatttcagacagttgcctgttctgcaattcttccatgtttgtaaagcaaggatag

SEQ ID NO: 12126 - protein, 470 aa, Sorghum bicolor
  misc_feature: Ceres ANNOT ID no. 6064421
  misc_feature (337)..(469): Pfam Id: Gb3_synth Pfam Desc: Alpha 1,4-glycosyltransferase conserved region
  misc_feature (242)..(334): Pfam Id: Gly_transf_sug Pfam Desc: Glycosyltransferase sugar-binding region containing DXDmotif
  misc_feature (88)..(468): NCBI GI: 115459564 NCBI Desc: os04g0529700 [oryza sativa (japonica cultivar-group)]
  misc_feature (142)..(463): NCBI GI: 140042948 NCBI Desc: glycosyltransferase sugar-binding region containing dxd motif; alpha 1,4-glycosyltransferase conserved region [medicago truncatula]
  misc_feature (136)..(463): NCBI GI: 145360743 NCBI Desc: transferase/ transferase, transferring glycosyl groups [arabidopsis thaliana]
  misc_feature (183)..(461): NCBI GI: 85719350 NCBI Desc: glycosyltransferase sugar-binding region containing dxd motif; alpha 1,4-glycosyltransferase conserved region [medicago truncatula]
  misc_feature (183)..(407): NCBI GI: 115472843 NCBI Desc: os07g0567300 [oryza sativa (japonica cultivar-group)]
MVTPASPTTMPAARKPLPLLLLSLSLPALLLVLSLVFLLSHTTFSLLICPLLPRLSSTRNATSASRRTGGTSLGVSMDENLQAFHASMPTIPSRRNATSSNSSTSIAVSVDKTLQEAFHAFAVAPPPPLPAASWPPAAPAVKSSSRKKASAKRNRSLLKLLLRKTPQTRRFAARADELFAAPCTDRFFMTWLSPLAQFGRRELLVLESLFRWHRGGCLLVASDTMDSAGGRDKLRPFLERGFRLAVASPDFAYLLNGTPAEAWLGAVQRGGVSLGSVPLGQNLSNLLRLALLYRYGGIYLDADVVVLRPLSDLRNAIGAQAVDEATGDWMRLNNAVMVFDRAHPLLHEFIAEFAAAFDGSKWGHNGPYLVSRVAARLRHRSPGPAFTVLPPRAFYPVHWSKIGGLFVAPKDRKDKRWVKAKVENIKGESFGIHLWNRESSRLEMEEGSVIGTLISDSCLFCNSSMFVKQG

SEQ ID NO: 12127 - DNA, 1530 bp, Sorghum bicolor
  misc_feature: Ceres ANNOT ID no. 6064457
  misc_feature: Encodes the peptide sequence at SEQ ID NO 12128
atgagatcagttgttcggtcacttcgccagctccgccgtttcgcccagcaccatgcagagaggcactcacaagcaaccagattgttcgggcagcagaatgctttaatcatgtgtggtttgacatcccgttcactgagcatgttacgtcgtaatggtgaaattagcagatttgcaagccctggcatggagttgatgaggtccatgttttccactgtagcggctgattcaattaaagatattggaagaggtggtccgatggtggaatatgagaggagaatagcatcaggagacctagtagatggcgatagctttcaggttgatacaattcatcaattacaaaggctctatgaggagttgattgagaatgaagaagactgtcagctggatagatataagtcatctgagaaatcaggacggagtcgatggctatggtcccgcctcattactcagccttctacctatgctccagttaagggcctttacctctatggtggtgttggtacagggaagacgatgcttatggacttgttctatgaacaactgccatctaattggagaaaaaaacgtattcactttcatgatttcatgttgaatgtacatagtcgtcttcagatgcataaaggtgtttcagatccccttgatgtcgtagcagctgagatttcagatgaggccatcatattatgtcttgatgagtttatggtaactgatgttgctgatgctatgattctgaaccggctgttcagacaattgttcagcaaaggcgttattcttgtttcgacttctaaccgtcctccagataagctttatgaaggtggcttacaacgggatcttttcttgccatttattgacaccttgaaagaaaggtgcatcgtgcatcccattggatctgcggtggactatcgtcaactgggttctgctgaacaaggcttctattttgtcggaaaacattacagtacgcttctgaaacagaagctccagtctttaattggagatgaggaacccagcccacaaactgttgaagtaatcatgggaaggaaattacaggtttccctgggagcaaatggttgtgcatattttccttttgaagatctttgtgatagacctttaggtgcagcagattactttggactctttaaaaaatttcacaccctggcacttgacggtgttccaaagtttgggtctagtaacagaacggcagcttatcggttcgtcacactgattgatgttatgtacgagaacaaagcaaggctgttatgtacagccgaggctggaccagtaggactgtttgagaatatcgtgactgttgctgaagcacagaaggtttcaccaagatattcacgctcacagaaaagcgacgatcctgacttatgtgtggacaatgagcttggatttgccaaggatcgaacgattagcaggttgacagagatcaacagcagagaatatttggaggacttcgaaatgagattgaggcaacagcagcagctgcccttgcaaggtctagataatggcggtgatgttgtactagcataa

SEQ ID NO: 12128 - protein, 509 aa, Sorghum bicolor
  misc_feature: Ceres ANNOT ID no. 6064457
  misc_feature (83)..(489): Pfam Id: AFG1_ATPase Pfam Desc: AFG1-like ATPase
  misc_feature (84)..(493): NCBI GI: 79325316 NCBI Desc: atpase [arabidopsis thaliana]
  misc_feature (182)..(508): NCBI GI: 115475609 NCBI Desc: os08g0265500 [oryza sativa (japonica cultivar-group)]
  misc_feature (84)..(493): NCBI GI: 42567204 NCBI Desc: afg1-like atpase family protein [arabidopsis thaliana]
  misc_feature (89)..(452): NCBI GI: 82700694 NCBI Desc: atp/gtp-binding site motif a (p-loop):afg1-like atpase [brucella melitensis biovar abortus 2308]
  misc_feature (89)..(452): NCBI GI: 82616795 NCBI Desc: atp/gtp-binding site motif a (p-loop):afg1-like atpase [brucella melitensis biovar abortus]
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: GREAT-hit functional homolog of the protein sequence given in SEQ ID NO 13557
  misc_feature: Useful for making plants with modulated biomass
  misc_feature: Useful for making plants with modulated flowering time
  misc_feature: Functional homolog of the protein sequence given in SEQ ID NO 13557
MRSVVRSLRQLRRFAQHHAERHSQATRLFGQQNALIMCGLTSRSLSMLRRNGEISRFASPGMELMRSMFSTVAADSIKDIGRGGPMVEYERRIASGDLVDGDSFQVDTIHQLQRLYEELIENEEDCQLDRYKSSEKSGRSRWLWSRLITQPSTYAPVKGLYLYGGVGTGKTMLMDLFYEQLPSNWRKKRIHFHDFMLNVHSRLQMHKGVSDPLDVVAAEISDEAIILCLDEFMVTDVADAMILNRLFRQLFSKGVILVSTSNRPPDKLYEGGLQRDLFLPFIDTLKERCIVHPIGSAVDYRQLGSAEQGFYFVGKHYSTLLKQKLQSLIGDEEPSPQTVEVIMGRKLQVSLGANGCAYFPFEDLCDRPLGAADYFGLFKKFHTLALDGVPKFGSSNRTAAYRFVTLIDVMYENKARLLCTAEAGPVGLFENIVTVAEAQKVSPRYSRSQKSDDPDLCVDNELGFAKDRTISRLTEINSREYLEDFEMRLRQQQQLPLQGLDNGGDVVLA

SEQ ID NO: 12129 - DNA, 786 bp, Sorghum bicolor
  misc_feature: Ceres ANNOT ID no. 6064459
  misc_feature: Encodes the peptide sequence at SEQ ID NO 12130
atgctgcgccgcctcgccgccgtcgccccgcgggccttctcctccttctcctcctcctcctcctccccgcacgccccgccgctggcggcgtcgggctacaccccgcgccgcgagtacggcctggtgcccatggtgatcgagcacacctcccgcggggagcgcgcctacgacatcttctcgcgcctgctcaaggagcgcatcgtctgcatccacggccccatcaccgacgacacggcgtccctcgtcgtcgcccagctgctcttcctcgagtccgagaaccccgccaagcccgtccacctctacatcaactccccggggggcgtcgtcacggcgggcctcgccatctacgacaccatgcagtacatccgctctcccgtcaccacgctctgcatcggccaggccgcctccatggcgtcgctgctcctcgccgcgggggcgagcggggagaggcgggcgctgccgaacgcgcgggtcatgatccaccagccctccggtggcgcgtcggggcaggcctccgacatcgccatccacgccaaggagatcctcaaggtgcgcgaccggctcaacaagatctacgccaagcacacgggccaggccatcgaccgcatcgagcagtgtatggagagggacatgttcatggacccggaggaggcacatgattgggggctcatcgacgaggtcatcgagcaccgtcctgtctctcttgtgtctgatgctgttggcagcgattcgccaaaccccggaactggggtgaataaagggacagatgagccatcctcagcgtga

SEQ ID NO: 12130 - protein, 261 aa, Sorghum bicolor
  misc_feature: Ceres ANNOT ID no. 6064459
  misc_feature (50)..(231): Pfam Id: CLP_protease Pfam Desc: Clp protease
  misc_feature (1)..(261): NCBI GI: 38344435 NCBI Desc: osjnba0038o10.7 [oryza sativa (japonica cultivar-group)]
  misc_feature (1)..(261): NCBI GI: 115459516 NCBI Desc: os04g0525600 [oryza sativa (japonica cultivar-group)]
  misc_feature (31)..(258): NCBI GI: 126002109 NCBI Desc: ga18618-pa [drosophila pseudoobscura]
  misc_feature (41)..(231): NCBI GI: 114771109 NCBI Desc: protease subunit of atp-dependent clp protease [alpha proteobacterium htcc2255]
  misc_feature (41)..(260): NCBI GI: 56207353 NCBI Desc: novel protein similar to human and mouse clpp caseinolytic protease, atp-dependent, proteolytic subunit homolog (e. coli) (clpp) [danio rerio]
  misc_feature (33)..(235): SWISSPROT Homolog: EC 3.4.21.92 ATP-dependent Clp protease proteolytic subunit
MLRRLAAVAPRAFSSFSSSSSSPHAPPLAASGYTPRREYGLVPMVIEHTSRGERAYDIFSRLLKERIVCIHGPITDDTASLVVAQLLFLESENPAKPVHLYINSPGGVVTAGLAIYDTMQYIRSPVTTLCIGQAASMASLLLAAGASGERRALPNARVMIHQPSGGASGQASDIAIHAKEILKVRDRLNKIYAKHTGQAIDRIEQCMERDMFMDPEEAHDWGLIDEVIEHRPVSLVSDAVGSDSPNPGTGVNKGTDEPSSA

SEQ ID NO: 12131 - DNA, 318 bp, Sorghum bicolor
  misc_feature: Ceres ANNOT ID no. 6064503
  misc_feature: Encodes the peptide sequence at SEQ ID NO 12132
atggcggatgagaatcaggctggaaagaaagaggaggaggaatttagcacaggccctctgtcagtcctaatgatgagtgttaagaacaacacccaggtgctcatcaattgccgcaacaacaagaaactacttggccgggttcgcgcttttgatcgccactgtaacatggtgctcgagaacgtgcgggagatgtggacagaggtccccaagactggcaagggcaaaaagaaggctctgcctgtgaacaaggatagattcatcagcaagatgttcctcaggggcgactcggtcatcatcgttctgaggaacccaaactga

SEQ ID NO: 12132 - protein, 105 aa, Sorghum bicolor
  misc_feature: Ceres ANNOT ID no. 6064503
  misc_feature (23)..(102): Pfam Id: LSM Pfam Desc: LSM domain
  misc_feature (1)..(104): NCBI GI: 115463137 NCBI Desc: os05g0314100 [oryza sativa (japonica cultivar-group)]
  misc_feature (3)..(104): NCBI GI: 21592784 NCBI Desc: small nuclear ribonucleoprotein-like protein [arabidopsis thaliana]
  misc_feature (9)..(104): NCBI GI: 60834798 NCBI Desc: small nuclear ribonucleoprotein d2 polypeptide [synthetic construct]
  misc_feature (9)..(104): NCBI GI: 50417589 NCBI Desc: mgc89748 protein [xenopus tropicalis]
  misc_feature (9)..(104): NCBI GI: 29294624 NCBI Desc: small nuclear ribonucleoprotein polypeptide d2 [homo sapiens]
MADENQAGKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPN

SEQ ID NO: 12133 - DNA, 993 bp, Sorghum bicolor
  misc_feature: Ceres ANNOT ID no. 6064540
  misc_feature: Encodes the peptide sequence at SEQ ID NO 12134
atgatcgccgccgccgccgcagcagcagcaggcgcggccaccgccttcccgttcgtctccaccgccttattccaccgcccgcggctccggcccagctgcccgcgccgcgccgccgccgggccctcgtcgtcctgggaggagcgcgaggacgcgcggtggctccgcgaggagcagcgctggctgcgggaggagcagcggtggctccgcgaggagtcgcgctggcgcgccgagcgcgaggcgctcctcgccgaggtcgccgcgctgcggctccgcctccgcgcgctcgagggcactcaccctgctgatcacctcgcggtcgtctccgttgacgccgtggtggcctcgcccgcgccgcagcccagcaagagcaggaggacgctgagggcgggggccgagggcgaggacgtgcgcgcgatgcaggaagctttgctgaagctcggtttttactcgggcgaggaagacatggagtactctagtttctcatctggcaccgagcgagctgtcaagacatggcagtcaacggttggaacttcagagaacggagtgatgacgtcggagctacttgagtggctattctcagggaagactggggaagatgcgaaaacgaaagatggcacaaacggagcagctgttccttctgtaacagggattgcggaggttcagaaaactgtgattacagaaaatggtgtcgccggagctggggtctccgaacacagagtgtttcttcttggtgaaaacaggtgggaagacccaaccagactgacgcaaaataaaaaaccagtcagcaccggcactactgcatcaaccaaggcatgcatctcttgtcgaggtgaagggcgcctcatgtgcttagaatgtgatggaacaggtgagccgaacattgaaccgcagttcttggagtgggtcggtgaagatacaaagtgcccatactgtgaaggacttggttccattttatgtgatgtttgtgatggaaagaaagtaatggcaagttaa

SEQ ID NO: 12134 - protein, 330 aa, Sorghum bicolor
  misc_feature: Ceres ANNOT ID no. 6064540
  misc_feature (132)..(195): Pfam Id: PG_binding_1 Pfam Desc: Putative peptidoglycan binding domain
  misc_feature (86)..(327): NCBI GI: 38345688 NCBI Desc: osjnbb0070j16.4 [oryza sativa (japonica cultivar-group)]
  misc_feature (86)..(327): NCBI GI: 116310834 NCBI Desc: osigba0140j09.2 [oryza sativa (indica cultivar-group)]
  misc_feature (68)..(326): NCBI GI: 30682566 NCBI Desc: peptidoglycan-binding domain-containing protein [arabidopsis thaliana]
MIAAAAAAAAGAATAFPFVSTALFHRPRLRPSCPRRAAAGPSSSWEEREDARWLREEQRWLREEQRWLREESRWRAEREALLAEVAALRLRLRALEGTHPADHLAVVSVDAVVASPAPQPSKSRRTLRAGAEGEDVRAMQEALLKLGFYSGEEDMEYSSFSSGTERAVKTWQSTVGTSENGVMTSELLEWLFSGKTGEDAKTKDGTNGAAVPSVTGIAEVQKTVITENGVAGAGVSEHRVFLLGENRWEDPTRLTQNKKPVSTGTTASTKACISCRGEGRLMCLECDGTGEPNIEPQFLEWVGEDTKCPYCEGLGSILCDVCDGKKVMAS

SEQ ID NO: 12135 - DNA, 1332 bp, Sorghum bicolor
  misc_feature: Ceres ANNOT ID no. 6064595
  misc_feature: Encodes the peptide sequence at SEQ ID NO 12136
atggaccccatggagcagccggagcccgaaatcgcgggccactactacgcccttcaggtgggctcctacttcctgacgggctactacaacgtcctgacgaaccagccgcacctgacgagcgagttctacacggacaacagcagcgttgtcaggctggactgcgagacgggccggtggtcatttggagagacggtggaggttatcaatgatatgatgatgtccatgaatgtaagcaaggttgaggttaaaacagcgaatttcttagagtcatggggtggggcgattacgctgttggttactggcctagtgcaattgaagggctaccctgttcgcaagcgatttactcagaatattgttcttgctccaaagaaagatggatattttatattcagcgacatctttaagctcatctgtgatgagtatgatgatcagtaccctgttgctgattacaattgtgctgacaacatgccccaagtggatgcgtcttacacaatggctgaaacagggtctgattatttggatggagaacctgaggcgcgggagactgttgctcctgttgaaaatcatgtgcagcacactgttgctcctgttgaaaatcatgtgcagcaccaagatcctttggaatataaggctggcaatgtcatttatgatgaaacttatccagaagagcatattccctcattccccagttcaacagacgtcaaaagggattcacctcttgctcctccccaccctcctttgtcgcctacccttcaagaacctgtggaagaagcacccaagacatatgcttcagtgttgcgaagaaatgtgaaggcaacgatggcaactgcagagacacagcagactcaacagttggccccacaggcacagtctgccccagtgcaggaaaagtctaacttggacaaccaccgggctgttagcacccctgaggatgaagaagagtttctttcggtttatgttgggaatctttcgccatctacttcggtctttgatcttgagaaagtgttccaggcttttggaagaattaaacccgatggagttgctatccgaagccgcaaggaggctggagtcttctttggctttgttgagttcgaagacatgtctggtattcagaatgctttaagtgcatctccaatagagttaaatggccgtttggtacatgttgaagagaggaggcctaactgcggattccctcgtggaagaagaggccgtggaagagctgatttctcaagggaccaagctggtgggagatacgacggggagtatgctactcgattgaagggaactgggcaccagaaaaaatctggacgccagtatgacagttactactag

SEQ ID NO: 12136 - protein, 443 aa, Sorghum bicolor
  misc_feature: Ceres ANNOT ID no. 6064595
  misc_feature (20)..(136): Pfam Id: NTF2 Pfam Desc: Nuclear transport factor 2 (NTF2) domain
  misc_feature (318)..(388): Pfam Id: RRM_1 Pfam Desc: RNA recognition motif. (a.k.a. RRM, RBD, or RNP domain)
  misc_feature (1)..(434): NCBI GI: 32488444 NCBI Desc: osjnba0004n05.1 [oryza sativa (japonica cultivar-group)]
  misc_feature (1)..(434): NCBI GI: 116311069 NCBI Desc: osigba0157k09-h0214g12.10 [oryza sativa (indica cultivar-group)]
  misc_feature (1)..(434): NCBI GI: 115459374 NCBI Desc: os04g0510500 [oryza sativa (japonica cultivar-group)]
  misc_feature (17)..(438): NCBI GI: 115444027 NCBI Desc: os02g0131700 [oryza sativa (japonica cultivar-group)]
  misc_feature (13)..(425): NCBI GI: 92894023 NCBI Desc: rna-binding region rnp-1 (rna recognition motif); nuclear transport factor 2 [medicago truncatula]
MDPMEQPEPEIAGHYYALQVGSYFLTGYYNVLTNQPHLTSEFYTDNSSVVRLDCETGRWSFGETVEVINDMMMSMNVSKVEVKTANFLESWGGAITLLVTGLVQLKGYPVRKRFTQNIVLAPKKDGYFIFSDIFKLICDEYDDQYPVADYNCADNMPQVDASYTMAETGSDYLDGEPEARETVAPVENHVQHTVAPVENHVQHQDPLEYKAGNVIYDETYPEEHIPSFPSSTDVKRDSPLAPPHPPLSPTLQEPVEEAPKTYASVLRRNVKATMATAETQQTQQLAPQAQSAPVQEKSNLDNHRAVSTPEDEEEFLSVYVGNLSPSTSVFDLEKVFQAFGRIKPDGVAIRSRKEAGVFFGFVEFEDMSGIQNALSASPIELNGRLVHVEERRPNCGFPRGRRGRGRADFSRDQAGGRYDGEYATRLKGTGHQKKSGRQYDSYY

SEQ ID NO: 12137 - DNA, 618 bp, Sorghum bicolor
  misc_feature: Ceres ANNOT ID no. 6064799
  misc_feature: Encodes the peptide sequence at SEQ ID NO 12138
atggccgaccccgacgactattggaacgccgagctcggcgtcttgtttcgcgtcgccgttgtggccgtgtgcgtcgtcatcattgtcatgtggtgcccgtggcgacggatccgcctctccacgctcggcggcgtcaccaccctgacgcggaggctcaactacccctgcaccgtgtgccaagagagcatggaggccggcgagaaggtccgcacgctctcctgcgaccacgcgttccactgcggcggcagcgccaagtgcgagcgcggcatcgaccaatggcttctcactcaggcgatggcgtgcccgctctgccgcaagatccccctccccgtgctgccggggaagcagccaccgccatcgtcgccagcaccttcaccgtcagcatcggagccagcgctacagcagttgccgcggacgtcgtcgtcgtcgacgcaggatttggagaaggcgctgctgcttccggcgcacgacgggacactagcggaggcgtcgtcatcagcatcggcgccaccgctagcgcagacgcagttgccgcggacctcgacgccggatgtggcgggggtgttgccgcttccggcgggcgacgaaatactaccggacgcgtcgtcatcgcagtag

SEQ ID NO: 12138 - protein, 205 aa, Sorghum bicolor
  misc_feature: Ceres ANNOT ID no. 6064799
  misc_feature (42)..(171): NCBI GI: 115459092 NCBI Desc: os04g0487700 [oryza sativa (japonica cultivar-group)]
  misc_feature (56)..(143): NCBI GI: 108710109 NCBI Desc: zinc finger, c3hc4 type family protein [oryza sativa (japonica cultivar-group)]
  misc_feature (34)..(114): NCBI GI: 145331133 NCBI Desc: protein binding / zinc ion binding [arabidopsis thaliana]
  misc_feature (56)..(134): NCBI GI: 115445315 NCBI Desc: os02g0249300 [oryza sativa (japonica cultivar-group)]
  misc_feature (56)..(157): NCBI GI: 38569180 NCBI Desc: osjnba0086b14.4 [oryza sativa (japonica cultivar-group)]
  misc_feature: The sequence is a functional homolog of SEQ ID NO. 271 in the 11/188,298 US application
  misc_feature: The sequence is a functional homolog of SEQ ID NO. 329 in the 11/188,298 US application
MADPDDYWNAELGVLFRVAVVAVCVVIIVMWCPWRRIRLSTLGGVTTLTRRLNYPCTVCQESMEAGEKVRTLSCDHAFHCGGSAKCERGIDQWLLTQAMACPLCRKIPLPVLPGKQPPPSSPAPSPSASEPALQQLPRTSSSSTQDLEKALLLPAHDGTLAEASSSASAPPLAQTQLPRTSTPDVAGVLPLPAGDEILPDASSSQ

SEQ ID NO: 12139 - DNA, 645 bp, Sorghum bicolor
  misc_feature: Ceres ANNOT ID no. 6064824
  misc_feature: Encodes the peptide sequence at SEQ ID NO 12140
atggccgaccccgacgactattggacgcggatggccatcgccggccacgccgtgctccgcatcgcctttcccgtcgccggcgtggccgtgtgcgtcgtcgccattgtcatgtggtgcccgtggcgacggatccgcctctccacgctcggcggcgtcaccaccctgacgcggacgctcaactacccctgcaccatgtgccaggagagcatggaggccggcgagaaggtccgcacgctctcctgcgaccacgcgttccactgcggcggcggcgccaagtgcgagcgcggcgtcgaccagtggcttctcactcaggcgatggcgtgcccgctctgccgcaagatccccctccccgtgctgccggggaagcagccaccgccatcgtcgccagcaccttcaccgtcagcatcggagccagctatacagcagttgccgcggacgtcgtcgtcgtcgacgcaggatttggagaaggcgctgctgcttccggcgcacgacgagacactagcggaggcgtcgtcatcagcatcggcgcccaggccaccgctagcgcagacgcagttgccgcggacctcgacgccggatgtggcgggggtgttgccgcttccggcgagcgacgaaatactaccggacgcgtcgtcatcgcagtag

SEQ ID NO: 12140 - protein, 214 aa, Sorghum bicolor
  misc_feature: Ceres ANNOT ID no. 6064824
  misc_feature (49)..(212): NCBI GI: 115459092 NCBI Desc: os04g0487700 [oryza sativa (japonica cultivar-group)]
  misc_feature (63)..(150): NCBI GI: 108710109 NCBI Desc: zinc finger, c3hc4 type family protein [oryza sativa (japonica cultivar-group)]
  misc_feature (63)..(165): NCBI GI: 38569180 NCBI Desc: osjnba0086b14.4 [oryza sativa (japonica cultivar-group)]
  misc_feature (63)..(165): NCBI GI: 116310080 NCBI Desc: h0818e04.18 [oryza sativa (indica cultivar-group)]
  misc_feature (41)..(121): NCBI GI: 145331133 NCBI Desc: protein binding / zinc ion binding [arabidopsis thaliana]
  misc_feature: The sequence is a functional homolog of SEQ ID NO. 271 in the 11/188,298 US application
  misc_feature: The sequence is a functional homolog of SEQ ID NO. 329 in the 11/188,298 US application
MADPDDYWTRMAIAGHAVLRIAFPVAGVAVCVVAIVMWCPWRRIRLSTLGGVTTLTRTLNYPCTMCQESMEAGEKVRTLSCDHAFHCGGGAKCERGVDQWLLTQAMACPLCRKIPLPVLPGKQPPPSSPAPSPSASEPAIQQLPRTSSSSTQDLEKALLLPAHDETLAEASSSASAPRPPLAQTQLPRTSTPDVAGVLPLPASDEILPDASSSQ

SEQ ID NO: 12141 - DNA, 147 bp, Sorghum bicolor
  misc_feature: Ceres ANNOT ID no. 6064826
  misc_feature: Encodes the peptide sequence at SEQ ID NO 12142
atggacgggcagggtcaacctgcattgttgtaccttgtgccatgtacattgggggttattgttattcttggttggttaagaggcgagcttcatgaattatggaactatggaaaaagtcgagcagaaaatttggttaacgaaccatga

SEQ ID NO: 12142 - protein, 48 aa, Sorghum bicolor
  misc_feature: Ceres ANNOT ID no. 6064826
  misc_feature (1)..(48): NCBI GI: 115485307 NCBI Desc: os11g0433200 [oryza sativa (japonica cultivar-group)]
  misc_feature (1)..(37): NCBI GI: 15221276 NCBI Desc: protease-associated (pa) domain-containing protein [arabidopsis thaliana]
  misc_feature (1)..(37): NCBI GI: 6850311 NCBI Desc: contains similarity to a vacuolar sorting receptor homolog from arabidopsis thaliana gbu79959
  misc_feature (1)..(38): NCBI GI: 115449841 NCBI Desc: os02g0823000 [oryza sativa (japonica cultivar-group)]
  misc_feature (1)..(38): NCBI GI: 16118854 NCBI Desc: growth-on protein gro11 [euphorbia esula]
MDGQGQPALLYLVPCTLGVIVILGWLRGELHELWNYGKSRAENLVNEP

SEQ ID NO: 12143 - DNA, 1251 bp, Sorghum bicolor
  misc_feature: Ceres ANNOT ID no. 6064832
  misc_feature: Encodes the peptide sequence at SEQ ID NO 12144
atggcgcggccggcggtgaaggcgcgggcgccgaagcacttggtggcgctcgccgtcgtcgccatcctcggcctcgtcctcgtcgccgactacctctgggcttcgtcctcggcgtcgtcctcggccgtctggtcgtccaggcttaacctccacaccagccccgccggtccgacgccgcccgtcgcgaagaagattaaggaggacaagaaatctgtaggttcgactgacataaatgcaacttttgcggacttgccagctccagaactaaaatgggaggagatggctgaagcacccgtggcccgtttggatggcgctgctttacagattaaaaatctcttatatgtatttgctggatatggcaccattaaccatgtgcattctcatgttgatatatacaatttctcggataatacatggggtggaagatttgacatgcccaaggacatggcacattcacatttggggatggttactgatggaagattcatctatgtggtaactggacagtatggtccacaatgtaggggaccaacagctcgaaattttgtattggacacagaaacaaaagaatggaatgatttgccaccattgccagttcctagatatgctccagcaacacaactttggagaggcagacttcatgtgatgggtggcagcaaggaggataggcatgaacctgggcttgaacactggagtctcgcggtaaagaatgggaaagcattggagaaagagtggaggagcgagataccaataccgcgtggaggtcctcatagggcttgtgttgttgcaaatgataaactccttgttatcggtggtcaagaaggtgatttcatggccaagcctgggtctcctatatttaaatgtgttagaagaagtgaggttgtgtatagtaatgtttatatgcttgatgatggaacgacttggaaggaacttccacctatgccaaaacctgattcacatatagaatttgcttgggtgaatgtcaacaattctcttgttattgctggtggaaccacagataagcacccaataactaaaaagatggtattggttggtgaagtatttcagttcaacctggatacactggaatggagtgtgattgggcggttacctttccgaatcaagaccacattggtaggatactgggatggctggttgtatttcacttctgggcaacgagacaaaggaccgaaagacccatctcctaaaaaggttgttgggtgcatgtggagaactaaattgcatctgtga

SEQ ID NO: 12144 - protein, 416 aa, Sorghum bicolor
  misc_feature: Ceres ANNOT ID no. 6064832
  misc_feature (150)..(198): Pfam Id: Kelch_1 Pfam Desc: Kelch motif
  misc_feature (200)..(252): Pfam Id: Kelch_2 Pfam Desc: Kelch motif
  misc_feature (1)..(416): NCBI GI: 90265262 NCBI Desc: h0302e05.10 [oryza sativa (indica cultivar-group)]
  misc_feature (1)..(416): NCBI GI: 38344229 NCBI Desc: oj991113_30.6 [oryza sativa (japonica cultivar-group)]
  misc_feature (1)..(416): NCBI GI: 115459086 NCBI Desc: os04g0487100 [oryza sativa (japonica cultivar-group)]
  misc_feature (14)..(414): NCBI GI: 15912245 NCBI Desc: at3g27220/k17e12_4 [arabidopsis thaliana]
  misc_feature (91)..(391): NCBI GI: 113940834 NCBI Desc: kelch repeat [herpetosiphon aurantiacus atcc 23779]
MARPAVKARAPKHLVALAVVAILGLVLVADYLWASSSASSSAVWSSRLNLHTSPAGPTPPVAKKIKEDKKSVGSTDINATFADLPAPELKWEEMAEAPVARLDGAALQIKNLLYVFAGYGTINHVHSHVDIYNFSDNTWGGRFDMPKDMAHSHLGMVTDGRFIYVVTGQYGPQCRGPTARNFVLDTETKEWNDLPPLPVPRYAPATQLWRGRLHVMGGSKEDRHEPGLEHWSLAVKNGKALEKEWRSEIPIPRGGPHRACVVANDKLLVIGGQEGDFMAKPGSPIFKCVRRSEVVYSNVYMLDDGTTWKELPPMPKPDSHIEFAWVNVNNSLVIAGGTTDKHPITKKMVLVGEVFQFNLDTLEWSVIGRLPFRIKTTLVGYWDGWLYFTSGQRDKGPKDPSPKKVVGCMWRTKLHL

SEQ ID NO: 12145 - DNA, 477 bp, Sorghum bicolor; identical to SEQ ID NO: 11583
  misc_feature: Ceres ANNOT ID no. 6064924
  misc_feature: Encodes the peptide sequence at SEQ ID NO 12146

SEQ ID NO: 12146 - protein, 158 aa, Sorghum bicolor; identical to SEQ ID NO: 11584
  misc_feature: Ceres ANNOT ID no. 6064924
  misc_feature (8)..(152): Pfam Id: Dirigent Pfam Desc: Dirigent-like protein
  misc_feature (14)..(158): NCBI GI: 20160673 NCBI Desc: beta-glucosidase aggregating factor precursor-like protein [oryza sativa (japonica cultivar-group)]
  misc_feature (1)..(151): NCBI GI: 55416171 NCBI Desc: dirigent-like protein [saccharum hybrid cultivar]
  misc_feature (11)..(151): NCBI GI: 115481556 NCBI Desc: os10g0335000 [oryza sativa (japonica cultivar-group)]
  misc_feature (1)..(151): NCBI GI: 37700483 NCBI Desc: dirigent [saccharum hybrid cultivar]
  misc_feature (1)..(151): NCBI GI: 38455904 NCBI Desc: jasmonate-induced protein [triticum aestivum]

SEQ ID NO: 12147 - DNA, 1512 bp, Sorghum bicolor
  misc_feature: Ceres ANNOT ID no. 6064936
  misc_feature: Encodes the peptide sequence at SEQ ID NO 12148
  misc_feature: Up-regulated in shoot tissues in response to salicylic acid treatment
atggctgctccctgcagctgccatggctgctggctgctcctcctgctgctgctgctgcttgctgctgcgggtgctcttggtgcagagggcgcctcccttgtgatcgtgcagctggacgcggagtccctgctcccttccgcagcagccgcgtcttgccacacgccagagcaaagacctgaggccgggacggccacgaggatgcccatcgtgcaccagcacggcccgtgctcgccgctggccgacgacaagcacgggaagaaggcgccgtcccacacggagatcctcgtcgcggaccagcgccgcgtcgagtacatccaccgccgcgtgtccgagaccaccgggcgggtgagacggcagaagcacagcgccccagtcgtggagctccggcccggcacgccgtcgtcgacccgctcttcgtcgtcgtcgctgtcgtcctcggccacgtctacgaacctgccggcgaagtccgggctctcgctgaacacgggcaactacgtggtgcccatccgcctcggcacgccggcggcgcggttcacggtggtgttcgacaccggcagcgacacgacgtgggtgcagtgccagccgtgcgtggcctactgctaccagcagaaggagcctctcttcaccccgaccaagtcggccacctacgccaacatctcctgcacgtcgtcctactgctccgacctcgacaccagaggctgctccggcggccactgcctgtacgccgtccagtacggcgacggctcctacaccgtcggcttctacgcccaagacacgctcaccctgggctacgacaccgtcaaggacttccggttcgggtgcggcgagaagaaccgcgggctgttcgggaaagcggcggggctgatgggtctcggccgcgggaagacgtcggtgccggtgcaggcgtacgacaagtacagcggcgtgttcgcgtactgcatcccggcgacgtcgtcagggacggggttcctggacttcgggccgggcgcgccggcggcggcgaacgcgcggctgacgccgatgctggtggacaacgggccgacgttctactacgtggggatgacgggcatcaaggtgggcgggcacctgctgtccatcccggccaccgtcttctccgacgccggcgcgctggtggactccggcacggtgatcacgcggctgccgccgtcggcgtacgagccgctgcggtcggcgttcgccaagggcatggagggcctggggtacaagacggcgccggcgttctcgatcctggacacctgctacgacctgacggggtaccaggggagcatcgcgctgcccgcggtgtcgctggtgttccagggcggcgcgtgcctggacgtggacgcgtcggggatcctgtacgtggcggacgtgtcgcaggcgtgcctggcgttcgcggccaacgacgacgacaccgacatgaccatcgtcgggaacacgcagcagaagacgtacagcgtgctctacgacctcggcaagaaggtcgtcggcttcgccccgggagcttgctga

SEQ ID NO: 12148 - protein, 503 aa, Sorghum bicolor
  misc_feature: Ceres ANNOT ID no. 6064936
  misc_feature (164)..(501): Pfam Id: Asp Pfam Desc: Eukaryotic aspartyl protease
  misc_feature (67)..(503): NCBI GI: 24430421 NCBI Desc: 41 kd chloroplast nucleoid dna binding protein (cnd41) [nicotiana sylvestris]
  misc_feature (67)..(503): NCBI GI: 2541876 NCBI Desc: cnd41, chloroplast nucleoid dna binding protein [nicotiana tabacum]
  misc_feature (91)..(503): NCBI GI: 8979711 NCBI Desc: nucleoid dna-binding protein cnd41-like protein [arabidopsis thaliana]
  misc_feature (239)..(503): NCBI GI: 86438622 NCBI Desc: chloroplast nucleoid binding protein [brachypodium sylvaticum]
  misc_feature (134)..(503): NCBI GI: 53792202 NCBI Desc: nucleoid dna-binding protein cnd41-like [oryza sativa (japonica cultivar-group)]
  misc_feature: Up-regulated in shoot tissues in response to salicylic acid treatment
MAAPCSCHGCWLLLLLLLLLAAAGALGAEGASLVIVQLDAESLLPSAAAASCHTPEQRPEAGTATRMPIVHQHGPCSPLADDKHGKKAPSHTEILVADQRRVEYIHRRVSETTGRVRRQKHSAPVVELRPGTPSSTRSSSSSLSSSATSTNLPAKSGLSLNTGNYVVPIRLGTPAARFTVVFDTGSDTTWVQCQPCVAYCYQQKEPLFTPTKSATYANISCTSSYCSDLDTRGCSGGHCLYAVQYGDGSYTVGFYAQDTLTLGYDTVKDFRFGCGEKNRGLFGKAAGLMGLGRGKTSVPVQAYDKYSGVFAYCIPATSSGTGFLDFGPGAPAAANARLTPMLVDNGPTFYYVGMTGIKVGGHLLSIPATVFSDAGALVDSGTVITRLPPSAYEPLRSAFAKGMEGLGYKTAPAFSILDTCYDLTGYQGSIALPAVSLVFQGGACLDVDASGILYVADVSQACLAFAANDDDTDMTIVGNTQQKTYSVLYDLGKKVVGFAPGAC

SEQ ID NO: 12149 - DNA, 1680 bp, Sorghum bicolor
  misc_feature: Ceres ANNOT ID no. 6064962
  misc_feature: Encodes the peptide sequence at SEQ ID NO 12150
atggaatggcgccgcctcttcctccctcgccaccactccctctcctccggcgcccaggccagcttcgctgtcgtcgccggtgagatctctgccctcctcaccgcccgacgttttcgggtttccgttaaccgggcggagcagttcatacgctccaatgccgtcggggcgtccggcgtccccgagatgtaccacttgttggccgccgctggcccacgtgagcagtgcctttacctcagcggcacggcctccgtgctggtcgaggcatcggcgcgcgcggacctccccgacggtgcgctgctgctgatcgacctgctcatccacacgcccatgttgccgcggccgtcggcgatctcctgcggccacctcataacgaagctcctctccctcggacgccgcgcggatgcgcgccgcgtgttggagaccctcgccgatcgcaagcgcgactgggcggtcgccacggtttggagagccgggagagcggccgaggccgtcaaggtgttcggcgaaatggcggacacggccgcggcgccaaaacattccaggtaccggtaccttaccaagaatatgatgaatgactgcctgatgaagggagatctggaggctgcttcagagttgcagacccagatggtgctggtgggcttgaaggtacccaagcaacagcggcgaatgcttcggatgctggaaaaattccggcagtgcccacacaaaatcccccggaatgtgctcattgaaatctgcatcatggcggacagcgtcgatggtgccatccgttggctccatcacatgggcaatgatgacatggcacctcccaatgctcactcctacaacctagtactcgccgggctctggaaggctggtaggggcggcgatgctgttgagatgttcgacgagatggcagacatgtccctggcgccaaataatttcacatatactgtcatgatcgatggccacttgaagaggctgagtcatgttctggcctcaaagaagaacgagagtggagatctggaggctgcgctcgtgctgcgggctcagatggtgcaggatggcttcaagccagacgaatacacttactatttgctgatggctgaactctgcttggctgaacggctgggagacgttacagctctgttccatgagatgctgatacaagggacgacactacacaagatcgttcatggaagcctgttcaagttcctcttcagaatcaacgaagatcagctactgggcattgttgaaaaatctgcaaaggatagtgctgctgcagcggataatggttgcattaccttgttaaaggagctttgcaggattcagaaagtttcactcgcggagaaggtgctgcggacatttgtgggagcagggttggtcccgacgacagagatgtacaacattctcgttgatgggtattgcaagatcaaggaactccaaggggcattctcgttgtgtcgccagatggaatcacatggtcagcttgtacctaatgaagccacctacgaggctctgctgctggccgtgctcaacaacatgagcatcatctattgggaggacgttctggagttgtttgagaaaaatggagttagtactgacgcactgaactccggcagttcggctacacatggattcaagtataggtctagtctgatacctagaatgtttaacaaactggtgagcaagctattttag

SEQ ID NO: 12150 - protein, 559 aa, Sorghum bicolor
  misc_feature: Ceres ANNOT ID no. 6064962
  misc_feature (273)..(307): Pfam Id: PPR Pfam Desc: PPR repeat
  misc_feature (459)..(493): Pfam Id: PPR Pfam Desc: PPR repeat
  misc_feature (221)..(526): NCBI GI: 115476328 NCBI Desc: os08g0402600 [oryza sativa (japonica cultivar-group)]
  misc_feature (219)..(529): NCBI GI: 144923591 NCBI Desc: tetratricopeptide-like helical [medicago truncatula]
  misc_feature (240)..(501): NCBI GI: 90265197 NCBI Desc: b0812a04.6 [oryza sativa (indica cultivar-group)]
  misc_feature (240)..(501): NCBI GI: 38567720 NCBI Desc: b1358b12.18 [oryza sativa (japonica cultivar-group)]
  misc_feature (72)..(501): NCBI GI: 119638441 NCBI Desc: auxin efflux carrier [brachypodium sylvaticum]
MEWRRLFLPRHHSLSSGAQASFAVVAGEISALLTARRFRVSVNRAEQFIRSNAVGASGVPEMYHLLAAAGPREQCLYLSGTASVLVEASARADLPDGALLLIDLLIHTPMLPRPSAISCGHLITKLLSLGRRADARRVLETLADRKRDWAVATVWRAGRAAEAVKVFGEMADTAAAPKHSRYRYLTKNMMNDCLMKGDLEAASELQTQMVLVGLKVPKQQRRMLRMLEKFRQCPHKIPRNVLIEICIMADSVDGAIRWLHHMGNDDMAPPNAHSYNLVLAGLWKAGRGGDAVEMFDEMADMSLAPNNFTYTVMIDGHLKRLSHVLASKKNESGDLEAALVLRAQMVQDGFKPDEYTYYLLMAELCLAERLGDVTALFHEMLIQGTTLHKIVHGSLFKFLFRINEDQLLGIVEKSAKDSAAAADNGCITLLKELCRIQKVSLAEKVLRTFVGAGLVPTTEMYNILVDGYCKIKELQGAFSLCRQMESHGQLVPNEATYEALLLAVLNNMSIIYWEDVLELFEKNGVSTDALNSGSSATHGFKYRSSLIPRMFNKLVSKLF

SEQ ID NO: 12151 - DNA, 996 bp, Sorghum bicolor
  misc_feature: Ceres ANNOT ID no. 6064965
  misc_feature: Encodes the peptide sequence at SEQ ID NO 12152
atgagcagcagatacagggctgacagagggagggctgcctcagatatgacaaggaagctcagagagttgcttcaaaagagcgacaaccgcatatgtgctgactgcagcgcacctgatcccaaatgggcatcagctaatattggagtattcatttgtctaaaatgctctggtgttcacagaagccttgggacacatgtttcaaaggtgctgtcagtcactctagatcaatgggcagatgatgagatcaactccatgatagaagttggtggaaactcttatgccaatgctatatatgaagcatttctgccagagggctatcacaagccgcatccagattctagccaggaagagagagctgatttcatcaggtcaaagtatgagctgcaagaatttttgaagccaagcctgaggttagtttctaataagggctctttagaggctaccagctctcggaaacataccggcagtaatgtctctctttctgctagtttcaacagtgaggctggaatggttgagtttatcggaatactaaaagttaaagtaataagagggactaaattagctgtaagagacctgataagtagtgacccctatgttgtactgaccctaggacaacagaaagcaaagacttctgtgattaaacgtaatctgaatcctgtttggaatgaagagcttaagctgtcagttcctcagcagtacgggcctctgaagcttcaagtgttcgaccatgacatgctatcaaaggatgacaaaatgggcgatgccgagattgacctgcagccgatgatcagtgcagctacagcgtttggcgaccctgacctactcgcggacatgcagatcggcaagtggctcaagtcccccgacaacgcgctggcgagggacagcgccgtcaatgtcatcagtggcaaggtcaagcaggaggtctctctgatgctacagaacgtggaatccggggaggtagaactagagctggagtggatacctctcaatcagtag

SEQ ID NO: 12152 - protein, 331 aa, Sorghum bicolor
  misc_feature: Ceres ANNOT ID no. 6064965
  misc_feature (18)..(139): Pfam Id: ArfGap Pfam Desc: Putative GTPase activating protein for Arf
  misc_feature (177)..(256): Pfam Id: C2 Pfam Desc: C2 domain
  misc_feature (1)..(330): NCBI GI: 34304192 NCBI Desc: zinc finger protein f35 [oryza sativa (japonica cultivar-group)]
  misc_feature (10)..(330): NCBI GI: 140068173 NCBI Desc: c2; arf gtpase activating protein [medicago truncatula]
  misc_feature (46)..(330): NCBI GI: 115444853 NCBI Desc: os02g0198300 [oryza sativa (japonica cultivar-group)]
  misc_feature (170)..(331): NCBI GI: 92885095 NCBI Desc: c2 [medicago truncatula]
  misc_feature (174)..(329): NCBI GI: 115470237 NCBI Desc: os07g0108400 [oryza sativa (japonica cultivar-group)]
  misc_feature: The sequence is a functional homolog of SEQ ID NO. 425 in the 11/188,298 US application
MSSRYRADRGRAASDMTRKLRELLQKSDNRICADCSAPDPKWASANIGVFICLKCSGVHRSLGTHVSKVLSVTLDQWADDEINSMIEVGGNSYANAIYEAFLPEGYHKPHPDSSQEERADFIRSKYELQEFLKPSLRLVSNKGSLEATSSRKHTGSNVSLSASFNSEAGMVEFIGILKVKVIRGTKLAVRDLISSDPYVVLTLGQQKAKTSVIKRNLNPVWNEELKLSVPQQYGPLKLQVFDHDMLSKDDKMGDAEIDLQPMISAATAFGDPDLLADMQIGKWLKSPDNALARDSAVNVISGKVKQEVSLMLQNVESGEVELELEWIPLNQ

SEQ ID NO: 12153 - DNA, 180 bp, Sorghum bicolor
  misc_feature: Ceres ANNOT ID no. 6065223
  misc_feature: Encodes the peptide sequence at SEQ ID NO 12154
atggcaagtggcggcgccaacgacgacgacgtggtggaggtgagctgcggcggcagaggcggcggcgaccccggcgtgtatgtcacggtgctcaagaggaagctcgacctgtactgcgccgccgtcgccaaatccatggtgtggtttctcctcttcttcctctcttccttcaatgattag

SEQ ID NO: 12154 - protein, 59 aa, Sorghum bicolor
  misc_feature: Ceres ANNOT ID no. 6065223
  misc_feature (17)..(46): NCBI GI: 115489448 NCBI Desc: os12g0601600 [oryza sativa (japonica cultivar-group)]
MASGGANDDDVVEVSCGGRGGGDPGVYVTVLKRKLDLYCAAVAKSMVWFLLFFLSSFND

SEQ ID NO: 12155 - DNA, 1329 bp, Sorghum bicolor
  misc_feature: Ceres ANNOT ID no. 6065388
  misc_feature: Encodes the peptide sequence at SEQ ID NO 12156
atgccgttcttcgaggaaatgatggagggatcgtcgtacatccgcacgcacctgcagcagatcgccgcagcgtcggtctccacggcaagctgcggcggcgcgtctaacaccgacgccgatgacgcggagtgccgcgacgaggcggcggcgctgaggctcaagatggtggccgtcgcggccatactcgtcgccggcgcgaccggcgtcgcgatcccgctcgtcggccgccgctgccgcgggcgcggaggaggagcctcctcctcctccggctccttctcctcctccccctccgccggcggggcgttcgtgctcgtcaaggcgttcgcggccggggtgatcctggccacgggcttcgtccacatgctgcacgacgcggacgaggcgctcacggacccctgcctccccgccgcgccctggcgccgcttcccgttcccgggcttcgtcgccatgctcgccgcgctcgccacgctcgtcttcgacttcgtcggcacgcacatgtacgaaagcaagcagcacagcgccgacgcggcggaagccgccgccgccgcaggcaatgccagtgtcaatgcgagcggccacgacgtgaccgcggcgctgctagaggacggcgcgctcgcggggagcgttgccagcggcatagggtacggcgcgctcatggggagcgttggcagcagcatagggtacagcgcgctcatggggagcgttggaagcagcatcgggggaggccacatggaccccatgcacatcgtggggatgcgcgcgcacgccgcggcgcacaggcatagctactcccacgggatcggcccttgtgatgacggtcacaatgggaacgatgaggagccgtcccaagctcgtcatgtggttgtctcacagattcttgagcttgggattgtatcacactcggtgatcatcggactatctttgggcgtctcacagaacccctgtaccatcaagcctctagttgctgccctctccttccaccagttttttgagggctttgcattgggcggctgcatttctgaggctcagttcaagggtttctctacactccttatggctttcttcttcgctatcacaacgcctactgggatcaccgtgggggcaggtatcgcgtccttctacaaccccaacagcccgagggcacttgtggtagagggcattctggattccatatcggctggtattctgatctacatggccttggtggacctcattgcagctgatttcctcagcaagagaatgagctgtaacctgaggcttcaagtctgctcatacattgccttgttccttggtgccatgtccatgtcgtctctggccatctgggcttag

SEQ ID NO: 12156 - protein, 442 aa, Sorghum bicolor
  misc_feature: Ceres ANNOT ID no. 6065388
  misc_feature (51)..(439): Pfam Id: Zip Pfam Desc: ZIP Zinc transporter
  misc_feature (252)..(442): NCBI GI: 89994167 NCBI Desc: zinc transporter protein zip7 [hordeum vulgare]
  misc_feature (286)..(442): NCBI GI: 92898254 NCBI Desc: zinc/iron permease [medicago truncatula]
  misc_feature (229)..(442): NCBI GI: 38036088 NCBI Desc: metal transport protein [medicago truncatula]
  misc_feature (20)..(441): NCBI GI: 14582257 NCBI Desc: zip-like zinc transporter [thlaspi caerulescens]
  misc_feature (102)..(442): NCBI GI: 82581289 NCBI Desc: zip family metal transporter [chengiopanax sciadophylloides]
  misc_feature: The sequence is a functional homolog of SEQ ID NO. 287 in the 11/188,298 US application
MPFFEEMMEGSSYIRTHLQQIAAASVSTASCGGASNTDADDAECRDEAAALRLKMVAVAAILVAGATGVAIPLVGRRCRGRGGGASSSSGSFSSSPSAGGAFVLVKAFAAGVILATGFVHMLHDADEALTDPCLPAAPWRRFPFPGFVAMLAALATLVFDFVGTHMYESKQHSADAAEAAAAAGNASVNASGHDVTAALLEDGALAGSVASGIGYGALMGSVGSSIGYSALMGSVGSSIGGGHMDPMHIVGMRAHAAAHRHSYSHGIGPCDDGHNGNDEEPSQARHVVVSQILELGIVSHSVIIGLSLGVSQNPCTIKPLVAALSFHQFFEGFALGGCISEAQFKGFSTLLMAFFFAITTPTGITVGAGIASFYNPNSPRALVVEGILDSISAGILIYMALVDLIAADFLSKRMSCNLRLQVCSYIALFLGAMSMSSLAIWA

SEQ ID NO: 12157 - DNA, 1539 bp, Sorghum bicolor
  misc_feature: Ceres ANNOT ID no. 6065417
  misc_feature: Encodes the peptide sequence at SEQ ID NO 12158
atggatcccccaggccccggcgacgaaggcgaggcggcgcagccgcagccgctggagtggcggttcgcccaggtcttcggcgagcgtgccgcgggcgaggacgtccaggaagttgacatcatctctgcaattgaatttgataaatctggtgatcatcttgccactggggataaaggaggacgcgtggttttatttgaaaggacagatgctcgggatcagaatgccatccggagagaactggagagacaagatgttccagttactagacacccagaattccgctacaaaacagaatttcagagtcatgaacctgagtttgactacctcaaaagtttggaaatagaggaaaagatcaacaagatcaagtggtgccagacagccaacagtgctctctcccttttgtctacaaatgataaaacaataaaatactggaaggttcaagagaagaaagtaaaacgagttgcagtaatgaatttggacagttcccaaagtataggaagtagtaccactgctattgcaagtaccagtagttctaaggcacctcttccaaatggtggatgctctgataagtttgattgcctgaataatggtctctcatttccacctggaggctacccatcactgcgtttgccagtggttaccagtctagaagcaaaccctgttgctagatgtcgacgtgtatttgctcacgcacacgattaccatataaattctatttcaaataatagtgatggtgagacattcatatcagcagatgatctccgaataaatttatggaacttggaaataaacagccagagctttaacattgttgatgtgaagcctacaaacatggaagatctaacagaggtgattacatgtgcggagttccatccatcccattgtaatacactggcctacagtagttcaaagggttctatccgccttattgatctacgtcaatcagcactgtgtgacaaccattccaaaatattcgaggaacatgaagcacctggatcaagatccttctttacagaaattattgcatcaatttctgatataaagttttcaaggaatggtagatatattcttagccgtgattatatgactctcaagctatgggatctaaacatgaattcaggccctgtttcaaccttccaagtccatgaacatttgagacctaggctctgcgatctgtatgagaatgactcaattttcgacaagtttgagtgttgtcttagtggggatggacttcgtgttgcaactggttcttatggtaatatatttcgcgtttttggttgtacttctggaagcatggaggcaacaactttggaagcaagtaggaatccaatgaggcgtcagattgcgaatccagtaaggcccacacggacactaacttcttttacccgtggtgttcggagaggtggagaaaatcaaggcgttgatgctaatgggaattcatttgacttctcaacgaagctgctccacctcgcatggcacccgaccgagaattccattgcatgtgctgctgcaaatagcttgtatatgtattatgcgtag

SEQ ID NO: 12158 - protein, 512 aa, Sorghum bicolor
  misc_feature: Ceres ANNOT ID no. 6065417
  misc_feature (1)..(512): NCBI GI: 110832726 NCBI Desc: serine/threonine protein phosphatase 2a 55 kda regulatory subunit b alpha isoform (pp2a, subunit b, alpha isoform)
  misc_feature (1)..(512): NCBI GI: 115468560 NCBI Desc: os06g0563300 [oryza sativa (japonica cultivar-group)]
  misc_feature (1)..(512): NCBI GI: 75325493 NCBI Desc: serine/threonine protein phosphatase 2a 55 kda regulatory subunit b beta isoform (pp2a, subunit b, beta isoform)
  misc_feature (14)..(512): NCBI GI: 3421415 NCBI Desc: protein phosphatase 2a 55 kda b regulatory subunit [oryza sativa]
  misc_feature (14)..(512): NCBI GI: 3421413 NCBI Desc: protein phosphatase 2a 55 kda b regulatory subunit [oryza sativa]
MDPPGPGDEGEAAQPQPLEWRFAQVFGERAAGEDVQEVDIISAIEFDKSGDHLATGDKGGRVVLFERTDARDQNAIRRELERQDVPVTRHPEFRYKTEFQSHEPEFDYLKSLEIEEKINKIKWCQTANSALSLLSTNDKTIKYWKVQEKKVKRVAVMNLDSSQSIGSSTTAIASTSSSKAPLPNGGCSDKFDCLNNGLSFPPGGYPSLRLPVVTSLEANPVARCRRVFAHAHDYHINSISNNSDGETFISADDLRINLWNLEINSQSFNIVDVKPTNMEDLTEVITCAEFHPSHCNTLAYSSSKGSIRLIDLRQSALCDNHSKIFEEHEAPGSRSFFTEIIASISDIKFSRNGRYILSRDYMTLKLWDLNMNSGPVSTFQVHEHLRPRLCDLYENDSIFDKFECCLSGDGLRVATGSYGNIFRVFGCTSGSMEATTLEASRNPMRRQIANPVRPTRTLTSFTRGVRRGGENQGVDANGNSFDFSTKLLHLAWHPTENSIACAAANSLYMYYA

SEQ ID NO: 12159 - DNA, 1386 bp, Sorghum bicolor
  misc_feature: Ceres ANNOT ID no. 6065466
  misc_feature: Encodes the peptide sequence at SEQ ID NO 12160
atggatggtgcagcggcggcggcggcggcaaccggtagcggcggtggcggccaccgccgcatggactcaaggatcgaggagcacgggaagtacctgtcggagtcgagctgctgctcacagtgcggccacaagaccgagcggaagctggactgggtggggctgccggcgggggtcaagttcgacccgacggatcaggagctgattgagcacctgcaggccaaggtccgggctgcttctgcggcggcgccgtcgcaccctctgatcgatgagttcatacccaccattgagggggaggacggcatatgctacacccatcctgagagactgccaggtttgacaaaggacggccggagcaggcactttttccaccggccgtccaaggcttacaccaccggcactcgcaagcgccgtaagattcagccgcgggccgcggagtcctcgtcgtcctccgccctgcccgcgcagcagcagcaacagcagcagcggagcgagacgcggtggcacaagaccggcaagacgcggccggtggtggtcgccggccagcagcgtgggtgcaagaagatcctggtgctctacaccaacttcggcaagcaccgcaagcccgataagaccaactgggtgatgcaccagtaccacctgggcgacaaagaggaggagcgcgagggcgagctcgtcgtgtccaagatcttctaccagacgcagcccaggcagtgtggcgtcgcggcggagcctgccgtcgccgccgccgcctcctctgacacagtggaggaggctgctgctgatccacctttgccgccggatggcatggtagtaccaccgccagatgtcgccggtgccttccacggcgccgctggcattgatgagttcaactttgcgcagttcaggagcagcttcgaggaggtggacgtgggagcatcatcagttcagatttcggtgagggatgatgaggaagtgcatgctgggcatcctaaccttcaccaggagcataatcttcaccagcatcaatttggcaaccaggagcaacgacagcgcatggctgcagctgctgcagcattccacatcaacacaccaacggagcctatcaccacgatgatcacctcatcgacggtggttcaccatggttctgccgtacttcaacatccagatgcatatggacatggcacgacttatcgtcgtcatcagcaggtggatgatgagcagctacaccaacaacctcaaagttttgatggacggtcaactgctgggcttgaagcggtgatcatgggatgtacttcatcaaggaggtccaaaagaggggaagcatctggttcaggtggtaacaaggagagcactggatggccgtaccaatccttctggccatctgacagtcaggatcatcatgggtag

SEQ ID NO: 12160 - protein, 461 aa, Sorghum bicolor
  misc_feature: Ceres ANNOT ID no. 6065466
  misc_feature (54)..(214): Pfam Id: NAM Pfam Desc: No apical meristem (NAM) protein
  misc_feature (84)..(461): NCBI GI: 115435024 NCBI Desc: os01g0191300 [oryza sativa (japonica cultivar-group)]
  misc_feature (4)..(139): NCBI GI: 56202085 NCBI Desc: no apical meristem (nam) protein-like [oryza sativa (japonica cultivar-group)]
  misc_feature (10)..(250): NCBI GI: 115462515 NCBI Desc: os05g0194500 [oryza sativa (japonica cultivar-group)]
  misc_feature (20)..(139): NCBI GI: 18396807 NCBI Desc: no apical meristem (nam) family protein [arabidopsis thaliana]
  misc_feature (50)..(139): NCBI GI: 6560767 NCBI Desc: f3m18.9 [arabidopsis thaliana]
  misc_feature: The sequence is a functional homolog of SEQ ID NO 1710 in the 10/374,780US patent application
  misc_feature: The sequence is a functional homolog of SEQ ID NO 1711 in the 10/374,780US patent application
  misc_feature: The sequence is a functional homolog of SEQ ID NO 1712 in the 10/374,780US patent application
  misc_feature: The sequence is a functional homolog of SEQ ID NO 1713 in the 10/374,780US patent application
  misc_feature: The sequence is a functional homolog of SEQ ID NO 542 in the 10/666,642US patent application
  misc_feature: Useful for making plants with modulated growth and phenotype characteristics
  misc_feature: The sequence is a functional homolog of SEQ ID NO 1710 in the 20060162006 US patent application
  misc_feature: The sequence is a functional homolog of SEQ ID NO 1711 in the 20060162006 US patent application
  misc_feature: The sequence is a functional homolog of SEQ ID NO 1713 in the 20060162006 US patent application
  misc_feature: The sequence is a functional homolog of SEQ ID NO 542 in the 20070033671 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO. 335 in the 11/188,298 US application
  misc_feature: The sequence is a functional homolog of SEQ ID NO. 362 in the 11/188,298 US application
  misc_feature: The sequence is a functional homolog of SEQ ID NO. 466 in the 11/188,298 US application
MDGAAAAAAATGSGGGGHRRMDSRIEEHGKYLSESSCCSQCGHKTERKLDWVGLPAGVKFDPTDQELIEHLQAKVRAASAAAPSHPLIDEFIPTIEGEDGICYTHPERLPGLTKDGRSRHFFHRPSKAYTTGTRKRRKIQPRAAESSSSSALPAQQQQQQQRSETRWHKTGKTRPVVVAGQQRGCKKILVLYTNFGKHRKPDKTNWVMHQYHLGDKEEEREGELVVSKIFYQTQPRQCGVAAEPAVAAAASSDTVEEAAADPPLPPDGMVVPPPDVAGAFHGAAGIDEFNFAQFRSSFEEVDVGASSVQISVRDDEEVHAGHPNLHQEHNLHQHQFGNQEQRQRMAAAAAAFHINTPTEPITTMITSSTVVHHGSAVLQHPDAYGHGTTYRRHQQVDDEQLHQQPQSFDGRSTAGLEAVIMGCTSSRRSKRGEASGSGGNKESTGWPYQSFWPSDSQDHHG

SEQ ID NO: 12161 - DNA, 657 bp, Sorghum bicolor
  misc_feature: Ceres ANNOT ID no. 6065478
  misc_feature: Encodes the peptide sequence at SEQ ID NO 12162
atgggagaggcttccgaggccgtggcggcgctccacgcaggaggggaggacggcggcggcggcgttgccaccggaggttgttgggtatccgggagtacagcagggtcggcgtcggcgtcgtcggggatcgggacggcgtccagcgggtcgtcgtcgtcgtcgtcttcgctcttctcatcgacgacgacgtggagcgtgggtgacgaagacgaggacggagactgcgcgacgtcgtcctcccgaccggcggcggatcgtcgtcgtcgtcatcgtcacttctcgtccttgtcttcatcgtcgtcgtcctcgatgtcgtcagagtcggaggcgtcgcagatgaacggggccgctggcggcccgctctacgggatgtcgacgatgcgcgatgatctcccgccggctcaaggactcagaacggggctatctatgtactacaaggggaggtcggagtccttcacatcgctagccgacgtcatctgcgtggaggaccttgcaaagaagaccaccctgtacatcaggaggccaaaggcgtccagacgtcacgctgcagcgctgggtgtgaagaacaggttgtcaaagacagtagcaaggaaagagccacccagggggaggaaaccagctgcatctgaatgccagggaaagctatacagatgctag

SEQ ID NO: 12162 - protein, 218 aa, Sorghum bicolor
  misc_feature: Ceres ANNOT ID no. 6065478
  misc_feature (14)..(119): NCBI GI: 90021917 NCBI Desc: cellobiohydrolase a (1 4-beta-cellobiosidase a)-like [saccharophagus degradans 2-40]
  misc_feature (13)..(119): NCBI GI: 9087201 NCBI Desc: sericin-1 (silk gum protein 1)
  misc_feature (14)..(134): NCBI GI: 90020297 NCBI Desc: rhogef guanine nucleotide exchange factor for rho/rac/cdc42-like gtpases-like [saccharophagus degradans 2-40]
  misc_feature (2)..(119): NCBI GI: 12043703 NCBI Desc: merozoite surface protein [plasmodium falciparum]
  misc_feature (2)..(125): NCBI GI: 89295696 NCBI Desc: scp-like extracellular protein [tetrahymena thermophila sb210]
  misc_feature: The plant is abnormally small.
  misc_feature: Useful for making plants with modulated biomass
  misc_feature: GREAT-hit functional homolog of the protein sequence given in SEQ ID NO 12974
  misc_feature: Useful for making plants with modulated biomass
  misc_feature: Functional homolog of the protein sequence given in SEQ ID NO 12974
MGEASEAVAALHAGGEDGGGGVATGGCWVSGSTAGSASASSGIGTASSGSSSSSSSLFSSTTTWSVGDEDEDGDCATSSSRPAADRRRRHRHFSSLSSSSSSSMSSESEASQMNGAAGGPLYGMSTMRDDLPPAQGLRTGLSMYYKGRSESFTSLADVICVEDLAKKTTLYIRRPKASRRHAAALGVKNRLSKTVARKEPPRGRKPAASECQGKLYRC

SEQ ID NO: 12163 - DNA, 1095 bp, Sorghum bicolor
  misc_feature: Ceres ANNOT ID no. 6065872
  misc_feature: Encodes the peptide sequence at SEQ ID NO 12164
atggttgccgtggcggcggaggtcgcgatccgcggtgcggacgccgtgccggcggcggagagggaagcggtgagggcggcggctgcggaggcggcggcgaagggcggtgagggggaatcggggaaggaggaggtgaggtactatgcgagcgacattaggaagctggaggagctgttttcgaagctgaacccctcggcggaggagttcgtgccgccgtcgcgccgccgcgtggacggcggcgctcgtcgcctctcggccgacgcgcccgtgttcgtgtcgccggcgatcgactactacgcgcgccaccaccagctcccgccgccgccgctgcagcagcagcagccgatgcacgtgcttcagtttgtgggtggcgtcggcgggggtggcatgggtggcggcggggggagggactcaagcagcgatggatccgtcaatggtcagccgaatcgacggagaaggaatggtttcatccaggggaggagaaggatgatgggtggccggcctcgtcgatctgacagggaggatagtgtgcggcggacagtctatgtctctgacattgatcagcatgtaactgaacagaaacttgctgaagttttttcaacctgtggacaggtggtagattgccgtatctgtggtgatcctaactcagtgctccgttttgcttttatcgagtttgctgatgatgttggtgcacaagctgcactagcacttggtggaaccgtgcttggcttttatcctgtcaaggttctgccatcaaagaccgcaattttgcctgtgaatcctaaatttcttcctcgaactgaggatgaaaaagaaatggtatccaggactgtgtattgtactaacattgacaagaagattggagaagatgaagtgaagcaattcttcgagggaacatgtggtgaagtttctcgtctgaggctacttggtgattatgtgcactccacatgcattgcctttgttgagtttgtccaagcagatagtgctattcttgctctgaactgcagtggcattgttcttggaacgcttcctgttagggtgagcccatcaaagacaccagtccgccctcgatcgccccgtgtgacgtcatactga

SEQ ID NO: 12164 - protein, 364 aa, Sorghum bicolor
  misc_feature: Ceres ANNOT ID no. 6065872
  misc_feature (181)..(249): Pfam Id: RRM_1 Pfam Desc: RNA recognition motif. (a.k.a. RRM, RBD, or RNP domain)
  misc_feature (278)..(347): Pfam Id: RRM_1 Pfam Desc: RNA recognition motif. (a.k.a. RRM, RBD, or RNP domain)
  misc_feature (57)..(74): Pfam Id: PAM2 Pfam Desc: Ataxin-2 C-terminal region
  misc_feature (130)..(363): NCBI GI: 56201749 NCBI Desc: rna-binding protein -like [oryza sativa (japonica cultivar-group)]
  misc_feature (145)..(363): NCBI GI: 79319864 NCBI Desc: cid8; rna binding [arabidopsis thaliana]
  misc_feature (124)..(348): NCBI GI: 79319100 NCBI Desc: cid11; rna binding [arabidopsis thaliana]
  misc_feature (108)..(360): NCBI GI: 110737686 NCBI Desc: rna-binding - like protein [arabidopsis thaliana]
  misc_feature (122)..(360): NCBI GI: 1174153 NCBI Desc: rna-binding protein
  misc_feature: The sequence is a functional homolog of SEQ ID NO 1301 in the 10/666,642US patent application
  misc_feature: Useful for making plants with modulated growth and phenotype characteristics
  misc_feature: The sequence is a functional homolog of SEQ ID NO 1301 in the 20070033671 US patent application
  misc_feature: The sequence is a functional homolog of SEQ ID NO 1301 in the 10/666,642 US patent application
  misc_feature: The sequence is a functional homolog of SEQ ID NO. 458 in the 11/188,298 US application
  misc_feature: The sequence is a functional homolog of SEQ ID NO. 339 in the 11/188,298 US application
MVAVAAEVAIRGADAVPAAEREAVRAAAAEAAAKGGEGESGKEEVRYYASDIRKLEELFSKLNPSAEEFVPPSRRRVDGGARRLSADAPVFVSPAIDYYARHHQLPPPPLQQQQPMHVLQFVGGVGGGGMGGGGGRDSSSDGSVNGQPNRRRRNGFIQGRRRMMGGRPRRSDREDSVRRTVYVSDIDQHVTEQKLAEVFSTCGQVVDCRICGDPNSVLRFAFIEFADDVGAQAALALGGTVLGFYPVKVLPSKTAILPVNPKFLPRTEDEKEMVSRTVYCTNIDKKIGEDEVKQFFEGTCGEVSRLRLLGDYVHSTCIAFVEFVQADSAILALNCSGIVLGTLPVRVSPSKTPVRPRSPRVTSY

SEQ ID NO: 12165 - DNA, 792 bp, Sorghum bicolor
  misc_feature: Ceres ANNOT ID no. 6065925
  misc_feature: Encodes the peptide sequence at SEQ ID NO 12166
atggacggcctctccaagaccatcggcggcggtggccctagcgttccggcgggatcccaccccgcgggcgggagccaggcggcggccggaggaggcgcgacgcagcggacgcagtacccgtatgtgactggtacttcagtcattgccttgaaatacaaggatggtgtgattatggcatgtgacactggagcctcctatggatcaactttgagatacaagagtgtggaacgcattaaggcagttggcaagcatagcatcattggagcaagtggagagtacagcgatttccaggagatcctgcgctatctggatgaactaactctgtctgatcatatgtgggatgatggaaactccctgggccccaaagagatccactcttatttgacaagagtgatgtacaacagacgcaacaagtttgatcctctctggaactcacttgtacttggtggagtgaaaaagggtccaaagggagatgagaagtatcttggcatggttaacatgattggcacccactttgaggaaaaccatgtggctactggatttggaaatcatctggcgatcccaatacttcgtgctgaatggcgcgaggatatgacttttgaagaagctgttaagctggttgagaagtgcttgctggtcttgctgtaccgtgacaggtcatctatcaacaaattccagattgccaagatcacaactgaaggatcaaccatctatccaccatactccttgaagacttactggggcttcactcactttgaaaacccagcccagggcgctgtgggatcatggtag

SEQ ID NO: 12166 - protein, 263 aa, Sorghum bicolor
  misc_feature: Ceres ANNOT ID no. 6065925
  misc_feature (41)..(230): Pfam Id: Proteasome Pfam Desc: Proteasome A-type and B-type
  misc_feature (18)..(263): NCBI GI: 115480143 NCBI Desc: os09g0515200 [oryza sativa (japonica cultivar-group)]
  misc_feature (34)..(263): NCBI GI: 3421123 NCBI Desc: 20s proteasome beta subunit pbg1 [arabidopsis thaliana]
  misc_feature (65)..(226): NCBI GI: 144924557 NCBI Desc: 20s proteasome, a and b subunits [medicago truncatula]
  misc_feature (122)..(263): NCBI GI: 52548242 NCBI Desc: 20s proteasome beta 7 subunit [triticum aestivum]
  misc_feature (10)..(251): NCBI GI: 33417170 NCBI Desc: psmb4-prov protein [xenopus laevis]
  misc_feature (34)..(263): SWISSPROT Homolog: EC 3.4.25.1 Proteasome subunit beta type 4 precursor
MDGLSKTIGGGGPSVPAGSHPAGGSQAAAGGGATQRTQYPYVTGTSVIALKYKDGVIMACDTGASYGSTLRYKSVERIKAVGKHSIIGASGEYSDFQEILRYLDELTLSDHMWDDGNSLGPKEIHSYLTRVMYNRRNKFDPLWNSLVLGGVKKGPKGDEKYLGMVNMIGTHFEENHVATGFGNHLAIPILRAEWREDMTFEEAVKLVEKCLLVLLYRDRSSINKFQIAKITTEGSTIYPPYSLKTYWGFTHFENPAQGAVGSW

SEQ ID NO: 12167 - DNA, 561 bp, Sorghum bicolor
  misc_feature: Ceres ANNOT ID no. 6066089
  misc_feature: Encodes the peptide sequence at SEQ ID NO 12168
atgtcttccgtcgccggtgacggttgtgtgtcgtctcaaaaggggaaggagagggaggaggaggacggcgccgacgggaggagccaacgtgtggagggggtggaggtgtctgagggaggagtggatttgggtgacctgtacggcgcggcggcagggtgggtagcggcgcggaccacctgcccgcacctcggcaccatgccgcccgctggtcccgacgacctcgctcgcgtgcctccgcccgattctccttgctccagatgtcatcaccctgctgaaaactggttatgcttgatatgcaaagatgtgctgtgcagtcgttttatcaacaaacatatgttgtgccatcatcaagaaactggtcactgtcttgctttgagcttcagtgatctgtcagtttggtgtttctcatgtgactcatacctagatgttcaagccattttagaattgcgcccagtctatgaagttgcacatttgttgaagtttggagaacgtccaccttttcgatcacttgaagtactggatttaaccactggtgaaagtgggagtgcatcaaggtcttag

SEQ ID NO: 12168 - protein, 186 aa, Sorghum bicolor
  misc_feature: Ceres ANNOT ID no. 6066089
  misc_feature (84)..(156): Pfam Id: zf-UBP Pfam Desc: Zn-finger in ubiquitin-hydrolases and other protein
  misc_feature (10)..(163): NCBI GI: 27882614 NCBI Desc: hdac6-prov protein [xenopus laevis]
  misc_feature (60)..(166): NCBI GI: 119571130 NCBI Desc: histone deacetylase 6, isoform cra_b [homo sapiens]
  misc_feature (60)..(166): NCBI GI: 46623327 NCBI Desc: hdac6 protein [homo sapiens]
  misc_feature (60)..(166): NCBI GI: 15489272 NCBI Desc: hdac6 protein [homo sapiens]
  misc_feature (60)..(166): NCBI GI: 7108921 NCBI Desc: gr af-1 specific histone deacetylase [homo sapiens]
MSSVAGDGCVSSQKGKEREEEDGADGRSQRVEGVEVSEGGVDLGDLYGAAAGWVAARTTCPHLGTMPPAGPDDLARVPPPDSPCSRCHHPAENWLCLICKDVLCSRFINKHMLCHHQETGHCLALSFSDLSVWCFSCDSYLDVQAILELRPVYEVAHLLKFGERPPFRSLEVLDLTTGESGSASRS

SEQ ID NO: 12169 - DNA, 1209 bp, Sorghum bicolor
  misc_feature: Ceres ANNOT ID no. 6066349
  misc_feature: Encodes the peptide sequence at SEQ ID NO 12170
atggcgggtggatccagctctaagaagagggtccggaggaagcggaagccgaaccccgcgacgcagctcaccgacgacctcctcgtcgagatcctctcgcgcgtgccgtacaggtccctctgccgcttccggtgcgtctccactcgctggcgcgcgattatctcccaccccgactaccgcaggagcctcccccagacccttgccggcatcttgtaccgaagaaggcccgccgtcggctcctcggagtcgacgccggttcgctgctgcttcaccgacgtgtccgggaccggccgcccgctcatcgacccttcattcccgttcctgcccgaccgcgagcgggagcacctcgacctggtcgacagctgcaacggcctcctgctctgccacagcttcagaaacgctgacgagggcttgttcgactacctcgtcttcaatcctgctaccgagaactgggccgccgtgccagtctcatggggctggtccaataaggtgcagacggttcgcctcgggtttgatccggcgttctcctcccacttctacatctttgagtttcagttggatgtggatgatgaagattatgatgctgggggtggccatgtcctaggggtgaagatatacacatctgaaaccggagtttggtgccacaagaagagtgcctggagctttgagtttataccacagtgtgaatttaagagtgtatttgtcaatggtgtgctgtatgtgatcgccattgagtgcgtaattggggcggtggatgtgaagggggaaacttggaggatcattgattttccacgctccgaggattcaccattccatgatactggtcctggattcattgatctgtcccaggggagattgcaccttgcaaatgatgatgatatggtcggggataagctcgcaatctgggtcctcgaggataaagacaccgatgaatggaccttaaagcacactgtctgctataagcatctggtcggaaggaagtatgtccactttggatttcatgagtttattgttgttgctatccacccagaccgcaacatggtattctttgtttttggtcgtcatgaaaaaacgctaatgtcttatgacatggatagcgggagggtgcatgtcatccgtaatcttggacacattgactctgactctgaatattttctaccatatgttcccttattttcaaagtcattgccagatgctgcgaaacagtaa

SEQ ID NO: 12170 - protein, 402 aa, Sorghum bicolor
  misc_feature: Ceres ANNOT ID no. 6066349
  misc_feature (18)..(65): Pfam Id: F-box Pfam Desc: F-box domain
  misc_feature (232)..(351): Pfam Id: FBA_3 Pfam Desc: F-box associated
  misc_feature (12)..(398): NCBI GI: 115462391 NCBI Desc: os05g0177100 [oryza sativa (japonica cultivar-group)]
  misc_feature (1)..(317): NCBI GI: 115462393 NCBI Desc: os05g0177400 [oryza sativa (japonica cultivar-group)]
  misc_feature (17)..(323): NCBI GI: 115462373 NCBI Desc: os05g0175800 [oryza sativa (japonica cultivar-group)]
  misc_feature (48)..(398): NCBI GI: 50508392 NCBI Desc: receptor-like kinase-like [oryza sativa (japonica cultivar-group)]
  misc_feature (18)..(183): NCBI GI: 117670145 NCBI Desc: f-box-like protein [hordeum vulgare]
  misc_feature: The sequence is a functional homolog of SEQ ID NO. 456 in the 11/188,298 US application
MAGGSSSKKRVRRKRKPNPATQLTDDLLVEILSRVPYRSLCRFRCVSTRWRAIISHPDYRRSLPQTLAGILYRRRPAVGSSESTPVRCCFTDVSGTGRPLIDPSFPFLPDREREHLDLVDSCNGLLLCHSFRNADEGLFDYLVFNPATENWAAVPVSWGWSNKVQTVRLGFDPAFSSHFYIFEFQLDVDDEDYDAGGGHVLGVKIYTSETGVWCHKKSAWSFEFIPQCEFKSVFVNGVLYVIAIECVIGAVDVKGETWRIIDFPRSEDSPFHDTGPGFIDLSQGRLHLANDDDMVGDKLAIWVLEDKDTDEWTLKHTVCYKHLVGRKYVHFGFHEFIVVAIHPDRNMVFFVFGRHEKTLMSYDMDSGRVHVIRNLGHIDSDSEYFLPYVPLFSKSLPDAAKQ

SEQ ID NO: 12171 - DNA, 756 bp, Sorghum bicolor
  misc_feature: Ceres ANNOT ID no. 6066368
  misc_feature: Encodes the peptide sequence at SEQ ID NO 12172
atggccaggccgctctcttccttctgcctccaccggatcaggtccggcggtactgcgtccactgccgcaccgctgtcgatatgcgccaacaagaagacctccttcgacgacgacggcggcggtggcatatgcaagtcgctgaaggatggcaagcaggaagacgaggaggctaacaagaagggtggcgtggaggccgtcgtcgtggggaggaaggtgatggtggcggcggacggcggcagcgaggaggcccggacggcgctgcagtgggcgctgtcgcacgccgtccggccctgcgacacggtggtcctgctcgacgtcgtcaggggcggcgccggcggcggcaacggcaagaaccgacgcgatccaagagggagtagtcagcacctggaggcaatgaggagcatctgccaggccaagagaccagaggtgcgcgtggaggtttccctggcggagggcggcggcggcggcggcaaggaccgcgggccggcgatagtggaggcggcgaggaagcagggcgtgtcgctcctcgtcgtggggcagaagaggcggtcctctgtcacatggcggctgctgtccatgtggatcgccggcgtcaagggcggcggtggcggtgccggaggcggctgcgccagcgccgccgactactgcgtgcagcacgcggcgtgcacggcgctggccgtccggcgcaagagccggcgaggcggcggatacctcatcaccaccaggcggcagagggatttctggctcctggcttga

SEQ ID NO: 12172 - protein, 251 aa, Sorghum bicolor
  misc_feature: Ceres ANNOT ID no. 6066368
  misc_feature (69)..(228): Pfam Id: Usp Pfam Desc: Universal stress protein family
  misc_feature (67)..(251): NCBI GI: 6730651 NCBI Desc: f4n2.5 [arabidopsis thaliana]
  misc_feature (67)..(251): NCBI GI: 42572035 NCBI Desc: universal stress protein (usp) family protein [arabidopsis thaliana]
  misc_feature (109)..(251): NCBI GI: 92870532 NCBI Desc: uspa [medicago truncatula]
  misc_feature (121)..(251): NCBI GI: 144924295 NCBI Desc: uspa [medicago truncatula]
MARPLSSFCLHRIRSGGTASTAAPLSICANKKTSFDDDGGGGICKSLKDGKQEDEEANKKGGVEAVVVGRKVMVAADGGSEEARTALQWALSHAVRPCDTVVLLDVVRGGAGGGNGKNRRDPRGSSQHLEAMRSICQAKRPEVRVEVSLAEGGGGGGKDRGPAIVEAARKQGVSLLVVGQKRRSSVTWRLLSMWIAGVKGGGGGAGGGCASAADYCVQHAACTALAVRRKSRRGGGYLITTRRQRDFWLLA

SEQ ID NO: 12173 - DNA, 1485 bp, Sorghum bicolor
  misc_feature: Ceres ANNOT ID no. 6066622
  misc_feature: Encodes the peptide sequence at SEQ ID NO 12174
atgaaggtcgacagggaaatggagattctgctcaacgagatccccctcctccaccacggtggcctcctcggcggcagcggcgaggctggtgcggacgacgacgccgacctctctttcctcatccacgaactcgccgcgatgggcgtcgtggacggcgacgacgagccaccggcgccgggcgctgccaacggcttcggcttctccagcatgatgatttaccccaagaaaggcggcgagaatctggtatccctgcacccgttctccatggccggccactgcgcgcacatgccgtctctgtttgatcccgtcaccttcgctgccgccgacggctgggacatccggtgctccccgccgccttctgtttctgtgtcgccaccgcccgccacgccgagggcccggtgcaagaacgtgaggaggaagaacggcggctgcggcgcggtgacggcgacgagccccaagaagtgcggagccgcggcggcggcggcggcggcggcggccaacaagtcgcacggcgagagcctggccggcctgcgcggggtcatgtcccacatcgcgcgcgaccagcacgggtgccggctgctgcagcagaggctcgacgacggcaagcgcgaggtcgaccacatcttcgccggcgtgtcgcgccacgccgcgcagctgatggtggacccgttcgggaactacctcatgcagaagctgctcgccgtctgcgacgccgggcagaggatggcgctcgtgctcaccctcaccgctgacgccttcgtcctcgtcaggatatccctcaacgtccatgggacacgggcagtgcagaagctgattgagagcctgaggacaagggaagagattagtcttgtcatcgatgctctgcgcccggggttcttggagctcatcaaggatcctaatggcaatcatgtcgtgcaaaagtgtttgcaggcgtttgaagccgacgataacaaggcgatatttgatgctgctgcactccactgtctcgatatcgggatgcaatgccacggttgctgtgtcctacagcggtgcattgcacgatcgcgtggtgagcacagggacaagctggttgctgccattgctggcaatggattcaaacttgcccaagatgcatatgggaactatgttgttcagtatgtaatagacttgaagataccaaatgcaaattcaagtcttgcacaacagtttgaaggcaagtatatccacctgtccatgcagaaattcagtagcaatgttgttgagaaatgcctgaaagtcttcaaggaggttgacaaggccaagatcatactagaaatcctcgccacgccacacttggagcaattgcttcagcacccttatgcaaactatgtcatctactctgctctccagaattccaagggttcacttcattctgcactgacaaatgcaatccgacctcatgtggaactgcttaggaccagtccatactgcaagaggatatactctcgagctttgctgaagaaatga

SEQ ID NO: 12174 - protein, 494 aa, Sorghum bicolor
  misc_feature: Ceres ANNOT ID no. 6066622
  misc_feature (211)..(245): Pfam Id: PUF Pfam Desc: Pumilio-family RNA binding repeat
  misc_feature (287)..(321): Pfam Id: PUF Pfam Desc: Pumilio-family RNA binding repeat
  misc_feature (173)..(494): NCBI GI: 22330712 NCBI Desc: pumilio/puf rna-binding domain-containing protein [arabidopsis thaliana]
  misc_feature (154)..(493): NCBI GI: 9454526 NCBI Desc: contains similarity to rna binding protein pufa from dictyostelium discoideum gi5106561 and contains multiple pumilio-family rna binding pf00806 domains. [arabidopsis
  misc_feature (154)..(493): NCBI GI: 9454526 (continued) thaliana]
  misc_feature (154)..(493): NCBI GI: 15219849 NCBI Desc: pumilio/puf rna-binding domain-containing protein [arabidopsis thaliana]
  misc_feature (173)..(494): NCBI GI: 22327888 NCBI Desc: pumilio/puf rna-binding domain-containing protein [arabidopsis thaliana]
  misc_feature (168)..(494): NCBI GI: 15220217 NCBI Desc: pumilio/puf rna-binding domain-containing protein [arabidopsis thaliana]
MKVDREMEILLNEIPLLHHGGLLGGSGEAGADDDADLSFLIHELAAMGVVDGDDEPPAPGAANGFGFSSMMIYPKKGGENLVSLHPFSMAGHCAHMPSLFDPVTFAAADGWDIRCSPPPSVSVSPPPATPRARCKNVRRKNGGCGAVTATSPKKCGAAAAAAAAAANKSHGESLAGLRGVMSHIARDQHGCRLLQQRLDDGKREVDHIFAGVSRHAAQLMVDPFGNYLMQKLLAVCDAGQRMALVLTLTADAFVLVRISLNVHGTRAVQKLIESLRTREEISLVIDALRPGFLELIKDPNGNHVVQKCLQAFEADDNKAIFDAAALHCLDIGMQCHGCCVLQRCIARSRGEHRDKLVAAIAGNGFKLAQDAYGNYVVQYVIDLKIPNANSSLAQQFEGKYIHLSMQKFSSNVVEKCLKVFKEVDKAKIILEILATPHLEQLLQHPYANYVIYSALQNSKGSLHSALTNAIRPHVELLRTSPYCKRIYSRALLKK

SEQ ID NO: 12175 - DNA, 720 bp, Sorghum bicolor
  misc_feature: Ceres ANNOT ID no. 6067072
  misc_feature: Encodes the peptide sequence at SEQ ID NO 12176
atgccctggaatagattcacgcccttcctttcaaaatgttgtacttctaccattcagacatccccatcatattcatctttttcctcgtccttgtccccgatacaaccatggttatttgtcggtcttggcaaccctggtgagaagtatcaatccaccaggcacaacgtgggttttgatatgatagatgcatttgcgcaatcccagggtatacccctgactacacattacttcaaagcactctttggtgaagggatggttgatggagtccctgttcttattgccaagccccagacttatatgaatctcagtggagaatctgttggtccacttgctgcctattataaactgccacttaatcgtgtcctagtggcgtttgatgatatggacttgccatgtggagttctccgcttacagccaaaaggaggctttggacggcacaatgggttgaagagtgttatataccactttcgtaagaatcgagaattttgccgattaaggattggaattggacggccacctggccagatggatcctaaagcctttgttcttcagaagttcaataggactggccgtgaacggattgattcagccataagagagggtgtcaatattctgaagatggtggccaccaggggtttgacagaggcggcaagattgtcaaatgcagatcagaagtataaacttctgagatcacatgatattcagactaacgatgactag

SEQ ID NO: 12176 - protein, 239 aa, Sorghum bicolor
  misc_feature: Ceres ANNOT ID no. 6067072
  misc_feature (38)..(221): Pfam Id: Pept_tRNA_hydro Pfam Desc: Peptidyl-tRNA hydrolase
  misc_feature (3)..(148): NCBI GI: 122247022 NCBI Desc: crs2-like protein, chloroplast precursor (chloroplastic rna splicing factor 2-like protein)
  misc_feature (15)..(229): NCBI GI: 56785144 NCBI Desc: peptidyl-trna hydrolase-like [oryza sativa (japonica cultivar-group)]
  misc_feature (15)..(229): NCBI GI: 75285812 NCBI Desc: peptidyl-trna hydrolase, mitochondrial precursor (m-pth)
  misc_feature (36)..(230): NCBI GI: 92879630 NCBI Desc: peptidyl-trna hydrolase [medicago truncatula]
  misc_feature (9)..(229): NCBI GI: 30685853 NCBI Desc: peptidyl-trna hydrolase family protein [arabidopsis thaliana]
  misc_feature (35)..(234): SWISSPROT Homolog: EC 3.1.1.29 Peptidyl-tRNA hydrolase, mitochondrial precursor
MPWNRFTPFLSKCCTSTIQTSPSYSSFSSSLSPIQPWLFVGLGNPGEKYQSTRHNVGFDMIDAFAQSQGIPLTTHYFKALFGEGMVDGVPVLIAKPQTYMNLSGESVGPLAAYYKLPLNRVLVAFDDMDLPCGVLRLQPKGGFGRHNGLKSVIYHFRKNREFCRLRIGIGRPPGQMDPKAFVLQKFNRTGRERIDSAIREGVNILKMVATRGLTEAARLSNADQKYKLLRSHDIQTNDD

SEQ ID NO: 12177 - DNA, 996 bp, Sorghum bicolor
  misc_feature: Ceres ANNOT ID no. 6067118
  misc_feature: Encodes the peptide sequence at SEQ ID NO 12178
atggctaccactcagttcgccatggttgaggagctggcctcgctcatcaaggacaacctgcacagcaagcaccttatcctctccactgaggagtccctcatagcagccctccagcagctccactgccgcgacggcgacggcgaccttgaagaggacggcgacgcggcggatacgatagagctccagcctgccggggcctaccaccgccttctcttgcatcgccttgctgaaatttatgggttcgctcatgaatcggttggtgaaggcgaggatcgacatttagtcctccagcgctgccctgaaacagccatcccatctgtccttgttagtgatatgttatggaagtttgattacagcgatgatctgacgtctgttgtgctaaccagaaatgatacagattttcaaaaacctcagaaggcagatgttgccaaagaagctgtttctgttaaaaactcgcatctgaaagataatacagacctgaaacctctgaagcagccagcagtacttccagcagcatcgttgaaggagagggaagctgcttatcgagctgctcgtgagcgaatcttctctggggatgatcccaagggaaatgataggtcacatatgaaatgtagacaggttcctgtcgttgctcaacggatgattgcccatgcactcggtcaaaaggttcaaaataccacagacacagttgcctccacagaaagcagaggaaaacagctgtcgaatgggaaaaatattccgacacatagcaggaacaacttctgcccagttacaccagataatagagaagcagttcgaaatgggaagccaaactcagctggtagtaactcgtatcaaactccatcaagccaaaggtgccgcacaactaatactagagctgttactgctgaaagcttgaagaaagagcagactggagcagctaaaagaatgtttgcacatgcactggggctgtctgcagctcgaggaagttgtggtgcactgcccaaaccgaagtaa

SEQ ID NO: 12178 - protein, 331 aa, Sorghum bicolor
  misc_feature: Ceres ANNOT ID no. 6067118
  misc_feature (34)..(99): Pfam Id: R3H Pfam Desc: R3H domain
MATTQFAMVEELASLIKDNLHSKHLILSTEESLIAALQQLHCRDGDGDLEEDGDAADTIELQPAGAYHRLLLHRLAEIYGFAHESVGEGEDRHLVLQRCPETAIPSVLVSDMLWKFDYSDDLTSVVLTRNDTDFQKPQKADVAKEAVSVKNSHLKDNTDLKPLKQPAVLPAASLKEREAAYRAARERIFSGDDPKGNDRSHMKCRQVPVVAQRMIAHALGQKVQNTTDTVASTESRGKQLSNGKNIPTHSRNNFCPVTPDNREAVRNGKPNSAGSNSYQTPSSQRCRTTNTRAVTAESLKKEQTGAAKRMFAHALGLSAARGSCGALPKPK

SEQ ID NO: 12179 - DNA, 1599 bp, Sorghum bicolor
  misc_feature: Ceres ANNOT ID no. 6067165
  misc_feature: Encodes the peptide sequence at SEQ ID NO 12180
atgttttcagttataaaacttcttactgaaaatatcttatgttgttttgattttctacgtgatattttatacttcaggaatacagttgatgctaatcctaagtggtgctgcacttatcttcttgatccttctgattcattgtttatagatgtggggcaggcttttatcaggcaacagataaaagagtacggcgatgtaaccaacatctataactgtgacacgttcaatgagaataccccaccaacagatgaaccagcatatatttcatcacttggttctgctatctatgaagcaatgtcccgaggtaacaagaatgcagtgtggttaatgcagggttggttattctactcagatgctgcattctggaaggagccacaaatgaaagcacttcttcactctgttccaattggtaagatgatagttctcgatttatttgctgatgtcaagcccatttggaaaatgtcctctcagttctacggtgtaccttacatctggtgcatgttacacaactttggtgggaacattgaaatgtatggcgtacttgattcaatttcatctggccccattgatgcccgtacaagttacaattcaacaatgattggtgttggcatgtgcatggagggaatagagcacaatccagttgtttatgaacttatgtctgaaatggcatttcataataagaaggttgaagttgaggactggttaaaaacatactcctataggagatatggtcgagcgaatgctgaaatagagaaagcttggagatatttgtatcatacaatatacaattgcaccgatggaattgcggatcataataaagactacatagttgaatttccagacataagtcccagctcaattagttctcagctttctaaacgaaggggtatgtcaattatgagaaaccataggaggtttttcttaagtgaggtgtctggaagcctaccacatccgcacctatggtattctacgaaggaggccatcaaagcccttgaactatttcttgatgcaggaagcacattttcaaaaagtctcacatataggtatgaccttgtcgacctaactaggcagtgcctatccaaactagcaaatgaagtgtaccttgatgcgatgagttcgtaccaaaagaaagattcaaatggcctgaattctcacacgaggaaatttcttgagatcatcatggatattgatacactactagctgctgatgataactttctgctgggcccctggctggaaagtgcaaaaagccttgctataactgaaaaggaacgccagcagtatgagtggaacgccagaacacaggtgacgatgtggtatgacaacacagagaccgagcagagtaaattgcatgactacgccaataagttttggagcgggctactgaagagctattaccttccaagggcgtcaaaatacttcgcctacttaacaaggagcctgcaagagaaccagagcttccagctggaggagtggaggaaggattggatctcatattccaacgagtggcagtccgggaaggaggtgtatgccgtgaaggccacgggtgatgctttggccatcgccaggtcactgtacagaaaatacttgagttcttga

SEQ ID NO: 12180 - protein, 532 aa, Sorghum bicolor
  misc_feature: Ceres ANNOT ID no. 6067165
  misc_feature (6)..(529): Pfam Id: NAGLU Pfam Desc: Alpha-N-acetylglucosaminidase (NAGLU)
  misc_feature (27)..(531): NCBI GI: 4160292 NCBI Desc: alpha-n-acetylglucosaminidase [nicotiana tabacum]
  misc_feature (28)..(530): NCBI GI: 38345908 NCBI Desc: osjnbb0059k02.16 [oryza sativa (japonica cultivar-group)]
  misc_feature (63)..(530): NCBI GI: 115460990 NCBI Desc: os04g0650900 [oryza sativa (japonica cultivar-group)]
  misc_feature (200)..(453): NCBI GI: 90399367 NCBI Desc: h0212b02.15 [oryza sativa (indica cultivar-group)]
  misc_feature (35)..(282): NCBI GI: 14861378 NCBI Desc: lysosomal alpha-n-acetyl glucosaminidase [dromaius novaehollandiae]
MFSVIKLLTENILCCFDFLRDILYFRNTVDANPKWCCTYLLDPSDSLFIDVGQAFIRQQIKEYGDVTNIYNCDTFNENTPPTDEPAYISSLGSAIYEAMSRGNKNAVWLMQGWLFYSDAAFWKEPQMKALLHSVPIGKMIVLDLFADVKPIWKMSSQFYGVPYIWCMLHNFGGNIEMYGVLDSISSGPIDARTSYNSTMIGVGMCMEGIEHNPVVYELMSEMAFHNKKVEVEDWLKTYSYRRYGRANAEIEKAWRYLYHTIYNCTDGIADHNKDYIVEFPDISPSSISSQLSKRRGMSIMRNHRRFFLSEVSGSLPHPHLWYSTKEAIKALELFLDAGSTFSKSLTYRYDLVDLTRQCLSKLANEVYLDAMSSYQKKDSNGLNSHTRKFLEIIMDIDTLLAADDNFLLGPWLESAKSLAITEKERQQYEWNARTQVTMWYDNTETEQSKLHDYANKFWSGLLKSYYLPRASKYFAYLTRSLQENQSFQLEEWRKDWISYSNEWQSGKEVYAVKATGDALAIARSLYRKYLSS

SEQ ID NO: 12181 - DNA, 1305 bp, Sorghum bicolor
  misc_feature: Ceres ANNOT ID no. 6067330
  misc_feature: Encodes the peptide sequence at SEQ ID NO 12182
atgaaccccagcaacgactgcgccaccccgagaagcgatggccgcggcagcagcagcggcagcggcagcgacgggaatgggggccgctcggcgaacacctcgtcgcggcgccgccgccgcatgccgtccacgcctacgggtactcaactcatgtcggagttcaacgctgctggtgatgccgggggctccgggtcttccttgtcgccaccgtcttccggggccctcgacctggagggcgtgctcctcctagccaccccggtggcaacggacagcaccatcatcatggagggtgagctcctcgacgacgacaacgaaccaggtaccccctccggcaccaggcgctccgcttctctcgtcgacaacaacggactgggcgcctccgcctccgccagcgccaggcgctccacctccgtcgacaacaacgggcccagcaacaaggtctccatcagcgacctcgacctcgttttggtctcctccggctctcagggctccagtggaggtgggagcggcggcaggcgcagcggcagcgcctccaatgatcaggtcggaccggagtgccaaatcccggtgcccccgccgaccccgccgctgtggggggtaccgacattcggtgccggactgagactgcaactgggaccagccgtccgaggacccgtgcagctctacgggtcaccttcgagctacccaccattcgaggtcaccaccatggtcctccccaggaggtcctcaggtctgtacccgccgcccggcgtcaccatccgccaccccccgaccagcaacggggactcgccgccgccgccgctggagcagcccgcacgcaccagggtcaccatcacggccccgccggccagcgagggacccaggcagccggaggcaatgccgctggagcagagcgtacagtccaagatcaccatcaaggccccggcggccggcgaagggagctcgtcgtcgccacccaagcagccggagcagctcgagacgcgtccgtcacagccggtgccgctgtcgcgtgtgccggcgttccggtggcccccgattgcagaggacgacgccctcttcacggagtggctgcacggccgcaggcgccgtaccaggaggctgcccgtgttcgaggacatctgccccgacgacggaactagccaaccccctcctcttccaagccaagcccctccaccacctccgcctcctccgacaagcccaccgcctccgcctccgccgcctccgacaagcccaccccctccgcctccgcctcctccgacaagcccaccccctcccactccgccgccgcctcctgggagcccgtga

SEQ ID NO: 12182 - protein, 434 aa, Sorghum bicolor
  misc_feature: Ceres ANNOT ID no. 6067330
  misc_feature (184)..(434): NCBI GI: 119627579 NCBI Desc: hcg1793893 [homo sapiens]
  misc_feature (183)..(434): NCBI GI: 6523547 NCBI Desc: hydroxyproline-rich glycoprotein dz-hrgp [volvox carteri f. nagariensis]
  misc_feature (168)..(432): NCBI GI: 66845451 NCBI Desc: actin associated protein [aspergillus fumigatus af293]
  misc_feature (189)..(434): NCBI GI: 12018147 NCBI Desc: vegetative cell wall protein gp1 [chlamydomonas reinhardtii]
  misc_feature (387)..(434): NCBI GI: 118763254 NCBI Desc: filamentous haemagglutinin family outer membrane protein [sphingomonas wittichii rw1]
MNPSNDCATPRSDGRGSSSGSGSDGNGGRSANTSSRRRRRMPSTPTGTQLMSEFNAAGDAGGSGSSLSPPSSGALDLEGVLLLATPVATDSTIIMEGELLDDDNEPGTPSGTRRSASLVDNNGLGASASASARRSTSVDNNGPSNKVSISDLDLVLVSSGSQGSSGGGSGGRRSGSASNDQVGPECQIPVPPPTPPLWGVPTFGAGLRLQLGPAVRGPVQLYGSPSSYPPFEVTTMVLPRRSSGLYPPPGVTIRHPPTSNGDSPPPPLEQPARTRVTITAPPASEGPRQPEAMPLEQSVQSKITIKAPAAGEGSSSSPPKQPEQLETRPSQPVPLSRVPAFRWPPIAEDDALFTEWLHGRRRRTRRLPVFEDICPDDGTSQPPPLPSQAPPPPPPPPTSPPPPPPPPPTSPPPPPPPPPTSPPPPTPPPPPGSP

SEQ ID NO: 12183 - DNA, 1509 bp, Sorghum bicolor
  misc_feature: Ceres ANNOT ID no. 6067347
  misc_feature: Encodes the peptide sequence at SEQ ID NO 12184
atggagactgccatctctgcagtgattggcgaggtcgtgagccagttcatctccttccttatgagcaaatactccaacaacgcagcctcagaggagcaaaagatggggagactgcagcatctgctcctgagggttcggacagtcgtcgaggaggcagacgggcggcacatcaccaactcagggatggtggaacagcttcaggtgctcgcagacgccatgtaccgaggctaccgcctgctcgacagcttcagctgtggaggaaggcctaataatcctttgatgatggaggaggttaaggttagcaacacatctgcctccttgtctttgcaaagccctcgtcccaaacgttgccgtacgattacccttggaaggaagggcaaggccgttattgaccttgatcagtcgtcgttggatgaaacactggacaggttagaaactgctgctgctcacatggcagaatttgttgtgcttttgggtggctgtgaacgcttgtcgcgtcgaccatacgacgcacatctctacatcgacaatttcatgtttgggcgtcatgctgaaaagcaaaggctcctcaacttcttgttggatcagaacaattcagccactggttcaccgccgccggttctttcggtgatcggcggtccttcggtaggaaaaagaactctggtcgctcatgtatgcagtgacaagagagttacttcgcacttctctttgattttacacttgaatgaaggtgatctttttagagtacaagaagaacatgaaagcaggcgagcggcggagggcaaggtcttgatagttgtggagtttgattcagtagtggacgaggaggactgggtaaaattttattcgtctgtgacaaatctgaagaaagggagcaaggtggtgatcatcagcaaccttagaaaatttgacacatttgcaactgttaagccaatttttctcagtaccctgccatatgcggagttcaggtacctcttcaagatactcgcattcggaagcacaaaccccatggaacatcctcagctgttaaagattgtcgacgaattatccaaggagttgcaactggggtggtcacttgtcacagcaaatgcacttggagaagccttgagaacgaatctcgatgtacgtttctggctttgcatgctaaacaggattaggagaacatctgagagaaacatgtccgtttttggcgcgtatcctagagcactcgctgaacggggtgatcatgtagacatgacagacctagagttaacccctggtgctccatttcacttcgtgtggagtagaaaagcccatgatatctcagtgaagaaggaactaccaaaggtgacagttcgagaacttatggtagatcctactgctaggccaaaaggggagttcattatgattatatggcaatcaaggataccccctcacacttgttttggtcactttgttccaaattgtgatcagggtatgcgtcagcatgttctcttgtcagggaggaaacgtcgaggactgcctttatag

SEQ ID NO: 12184 - protein, 502 aa, Sorghum bicolor
  misc_feature: Ceres ANNOT ID no. 6067347
  misc_feature (1)..(497): NCBI GI: 57899231 NCBI Desc: fusarium resistance protein i2c-5-like [oryza sativa (japonica cultivar-group)]
  misc_feature (1)..(472): NCBI GI: 115439635 NCBI Desc: os01g0721800 [oryza sativa (japonica cultivar-group)]
  misc_feature (1)..(498): NCBI GI: 18461229 NCBI Desc: p0690b02.14 [oryza sativa (japonica cultivar-group)]
  misc_feature (64)..(497): NCBI GI: 115435732 NCBI Desc: os01g0256300 [oryza sativa (japonica cultivar-group)]
  misc_feature (3)..(398): NCBI GI: 115470327 NCBI Desc: os07g0117800 [oryza sativa (japonica cultivar-group)]
METAISAVIGEVVSQFISFLMSKYSNNAASEEQKMGRLQHLLLRVRTVVEEADGRHITNSGMVEQLQVLADAMYRGYRLLDSFSCGGRPNNPLMMEEVKVSNTSASLSLQSPRPKRCRTITLGRKGKAVIDLDQSSLDETLDRLETAAAHMAEFVVLLGGCERLSRRPYDAHLYIDNFMFGRHAEKQRLLNFLLDQNNSATGSPPPVLSVIGGPSVGKRTLVAHVCSDKRVTSHFSLILHLNEGDLFRVQEEHESRRAAEGKVLIVVEFDSVVDEEDWVKFYSSVTNLKKGSKVVIISNLRKFDTFATVKPIFLSTLPYAEFRYLFKILAFGSTNPMEHPQLLKIVDELSKELQLGWSLVTANALGEALRTNLDVRFWLCMLNRIRRTSERNMSVFGAYPRALAERGDHVDMTDLELTPGAPFHFVWSRKAHDISVKKELPKVTVRELMVDPTARPKGEFIMIIWQSRIPPHTCFGHFVPNCDQGMRQHVLLSGRKRRGLPL

SEQ ID NO: 12185 - DNA, 1122 bp, Sorghum bicolor
  misc_feature: Ceres ANNOT ID no. 6067407
  misc_feature: Encodes the peptide sequence at SEQ ID NO 12186
atgggatcgccgcgttctgacgatggccgacgagaggcgaaggcgaccaggtggtgcgcggtgaccggcggccggggattcatggccaggcacctggtggccgcgttgctccgttccggttggcatgttcgggttaccgacctcgcaccctccttggtgctcggccccggcgagacggaggacctcctccgggatgccctcggcgacggccgagccgtctatgcctccgtggatgtctgcaacttcgagcagcttactacagcttttgaaggggtagatgttgttttccacacagctaccgcggatcctatcaagaacaacttgccacttcactacaaggtcaatgtcgagggaacaaagagtgtgattgatgcttgtaagatctgcaaggtgaaaaggcttatacacaccagttctagtggtgttgtgtttgacggtgttcatggactttttgatgtaaatgagtcattgccatacccagataagtttcctgatgcatatacacaaacaaaggcagaagcagagaagttagtcatcaaggccaatgacattaatgaccttctaacttgttgcttacgtcctggtagcatatttggcccaggtgacatggtgatgccaactttagatagttatggaaggacaaattttattattggcgatgggaagaattgtgatgattttgtgtacgttgaaaatgtggtatatggtcacatatgtgctgatacgactctttctactatagagggtgcaaaaaccagtggtggaaaagcctactttataactaatatggagccaatcaatttgtgggactttctacatatggttcaagaagaacttggacataaaagactgttcacgataaggatacctttgtctctcatgaagctagtaagctatttggttgagtgggcatacatgattctacatcgttatggaatatgccaaactcaaagggtaacaccagcaaggattaagtatatgacacttaacagaacatttagttgtaacagagctgttgaagaacttggctacaaacctactgtgacactcatggttaaacttaaatccttttggtgtctctacataattatttttttgttattacaaccctttatatgctga

SEQ ID NO: 12186 - protein, 373 aa, Sorghum bicolor
  misc_feature: Ceres ANNOT ID no. 6067407
  misc_feature (20)..(291): Pfam Id: 3Beta_HSD Pfam Desc: 3-beta hydroxysteroid dehydrogenase/isomerase family
  misc_feature (19)..(261): Pfam Id: Epimerase Pfam Desc: NAD dependent epimerase/dehydratase family
  misc_feature (21)..(243): Pfam Id: NAD_binding_4 Pfam Desc: Male sterility protein
  misc_feature (17)..(355): NCBI GI: 18401656 NCBI Desc: 3-beta hydroxysteroid dehydrogenase/isomerase family protein [arabidopsis thaliana]
  misc_feature (17)..(355): NCBI GI: 63034416 NCBI Desc: 4alpha-carboxysterol-c3-dehydrogenase/c4-decarboxylase isoform 1-1 [arabidopsis thaliana]
  misc_feature (17)..(350): NCBI GI: 3075392 NCBI Desc: 3-beta-hydroxysteroid dehydrogenase [arabidopsis thaliana]
  misc_feature (17)..(350): NCBI GI: 42569340 NCBI Desc: 3-beta hydroxysteroid dehydrogenase/isomerase family protein [arabidopsis thaliana]
  misc_feature (24)..(294): NCBI GI: 110346532 NCBI Desc: sterol decarboxylase [nicotiana benthamiana]
MGSPRSDDGRREAKATRWCAVTGGRGFMARHLVAALLRSGWHVRVTDLAPSLVLGPGETEDLLRDALGDGRAVYASVDVCNFEQLTTAFEGVDVVFHTATADPIKNNLPLHYKVNVEGTKSVIDACKICKVKRLIHTSSSGVVFDGVHGLFDVNESLPYPDKFPDAYTQTKAEAEKLVIKANDINDLLTCCLRPGSIFGPGDMVMPTLDSYGRTNFIIGDGKNCDDFVYVENVVYGHICADTTLSTIEGAKTSGGKAYFITNMEPINLWDFLHMVQEELGHKRLFTIRIPLSLMKLVSYLVEWAYMILHRYGICQTQRVTPARIKYMTLNRTFSCNRAVEELGYKPTVTLMVKLKSFWCLYIIIFLLLQPFIC

SEQ ID NO: 12187 - DNA, 945 bp, Sorghum bicolor
  misc_feature: Ceres ANNOT ID no. 6067412
  misc_feature: Encodes the peptide sequence at SEQ ID NO 12188
atgggggacaaggttaatccctggtgccattggcataatcctccatggaaattcaacactgaaggttctggcggcaatctccgcccacctgatgttgggcttgttaacaccaattcggtggcattgcctgcatatctgaacacagttgctgcacctgtgccatttttcacagcatcaattgctgagagacctctttcaatagctccaagatatgccacaacattggcaccaagtttggagttgcctgcactgtatccctcacgtaagagacctctagttttctaccagaaggaaaaccatgctcctagtgcagctcctttgctgagcaaagggccactggatcctgtgccagagctccaaggtagcaacgagactaatgtaactgatgttggagcagaagaaactgagggtattcatgagaactcagatgagatcaatgcactcctggactctgactcagatgaagggtatgaaaaactgcaagaactcgacagagtcagaaggcaatctgctgcagagaatgacaccctgagcgttgagtcagtgggcagtgctggtgctgccgcaggttctgcaccaccagccaagaagagaagactcagctcctgtactgacaagtctgttgttgacactgccagttcagcaaggcctgatcattccatcgagcagaagcttcttgtgaacgactgtgatgcgcagtcatgctgcgtcggtgaagtggaaagtgaccacaagttttctctgggggaggtagaagcagcagaaggtgacagccccgatgatcagaagcgaagaagagagaggatccaagagactgttgctgcgctcaggaatattgtccctgggggcattgccaaagacgccactgctgttcttgatgaagcaatctgttacttgcagtatctgaagctgaaggtcaagacgctgggagccgtctccctctag

SEQ ID NO: 12188 - protein, 314 aa, Sorghum bicolor
  misc_feature: Ceres ANNOT ID no. 6067412
  misc_feature (147)..(307): NCBI GI: 6693022 NCBI Desc: t22c5.19 [arabidopsis thaliana]
  misc_feature (263)..(309): NCBI GI: 47605761 NCBI Desc: indehiscent protein
  misc_feature (194)..(314): NCBI GI: 22327541 NCBI Desc: basic helix-loop-helix (bhlh) family protein [arabidopsis thaliana]
  misc_feature (250)..(311): NCBI GI: 108706746 NCBI Desc: helix-loop-helix dna-binding domain containing protein [oryza sativa (japonica cultivar-group)]
  misc_feature (263)..(312): NCBI GI: 92897159 NCBI Desc: helix-loop-helix dna-binding [medicago truncatula]
  misc_feature: The sequence is a functional homolog of SEQ ID NO. 414 in the 11/188,298 US application
MGDKVNPWCHWHNPPWKFNTEGSGGNLRPPDVGLVNTNSVALPAYLNTVAAPVPFFTASIAERPLSIAPRYATTLAPSLELPALYPSRKRPLVFYQKENHAPSAAPLLSKGPLDPVPELQGSNETNVTDVGAEETEGIHENSDEINALLDSDSDEGYEKLQELDRVRRQSAAENDTLSVESVGSAGAAAGSAPPAKKRRLSSCTDKSVVDTASSARPDHSIEQKLLVNDCDAQSCCVGEVESDHKFSLGEVEAAEGDSPDDQKRRRERIQETVAALRNIVPGGIAKDATAVLDEAICYLQYLKLKVKTLGAVSL

SEQ ID NO: 12189 - DNA, 1236 bp, Sorghum bicolor
  misc_feature: Ceres ANNOT ID no. 6067440
  misc_feature: Encodes the peptide sequence at SEQ ID NO 12190
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
atggcttccgacggcgtcgcccccagaggcagacgtcaagccgccgaggggtgcaaagatgtatgtattgttggggtcgcacgcacccctatgggtggtttccttggtgccttgtcttcctttcctgctacgaaacttggctctatagcaattcaagctgctctggaaagagcaaatgtggatccagccctcgtgcaggaggtctactttggaaatgtcttgagtgctaatttgggacaagctcctgcaaggcaagctgctctgggtgccgggataccaaactctgttgtctgcaccactgttaacaaagtctgtgcatctggcgtgaaagctactatgtttgcagcacagtcaattcaattgggtatcaataatattgttgtggctggtggcatggaaagtatgtccaatgccccaaagtacattgctgaagctaggaaggggtctcgttttggtcatgacacacttgttgacgccatgctaaaggatgggctttgggatgtatacaatgattgtgccatgggcatgtgcgccgagctttgtgctgacaatcatgccctcacaagagaagaccaggatgcatttgctatccaaagcaacgaacgtggaattgctgctcgcgacagtggtgcttttacatgggagatcgttccggttcaagttcctgttggtagaggaaaacccccaacactcattgagaaagatgaaagcctggataagtttgacccagtaaaactaaagaaacttcgcccaagtttcaaggagaatggtggtacagttacagctggaaatgcttctagtataagtgatggagctgctgcattagttctggtgagtgggcagaaggctcaagagcttggcctgcaagtccttgcaaggatcaaaggatatgctgatgcagctcaagctccggagctttttacaaccactccagcacttgcaataccaaaggctatagcaaatgctggattagagtcatcccatgttgatttctatgagattaatgaagccttttcggctgttgcacttgcaaatcaaaagcttctcgggattccttcagaaaagattaatgttcatggaggagctgtatctttaggacatcctctcgggtgcagtggtgctcgcattttggttacccttattggcgttctcagggcgaagagtggcaagatcggagttgctggtgtctgcaacggtggaggcggagcatcagctcttgttctcgagctcgcataa

SEQ ID NO: 12190 - protein, 411 aa, Sorghum bicolor
  misc_feature: Ceres ANNOT ID no. 6067440
  misc_feature (18)..(281): Pfam Id: Thiolase_N Pfam Desc: Thiolase, N-terminal domain
  misc_feature (288)..(410): Pfam Id: Thiolase_C Pfam Desc: Thiolase, C-terminal domain
  misc_feature (17)..(411): NCBI GI: 115478180 NCBI Desc: os09g0252100 [oryza sativa (japonica cultivar-group)]
  misc_feature (19)..(410): NCBI GI: 8777413 NCBI Desc: acetyl-coa c-acetyltransferase [arabidopsis thaliana]
  misc_feature (14)..(410): NCBI GI: 85700246 NCBI Desc: acetoacetyl-coa thiolase [picrorhiza kurrooa]
  misc_feature (14)..(410): NCBI GI: 53854350 NCBI Desc: cytosolic acetoacetyl-coenzyme a thiolase [nicotiana tabacum]
  misc_feature (19)..(410): NCBI GI: 53854352 NCBI Desc: peroxisomal acetoacetyl-coenzyme a thiolase [nicotiana tabacum]
  misc_feature (19)..(410): SWISSPROT Homolog: EC 2.3.1.9 Acetyl-CoA acetyltransferase, cytosolic 1
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
MASDGVAPRGRRQAAEGCKDVCIVGVARTPMGGFLGALSSFPATKLGSIAIQAALERANVDPALVQEVYFGNVLSANLGQAPARQAALGAGIPNSVVCTTVNKVCASGVKATMFAAQSIQLGINNIVVAGGMESMSNAPKYIAEARKGSRFGHDTLVDAMLKDGLWDVYNDCAMGMCAELCADNHALTREDQDAFAIQSNERGIAARDSGAFTWEIVPVQVPVGRGKPPTLIEKDESLDKFDPVKLKKLRPSFKENGGTVTAGNASSISDGAAALVLVSGQKAQELGLQVLARIKGYADAAQAPELFTTTPALAIPKAIANAGLESSHVDFYEINEAFSAVALANQKLLGIPSEKINVHGGAVSLGHPLGCSGARILVTLIGVLRAKSGKIGVAGVCNGGGGASALVLELA

SEQ ID NO: 12191 - DNA, 1971 bp, Sorghum bicolor
  misc_feature: Ceres ANNOT ID no. 6067457
  misc_feature: Encodes the peptide sequence at SEQ ID NO 12192
atgccggcgacggcggaggactccccggcgatacggaagctggggcagctcttccggctgaccgaagtatacctctgggacgattcgtatggcgctggacctcacgatggacggaagaactggcgctcggcggaggctgctctcgtggactctcatacagataaaacatgcaatgaagcatccaatggcactgacaaaggccatttgtttgttgaagatttggaattggccaacctcatgggttctttggggcttcctgtttcattcagcacaagtaaagtgaacaagaacacaggcaacaagggaaagaaaaaaggaagacaagcactgctcaaagcagcaaagactcaaatcaatgatgctgtgaggatatgtgccaatactgaagatagagaaagtgctgttgaatcattggatgttatggcgcacatgcactcatgcaatttatctgggactccgctgggtcacaatgaaccctgccatgatgacactgacaagatgcttagggaagacagtccttgtgttgaagaacaagaagagtctggctgtagcaccatctattcttctgacaaagcccctagctgtgatgctaaaaatctgctcactgaacttgggacttttgagctttctgataacttgggcaacccagcaaaagaagattattcaattcaagaaaatcaagcctctgacagcgtgttgctagattctgaagagatgccaaggcatgactgtgttgatggtgaatctacacattcatgtgtcgacatttatcaggaagaaagagtgtccacaagggaagatcaaacatctgaagaaactctgtcagtatcccatgatcataatgatgttggccaagaagctagtctaagtttggcagagccatcttctattgatgagcatgcacaaagttctgccaacaacttttactatgactatggtgaatggagggttgtctgggatccgttctatagtcggtattatttttacaacatccagacacaagagtccacatggtgtcctcctgaaggattggaggattttgcatcatattgtagcccagataccactaaagagctagttgaactgggatctcagtgtacaagcatagcaccgcaagagaacaatctggctactgatgacaatcatttagaagcacaggaacaagatcactgcattcatgatttatctgacattcctgtcgaaaaagcaatatatcaaagtatgataactacctctgacaaagcacagcacactgaaaataagtacagcgattcaacaactattgtgttagagatgaaccaggaagttactaccaccaaaaagaaaaagagagtaaggagatctcaatcgtatcattcatgccaagacatggcagggaacatctccaatgacatcatcaagtactggactcagcggtactcacttttctcactttttgatagaggtataaagatggatgaagaagggtggttttcagttacgccagagcctattgcaaagcatcatgcatctcgtgttggtgcgggagtaatcattgattgtttcacaggagttggtggaaatgccatccagtttgccacaaagtgcaagcatgtaattgcagttgatattgatccacaaaagattgattgtgcacatcataatgcatccatttatggagtaaatgatcacatagatttcattggagaaactgctttcatgtcgcctccttggggtggacctgactatgccaaagttgatgtttatgatatgaaaagcatgcttttgccttgtgatgggtactctcttttcaaacttggtactatgatagcttcaagagtagtgatgtttcttcctcgcaacattgatctaaaccaattggctgacatgtccttgtctgtggaccccccatggtcggttgaggtcgagaagaacttcctcaacggaaagctgaaagccataacagcatactttgaagaacaggattgttga

SEQ ID NO: 12192 - protein, 656 aa, Sorghum bicolor
  misc_feature: Ceres ANNOT ID no. 6067457
  misc_feature (248)..(655): NCBI GI: 42571775 NCBI Desc: ww domain-containing protein [arabidopsis thaliana]
  misc_feature (412)..(639): NCBI GI: 87240722 NCBI Desc: sam (and some other nucleotide) binding motif; ww/rsp5/wwp [medicago truncatula]
  misc_feature (366)..(651): NCBI GI: 143587061 NCBI Desc: trimethylguanosine synthase homolog (nuclear receptor coactivator 6-interacting protein) (prip-interacting protein with methyltransferase motif) (pipmt) (pimt)
  misc_feature (413)..(651): NCBI GI: 57530384 NCBI Desc: similar to prip-interacting protein pipmt [gallus gallus]
  misc_feature (366)..(651): NCBI GI: 50233914 NCBI Desc: nuclear receptor coactivator 6 interacting protein [mus musculus]
MPATAEDSPAIRKLGQLFRLTEVYLWDDSYGAGPHDGRKNWRSAEAALVDSHTDKTCNEASNGTDKGHLFVEDLELANLMGSLGLPVSFSTSKVNKNTGNKGKKKGRQALLKAAKTQINDAVRICANTEDRESAVESLDVMAHMHSCNLSGTPLGHNEPCHDDTDKMLREDSPCVEEQEESGCSTIYSSDKAPSCDAKNLLTELGTFELSDNLGNPAKEDYSIQENQASDSVLLDSEEMPRHDCVDGESTHSCVDIYQEERVSTREDQTSEETLSVSHDHNDVGQEASLSLAEPSSIDEHAQSSANNFYYDYGEWRVVWDPFYSRYYFYNIQTQESTWCPPEGLEDFASYCSPDTTKELVELGSQCTSIAPQENNLATDDNHLEAQEQDHCIHDLSDIPVEKAIYQSMITTSDKAQHTENKYSDSTTIVLEMNQEVTTTKKKKRVRRSQSYHSCQDMAGNISNDIIKYWTQRYSLFSLFDRGIKMDEEGWFSVTPEPIAKHHASRVGAGVIIDCFTGVGGNAIQFATKCKHVIAVDIDPQKIDCAHHNASIYGVNDHIDFIGETAFMSPPWGGPDYAKVDVYDMKSMLLPCDGYSLFKLGTMIASRVVMFLPRNIDLNQLADMSLSVDPPWSVEVEKNFLNGKLKAITAYFEEQDC

SEQ ID NO: 12193 - DNA, 1167 bp, Sorghum bicolor
  misc_feature: Ceres ANNOT ID no. 6067524
  misc_feature: Encodes the peptide sequence at SEQ ID NO 12194
atgggctcgcagaacgacgatggcaatggtggtcgccggcgggagacgaggtggtgcgcggtgaccggcggccgggggttcatggcgaggcacctggtggcggccctgctccgctccggcgagtggcgcgtccgggtcactgacctcacccctactattgtcctcggccctggggagacggaggagatcttcggtgatgctcttcgtgacggccgtgcaatctatgcctcggctgatgtctgcaacctagagcagcttatcgaagtttttgaaggggtagatgttgttttccacacagccgctgcggatcctagcaagaacaacttgcaacttcactacaaggttaatgtgattggaacaaagaatgtcattgatgcttgcaagatttgcaaggtgaagaggcttatacacaccagttctagtgctgttgtgttcgacggaattcatggtctatttaacgtaaatgaatcattgccatacccagataagtttcccgacgcatatgcacaaacaaaagcagaagcggagaagttagtcatggacgccaacgacactaatgaccttctgacttgttgcatacgtcctggtagcatatttggcccaggcgacctggtgatgccaactttggatcgctatggaaggacacatttcatcaccgttggtgatgggaagaattatgatgattttgtgtatgttgaaaatgttgtacatggtcatatatgtgcggataagactctttctactatggatggtgcaagaactagtggagggaaagcctactttataactaatatggagccaatgaatatgtgggacttcctatacactgttcaagaagagcttggatacaaaagactactcaatataaggatacctacacatgttattaagcctataagctatttggtagaaggagcatacaaggttttatatcattttggaatgccgacgcctcaattgctaacacgggctaggattaagtatatgacactcaatcgaacatttagttgtgacaaagctgtcaaagaacttggctacaaacctattgtgaaagtcatggatggcataaagatagcagtaaaagcgtatattcaattgagagatatagatttatctgagcagagtgaaggtatcaatcttaacatcagttgtcattgtactttatga

SEQ ID NO: 12194 - protein, 388 aa, Sorghum bicolor
  misc_feature: Ceres ANNOT ID no. 6067524
  misc_feature (20)..(293): Pfam Id: 3Beta_HSD Pfam Desc: 3-beta hydroxysteroid dehydrogenase/isomerase family
  misc_feature (19)..(263): Pfam Id: Epimerase Pfam Desc: NAD dependent epimerase/dehydratase family
  misc_feature (21)..(245): Pfam Id: NAD_binding_4 Pfam Desc: Male sterility protein
  misc_feature (15)..(367): NCBI GI: 18401656 NCBI Desc: 3-beta hydroxysteroid dehydrogenase/isomerase family protein [arabidopsis thaliana]
  misc_feature (15)..(367): NCBI GI: 63034416 NCBI Desc: 4alpha-carboxysterol-c3-dehydrogenase/c4-decarboxylase isoform 1-1 [arabidopsis thaliana]
  misc_feature (15)..(366): NCBI GI: 3075392 NCBI Desc: 3-beta-hydroxysteroid dehydrogenase [arabidopsis thaliana]
  misc_feature (15)..(366): NCBI GI: 42569340 NCBI Desc: 3-beta hydroxysteroid dehydrogenase/isomerase family protein [arabidopsis thaliana]
  misc_feature (24)..(299): NCBI GI: 110346532 NCBI Desc: sterol decarboxylase [nicotiana benthamiana]
MGSQNDDGNGGRRRETRWCAVTGGRGFMARHLVAALLRSGEWRVRVTDLTPTIVLGPGETEEIFGDALRDGRAIYASADVCNLEQLIEVFEGVDVVFHTAAADPSKNNLQLHYKVNVIGTKNVIDACKICKVKRLIHTSSSAVVFDGIHGLFNVNESLPYPDKFPDAYAQTKAEAEKLVMDANDTNDLLTCCIRPGSIFGPGDLVMPTLDRYGRTHFITVGDGKNYDDFVYVENVVHGHICADKTLSTMDGARTSGGKAYFITNMEPMNMWDFLYTVQEELGYKRLLNIRIPTHVIKPISYLVEGAYKVLYHFGMPTPQLLTRARIKYMTLNRTFSCDKAVKELGYKPIVKVMDGIKIAVKAYIQLRDIDLSEQSEGINLNISCHCTL

SEQ ID NO: 12195 - DNA, 1125 bp, Sorghum bicolor
  misc_feature: Ceres ANNOT ID no. 6067527
  misc_feature: Encodes the peptide sequence at SEQ ID NO 12196
atggggtcgtcggagcgtcacggtggcagcgagagcgaggcgaggtggtgtgcggtgaccggcggccggggattcatggcgaggcacctggtggccgccttgctccgctccggtgagtggcgcgtccgggtcactgacctcgcctctaccgttgtgctcggccctggcgagatggaagggctcttgggcgatgctctccgtgatggccgggccgtctatgcgtcagtggatgtctgcaacctagagcagcttacaaaagcctttgaaggggtagatgttgttttccacacagccgctgcggatcctagcaaaaatgacttgcaacttcaccacaaggttaacgtggagggaacgaagaatgtaattgatgcttgcaggatatgcaaggtcaaaaggcttatacacaccagttcttgttgtgttgtgtttgatggcattcatggactttttgatgtaaatgagtcattgccatacccagataagttttctgatgcatatgcacaaacaaaggcagaagcagagaagttagtcatcaaggccaattgcactaatggccttctaacgtgttgcttacgtcctggtgccatatttggcctaggtgacatagtgataccaaatctggatcgttatgcatggatgcgtcgtgttacatttggtgatgggaagaattgtgaggattttgtgtatgttgaaaatgttgtacatggtcatctttgtgctaataagactcttgctactattgaaggtgcaagaactagtggaggaaaagcatactttataactaatatggagccaatgaatatgtgggacttcctagacactgttcaagaagagcttggatacaaaagaatgtccaagataaggatacctacaattattatcaagccagcaagctatttaatagactgggcatatagggttgttttctctcattttggaatttcccagcctcaggtgctaacaccgacaaggattagatacataacactcaatagaacatatagttgtaacaaagctgttgaagaacttggctacaaacctattgtgacactgcaggatggtttaaagaaagcagtaaaattgtatattcaattgaggaataaagatttttctaagaaagagtaa

SEQ ID NO: 12196 - protein, 374 aa, Sorghum bicolor
  misc_feature: Ceres ANNOT ID no. 6067527
  misc_feature (18)..(291): Pfam Id: 3Beta_HSD Pfam Desc: 3-beta hydroxysteroid dehydrogenase/isomerase family
  misc_feature (17)..(261): Pfam Id: Epimerase Pfam Desc: NAD dependent epimerase/dehydratase family
  misc_feature (19)..(237): Pfam Id: NAD_binding_4 Pfam Desc: Male sterility protein
  misc_feature (10)..(374): NCBI GI: 18401656 NCBI Desc: 3-beta hydroxysteroid dehydrogenase/isomerase family protein [arabidopsis thaliana]
  misc_feature (10)..(374): NCBI GI: 63034416 NCBI Desc: 4alpha-carboxysterol-c3-dehydrogenase/c4-decarboxylase isoform 1-1 [arabidopsis thaliana]
  misc_feature (10)..(374): NCBI GI: 3075392 NCBI Desc: 3-beta-hydroxysteroid dehydrogenase [arabidopsis thaliana]
  misc_feature (10)..(374): NCBI GI: 42569340 NCBI Desc: 3-beta hydroxysteroid dehydrogenase/isomerase family protein [arabidopsis thaliana]
  misc_feature (22)..(296): NCBI GI: 110346532 NCBI Desc: sterol decarboxylase [nicotiana benthamiana]
MGSSERHGGSESEARWCAVTGGRGFMARHLVAALLRSGEWRVRVTDLASTVVLGPGEMEGLLGDALRDGRAVYASVDVCNLEQLTKAFEGVDVVFHTAAADPSKNDLQLHHKVNVEGTKNVIDACRICKVKRLIHTSSCCVVFDGIHGLFDVNESLPYPDKFSDAYAQTKAEAEKLVIKANCTNGLLTCCLRPGAIFGLGDIVIPNLDRYAWMRRVTFGDGKNCEDFVYVENVVHGHLCANKTLATIEGARTSGGKAYFITNMEPMNMWDFLDTVQEELGYKRMSKIRIPTIIIKPASYLIDWAYRVVFSHFGISQPQVLTPTRIRYITLNRTYSCNKAVEELGYKPIVTLQDGLKKAVKLYIQLRNKDFSKKE

SEQ ID NO: 12197 - DNA, 1122 bp, Sorghum bicolor
  misc_feature: Ceres ANNOT ID no. 6067531
  misc_feature: Encodes the peptide sequence at SEQ ID NO 12198
atggggtcgtcggagcgtcacgatggcagcgagagcgaggcgaggtggtgtgcggtgacgggcggccggggattcatggcgaggcacctggtggccgccttgctccgctccggtgagtggcgcgtccgggtcactgacctcgcctctaccgttgtgctcggccctggcgagatggaagggctcttgggcgatgctctccgtgatggccgggccgtctatgcgtcagtggatgtctgcaacctagagcagcttacaaaagcctttgaaggggtagatgttgttttccacacagccgctgcggatcctagcaaaaatgacttgcaacttcaccacaaggttaacgtggagggaacgaagaatgtaattgatgcttgcaagatatgcaaggtgaaaagacttatacacaccagttctagtggtgttgtgtttgacggcattcatggactttttgatgtaaatgagtcattgccatacccagataagtttcctgatgcatatgcacaaacaaaggcaggggcagagaagttagtcatcaaggccaattgcattaatgatcttctaacgtgttgcttacgtcctggttcaatatttggcccaggtgacaaaataataccatttttggatcgtcatggatggacacatgttactattggtgatgggaaaaattgtgatgattttgtgtatgttgaaaatgttgtacatggtcatctttgtgctgataagactcttgctactattgagggtgcaagaaccagtggaggaaaagcatattttataactaatatggagccaatgaatatgtgggacttcacatatcttgttcaacaagaacttggatacaaaagaatgcccaagataaggatacctacagtttttatcaagccagcaagctatgtaatagagtgggcatataggtttgttttctctaattttggaattcaccagcctcaaatactaacaccagcaaggattagatacacaacactcaatagaacatttatttgtaacaaagctgttgaagaacttggctacaaacctattgtgacactacaggatggtttaaagaaagcagtgaaattgtatattcagatgaggaataaagatttttctaagagagagtaa

SEQ ID NO: 12198 - protein, 373 aa, Sorghum bicolor
  misc_feature: Ceres ANNOT ID no. 6067531
  misc_feature (18)..(290): Pfam Id: 3Beta_HSD Pfam Desc: 3-beta hydroxysteroid dehydrogenase/isomerase family
  misc_feature (17)..(260): Pfam Id: Epimerase Pfam Desc: NAD dependent epimerase/dehydratase family
  misc_feature (19)..(303): Pfam Id: NAD_binding_4 Pfam Desc: Male sterility protein
  misc_feature (10)..(373): NCBI GI: 18401656 NCBI Desc: 3-beta hydroxysteroid dehydrogenase/isomerase family protein [arabidopsis thaliana]
  misc_feature (10)..(373): NCBI GI: 63034416 NCBI Desc: 4alpha-carboxysterol-c3-dehydrogenase/c4-decarboxylase isoform 1-1 [arabidopsis thaliana]
  misc_feature (10)..(373): NCBI GI: 3075392 NCBI Desc: 3-beta-hydroxysteroid dehydrogenase [arabidopsis thaliana]
  misc_feature (10)..(373): NCBI GI: 42569340 NCBI Desc: 3-beta hydroxysteroid dehydrogenase/isomerase family protein [arabidopsis thaliana]
  misc_feature (22)..(295): NCBI GI: 110346532 NCBI Desc: sterol decarboxylase [nicotiana benthamiana]
MGSSERHDGSESEARWCAVTGGRGFMARHLVAALLRSGEWRVRVTDLASTVVLGPGEMEGLLGDALRDGRAVYASVDVCNLEQLTKAFEGVDVVFHTAAADPSKNDLQLHHKVNVEGTKNVIDACKICKVKRLIHTSSSGVVFDGIHGLFDVNESLPYPDKFPDAYAQTKAGAEKLVIKANCINDLLTCCLRPGSIFGPGDKIIPFLDRHGWTHVTIGDGKNCDDFVYVENVVHGHLCADKTLATIEGARTSGGKAYFITNMEPMNMWDFTYLVQQELGYKRMPKIRIPTVFIKPASYVIEWAYRFVFSNFGIHQPQILTPARIRYTTLNRTFICNKAVEELGYKPIVTLQDGLKKAVKLYIQMRNKDFSKRE

SEQ ID NO: 12199 - DNA, 384 bp, Sorghum bicolor
  misc_feature: Ceres ANNOT ID no. 6067567
  misc_feature: Encodes the peptide sequence at SEQ ID NO 12200
atggagggcggcgaggcgacgctgtcggggttcgtcggcggcgggggcggtgcggggggaagccccggcgtggacaccaaggtgctgcacgcgttccagacgagcttcgtgcaggtgcagacgctgctggaccagaaccggctgctcatcaacgagatcaaccagaaccacgagtccaaggtgcccggcgacctctcccgcaacgtgggcctcatcagggagctcaacaacaacatccgccgcgtcgtcgacctctacgccgacctctcctcgctcttcgccgcctccgacgccggccgcgccgcgtccgagggcggctccgtcggcaccgtccgccaggcgcccggcgccgggcacaagcggatcaggtccggcctcgactga

SEQ ID NO: 12200 - protein, 127 aa, Sorghum bicolor
  misc_feature: Ceres ANNOT ID no. 6067567
  misc_feature (23)..(107): NCBI GI: 34499881 NCBI Desc: early flowering 4 [mesembryanthemum crystallinum]
  misc_feature (40)..(89): NCBI GI: 61611698 NCBI Desc: early flowering 4 [pisum sativum]
  misc_feature: Useful for making plants with altered Lignin content
  misc_feature: Functional homolog of the protein sequence given in SEQ ID NO 13163
  misc_feature: Useful for making plants with altered lignin content
  misc_feature: Functional homolog of the protein sequence given in SEQ ID NO 13163
MEGGEATLSGFVGGGGGAGGSPGVDTKVLHAFQTSFVQVQTLLDQNRLLINEINQNHESKVPGDLSRNVGLIRELNNNIRRVVDLYADLSSLFAASDAGRAASEGGSVGTVRQAPGAGHKRIRSGLD

SEQ ID NO: 12201 - DNA, 1470 bp, Sorghum bicolor
  misc_feature: Ceres ANNOT ID no. 6067659
  misc_feature: Encodes the peptide sequence at SEQ ID NO 12202
atgttgttcacgcatgaggcaaatgctgaccagtttgatcttctttcttatggtaatctaaggggagtagaggctagtagaaattctgaggaatccaattttggaaatgacttaaaggatggttcttcagttttttctgagaacttcagctcctcttgtctgccttgtgagaactatcaatctgccacaatagatcatgaaaaacgacctttttctgatgtcaagccatgccaagttgcttgcaaacgtccaaagcaaacagatcacaatacctggttatattcctttgaggaagaccctttgaccagtgaagtggggatatcttctccagctttagctgatggattggttgagaccaaacaaccaaatgacattcatgcaattaatggtgccacaacctgcagtggtagttcagacatcccttgccttaatcatgatcaatcagttttagtggaaagcctagatgtacctgattgggcgacttgtttccctggttattttgaagactgtgggccagttgctacatataaccatgttgatgacattggttcacctgttcatgagtacctccctagaaagggtgtgccaattggacctgagcaccaggctgacattccagaatggaggccccggatctctatgattgtacctggcacttctgagttttgtgctgatctggattgtagttctgcttccacttcagagtctgttaccagaggtgatgactatgtaagtgaaagtgacaagtggatcaggtgctgtgttgttccgatgatgagctgctcatctcttgttgactgggctggagacaacaaaatagattgtaactgcagtgacgagggttctacgaggtgttccagacagcatattattgaagcaagggatagcctcaaaatgagcttgggacaggacacgtttcgtgagttaggtctttgtgaaatgggagaggatgttgctcagagatggactgatgatgaggagaagctattccaaagagttgttttcttaaatcctgtctccttgggcaagaacttttgggatcaccttccagatgcatttcctggtaaaactagccaggagcttgttagctactattttaatgttttcatgctcaggaaaagggcccagcagaacaggtcagacgtgttgcgtgtggacagtgatgatgatgaactgcatggtgaacctctagttgagcgggaggaaggggatcctgcagttgagtcctctatacatgaacattttgtcagcaattctctgcccatggatgatgaccataaagagtttgaaggagcacagtttgatggatctttgtgtgagaagtcagtatacaatgcaggtgactgcagacatctaccaaatcagatgcctgcggattcaaatacggtgagcactgcacaagatgtttatggccaagataatggagctcagtgtgaagagtttcacatgtcactgccgaatgatacttaa

SEQ ID NO: 12202 - protein, 489 aa, Sorghum bicolor
  misc_feature: Ceres ANNOT ID no. 6067659
  misc_feature (319)..(369): Pfam Id: Myb_DNA-binding Pfam Desc: Myb-like DNA-binding domain
  misc_feature (1)..(487): NCBI GI: 115453611 NCBI Desc: os03g0425800 [oryza sativa (japonica cultivar-group)]
  misc_feature (249)..(430): NCBI GI: 42570671 NCBI Desc: myb family transcription factor / elm2 domain-containing protein [arabidopsis thaliana]
  misc_feature (28)..(166): NCBI GI: 46367652 NCBI Desc: myby2 protein [oryza sativa (japonica cultivar-group)]
  misc_feature (240)..(397): NCBI GI: 87162913 NCBI Desc: elm2; at-rich interaction region; homeodomain-related [medicago truncatula]
  misc_feature (266)..(403): NCBI GI: 115482246 NCBI Desc: os10g0446400 [oryza sativa (japonica cultivar-group)]
MLFTHEANADQFDLLSYGNLRGVEASRNSEESNFGNDLKDGSSVFSENFSSSCLPCENYQSATIDHEKRPFSDVKPCQVACKRPKQTDHNTWLYSFEEDPLTSEVGISSPALADGLVETKQPNDIHAINGATTCSGSSDIPCLNHDQSVLVESLDVPDWATCFPGYFEDCGPVATYNHVDDIGSPVHEYLPRKGVPIGPEHQADIPEWRPRISMIVPGTSEFCADLDCSSASTSESVTRGDDYVSESDKWIRCCVVPMMSCSSLVDWAGDNKIDCNCSDEGSTRCSRQHIIEARDSLKMSLGQDTFRELGLCEMGEDVAQRWTDDEEKLFQRVVFLNPVSLGKNFWDHLPDAFPGKTSQELVSYYFNVFMLRKRAQQNRSDVLRVDSDDDELHGEPLVEREEGDPAVESSIHEHFVSNSLPMDDDHKEFEGAQFDGSLCEKSVYNAGDCRHLPNQMPADSNTVSTAQDVYGQDNGAQCEEFHMSLPNDT

SEQ ID NO: 12203 - DNA, 1497 bp, Sorghum bicolor
  misc_feature: Ceres ANNOT ID no. 6067687
  misc_feature: Encodes the peptide sequence at SEQ ID NO 12204
atggcggcccgcgaggcctccgccgcggcgccggccccgggccccgcaggcgacgggccgagccgcccgccgcggcccacgctcgccctgccgccgcgctccgccgtcgagtccctcttcgcctcctccggcgcctcctctgccggcgccgccgccgagaccagccccggcccgctcaccctcgccgccgcgctcttccccgatggcgcgccctccccggctttccacggctccttcacccagctcctcgtcggcgccataggctccccggccgccgtaccctcgccgccctctccgttcgccgtcccgccggggctcagcccggccacgctccttggctcccccggcctcttctctcccacggggagttttgagatgtctcatcaacaagccttagcacaagtaacagcacaagcagtccattctcagtacaatatgataaatcacgcagattacgctatccctttttcgtctacaacaacaccagctttgatcacagcacagcatgccaattcttctgccaatgtgacatcagcacaggagaaaccagctctgccgtcacatacaggtaatagcaaaattgaatcaaatgaggtttcacaaggactcaaaccttctgcacccacttttgataaacctgctgacgatgggtacaactggcggaagtatggccagaaggcagttaagggtggcgagtatccgaggagttactacaaatgtacccacgcgagttgtccagttaagaaaaaagtggagcgctcagcagaaggatacatcactcaaataatttatagaggtcagcacaaccaccagcgacctccaaaaaggagatccaaagatggtggtggtttactaaatgaagcagatgatttccatgagaatgaagacacttcaactagatcagaacctggttctcaagatcactctggaaaacatgaggggtcaaatgatggcatagcagggccttcagtgtcaagaaggggagagggacatgagcaattgtcaggctcaagtgatagtgatgaggagcgagatgatgaacaaagggctggcaatggagatcctggctatgcaaatgcaaacagaagacatgtgccaactccagctcaaaggataattgtgcaaacaaacagcgaggttgatcttctggatgatggctatcgatggcgcaagtatggacagaaagtggtaaaagggaatccccatccgaggagttactacaaatgcacctatcaagggtgtgatgtgaagaagcatattgaaagatcatcccaagacccaaaggccgtcataacaacatacgaagggaagcacagccatgatgttccagcagccaggaacagtagccatgctgctgccaatgcaaattgttcatcttccaccagtgtaccacacagggtccagagttcagcgtccagtagtcgcagagtggcagacttacaaagcacatcctcagcttcttctatgctactaaaagaggaaaacgaaataacataa

SEQ ID NO: 12204 - protein, 498 aa, Sorghum bicolor
  misc_feature: Ceres ANNOT ID no. 6067687
  misc_feature (214)..(272): Pfam Id: WRKY Pfam Desc: WRKY DNA -binding domain
  misc_feature (383)..(442): Pfam Id: WRKY Pfam Desc: WRKY DNA -binding domain
  misc_feature (87)..(470): NCBI GI: 6689916 NCBI Desc: zinc finger transcription factor wrky1 [oryza sativa]
  misc_feature (118)..(405): NCBI GI: 115453731 NCBI Desc: os03g0444900 [oryza sativa (japonica cultivar-group)]
  misc_feature (90)..(498): NCBI GI: 48686707 NCBI Desc: dna binding protein wrky2 [vitis vinifera]
  misc_feature (118)..(405): NCBI GI: 31790178 NCBI Desc: wrky transcription factor [oryza sativa]
  misc_feature (90)..(498): NCBI GI: 4322940 NCBI Desc: dna-binding protein 2 [nicotiana tabacum]
  misc_feature: The sequence is a functional homolog of SEQ ID NO 140 in the 10/225,068US patent application
  misc_feature: The sequence is a functional homolog of SEQ ID NO 204 in the 10/714,887US patent application
  misc_feature: The sequence is a functional homolog of SEQ ID NO 204 in the 11/435,388US patent application
  misc_feature: The sequence is a functional homolog of SEQ ID NO 2444 in the 10/374,780US patent application
  misc_feature: The sequence is a functional homolog of SEQ ID NO 592 in the 10/412,699US patent application
  misc_feature: The sequence is a functional homolog of SEQ ID NO 734 in the 10/225,066US patent application
  misc_feature: Useful for making plants with modulated growth and phenotype characteristics
  misc_feature: The sequence is a functional homolog of SEQ ID NO 592 in the 20040045049 US patent application
  misc_feature: The sequence is a functional homolog of SEQ ID NO 204 in the 20060015972 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MAAREASAAAPAPGPAGDGPSRPPRPTLALPPRSAVESLFASSGASSAGAAAETSPGPLTLAAALFPDGAPSPAFHGSFTQLLVGAIGSPAAVPSPPSPFAVPPGLSPATLLGSPGLFSPTGSFEMSHQQALAQVTAQAVHSQYNMINHADYAIPFSSTTTPALITAQHANSSANVTSAQEKPALPSHTGNSKIESNEVSQGLKPSAPTFDKPADDGYNWRKYGQKAVKGGEYPRSYYKCTHASCPVKKKVERSAEGYITQIIYRGQHNHQRPPKRRSKDGGGLLNEADDFHENEDTSTRSEPGSQDHSGKHEGSNDGIAGPSVSRRGEGHEQLSGSSDSDEERDDEQRAGNGDPGYANANRRHVPTPAQRIIVQTNSEVDLLDDGYRWRKYGQKVVKGNPHPRSYYKCTYQGCDVKKHIERSSQDPKAVITTYEGKHSHDVPAARNSSHAAANANCSSSTSVPHRVQSSASSSRRVADLQSTSSASSMLLKEENEIT

SEQ ID NO: 12205 - DNA, 1167 bp, Sorghum bicolor
  misc_feature: Ceres ANNOT ID no. 6067811
  misc_feature: Encodes the peptide sequence at SEQ ID NO 12206
atggatccttccaagaagagtgcctgcgccgccgccgacctcacggatgatatcatcgtcgagatcctgtcgcggctgccggtcaaatcgatctgccgtttcaagtgcgtttcctggcattggtacggcctaatcacccactccgagcaccgcaagaagatcccccagacgctatccggcttcttctacggcttcgtccaccacagaggcaggttcaaccgcgaggagaacgacataataatattttcagatttcatggacatcacagtacgcgaagagctgctgtttttggacccctcgttgcccttcctgaccggctacaggcagattattccaaagacctgctgcaacggcctcctgttctgcctctgtaggaaggtcttcccccgtgatgaagctaattatgttgtgtgcaatcctgcaacagagaaatggtttgtcctgccggagtctgactatgatagtggtgcttgcgcataccgattccgctttgacccggctatctcatcccacttccatgtgttccagattctagaagaagaccagggttatggatttattgctgttgctggtgtgaatatctactcgtcagagacaggtgcctggagccgcaaggcaaatggttggggcaataaccttcagttagttgattccatagagttttttttcaaaggaatgttgcatctgatgaccaattgtttcaagctacttgcagtggacacacaaggtaagatatgtaggaccattcctttgctggaaactatgtgtgctgaaaacttctgtacagacattttttccagtaatcttactcttattggtcaatcacgggggcaattgtattacttcaatacgagggaaagggatctctctgtattgtcagtctggattcttgaggactatgacagtgatgaatggatatttaagtacaacattagtacttcacagctttttggagagaagggtcttgggtttgctttgatcgctatccatccagaatgcagcttgatttactttgtttggaagtgtgagggaatactgatgtcatatgacatggaacgtgggaaagtttgtgttgtatgcaatgccatggagcatttgtatgacccagttctttattatcttccatacgttccatttctctcgggctcagcaaggctagaagcataa

SEQ ID NO: 12206 - protein, 388 aa, Sorghum bicolor
  misc_feature: Ceres ANNOT ID no. 6067811
  misc_feature (9)..(56): Pfam Id: F-box Pfam Desc: F-box domain
  misc_feature (11)..(378): NCBI GI: 115462391 NCBI Desc: os05g0177100 [oryza sativa (japonica cultivar-group)]
  misc_feature (40)..(383): NCBI GI: 50508392 NCBI Desc: receptor-like kinase-like [oryza sativa (japonica cultivar-group)]
  misc_feature (11)..(309): NCBI GI: 115462393 NCBI Desc: os05g0177400 [oryza sativa (japonica cultivar-group)]
  misc_feature (10)..(309): NCBI GI: 115462373 NCBI Desc: os05g0175800 [oryza sativa (japonica cultivar-group)]
  misc_feature (14)..(178): NCBI GI: 117670145 NCBI Desc: f-box-like protein [hordeum vulgare]
  misc_feature: The sequence is a functional homolog of SEQ ID NO. 456 in the 11/188,298 US application
MDPSKKSACAAADLTDDIIVEILSRLPVKSICRFKCVSWHWYGLITHSEHRKKIPQTLSGFFYGFVHHRGRFNREENDIIIFSDFMDITVREELLFLDPSLPFLTGYRQIIPKTCCNGLLFCLCRKVFPRDEANYVVCNPATEKWFVLPESDYDSGACAYRFRFDPAISSHFHVFQILEEDQGYGFIAVAGVNIYSSETGAWSRKANGWGNNLQLVDSIEFFFKGMLHLMTNCFKLLAVDTQGKICRTIPLLETMCAENFCTDIFSSNLTLIGQSRGQLYYFNTRERDLSVLSVWILEDYDSDEWIFKYNISTSQLFGEKGLGFALIAIHPECSLIYFVWKCEGILMSYDMERGKVCVVCNAMEHLYDPVLYYLPYVPFLSGSARLEA

SEQ ID NO: 12207 - DNA, 1230 bp, Sorghum bicolor
  misc_feature: Ceres ANNOT ID no. 6067814
  misc_feature: Encodes the peptide sequence at SEQ ID NO 12208
atggaggcggcggcccgcgacaccgagaagaagcggagtctcgccgtcactagctccacagcaggcggcggcgttggcctcaccgacgacctcgtcgtcgagatcctctcacgcgtccccgtgaagtcgatctgccgcttcaagtgcgtctccccgtcgtggcgcagcctcatctcccaccccgacaaccgcaagaagctgccccacaccgtcacgggcttcctctaccttgtcgagttcgatacatgcagcttcgtcagcctgctcgccgagccgccgaggaggacgacaggaagaggacgggtggtgcggccccgctcgccatgcgatttcctgcccgccaacacagcaggcggtggggtggtggccgactgctgcaacgggctcgtcctcttgaaaaactccggcgacggctccgtctccgtctccggctccggctccgggccccgcgcatcgtacgtcgtctgcaaccctgccaccgagaagtgggctagcgtgccgggatcaacccatgccggcaagatctgctccgctagcatcctgtgcttcgaaccggccatctccctgcggcatttccatgtcgttgagctgttgtggtgggtggccaacgaggaagacgagaaccactggtatacggagccaagcctgtttgaggggttcaacatctactcctctgaaacaggagcctgggttttccatgctcacagccacagccattgtttcaacggcctgctgcattttatcactgccatcgacggcgcggtcgccgcactggacatggacgggcagacacgtagtgtgattcctgtcccgcgaaggggaggcggcgggttcattggccattctcaggggcgcctgttgtatgcgagcagagatgttggtaacacctccaagctgccgatctatgtgctgctgggggaggagggagagagtaatggcagcaggtggactttgaagcactgcgtcgacacttcaggcctggtgtttactgatgcggacgagtatttgttgcagtctgggctgttggtgggactgggagtggctgccattcatccgcacggcgattccatcttcttgtttgattcattgcagggaaaattgatgtcatacagtatggatagccagagagctcatgtcatccgcagtgtcacaaaatccccatacttctggtcatttctaccgtatgtaccacactacctagagacggcagcactgcaaaactcgaactag

SEQ ID NO: 12208 - protein, 409 aa, Sorghum bicolor
  misc_feature: Ceres ANNOT ID no. 6067814
  misc_feature (22)..(69): Pfam Id: F-box Pfam Desc: F-box domain
  misc_feature (27)..(404): NCBI GI: 115462391 NCBI Desc: os05g0177100 [oryza sativa (japonica cultivar-group)]
  misc_feature (54)..(402): NCBI GI: 50508392 NCBI Desc: receptor-like kinase-like [oryza sativa (japonica cultivar-group)]
  misc_feature (25)..(188): NCBI GI: 117670145 NCBI Desc: f-box-like protein [hordeum vulgare]
  misc_feature (97)..(322): NCBI GI: 115462373 NCBI Desc: os05g0175800 [oryza sativa (japonica cultivar-group)]
  misc_feature (23)..(332): NCBI GI: 20804769 NCBI Desc: p0698a10.24 [oryza sativa (japonica cultivar-group)]
MEAAARDTEKKRSLAVTSSTAGGGVGLTDDLVVEILSRVPVKSICRFKCVSPSWRSLISHPDNRKKLPHTVTGFLYLVEFDTCSFVSLLAEPPRRTTGRGRVVRPRSPCDFLPANTAGGGVVADCCNGLVLLKNSGDGSVSVSGSGSGPRASYVVCNPATEKWASVPGSTHAGKICSASILCFEPAISLRHFHVVELLWWVANEEDENHWYTEPSLFEGFNIYSSETGAWVFHAHSHSHCFNGLLHFITAIDGAVAALDMDGQTRSVIPVPRRGGGGFIGHSQGRLLYASRDVGNTSKLPIYVLLGEEGESNGSRWTLKHCVDTSGLVFTDADEYLLQSGLLVGLGVAAIHPHGDSIFLFDSLQGKLMSYSMDSQRAHVIRSVTKSPYFWSFLPYVPHYLETAALQNSN

SEQ ID NO: 12209 - DNA, 1245 bp, Sorghum bicolor
  misc_feature: Ceres ANNOT ID no. 6067815
  misc_feature: Encodes the peptide sequence at SEQ ID NO 12210
atggaggaggcccgcgacacgaagaagaagcggagcctcgccgtcactagttccgcctccaccgcagccgccaccggcgttggcctcaccgacgaccacatcgtcgacatcctctcgcgcgtgcccgtgaagtcgatctgccgcttcaagtgcgtctccccgtcgtggcgcagcctcatctcccaccccgacaaccgcaagaagctgccccagacggtcacgggcttcttctacttcgacgagttcgattcgtgcaccttcgtcagcctgctcgccgagccgccgaggaggacgacaggaagaggatgggtgcggccccgctcgccgtgcgatttcctgcccgccaacacaggcggcggggtggtggactgctgcaacgggctcgtcctcttgaacaactcccgcggcggcggcggcggcggcggctccgagccccgcgcatcgtacgtcgtctgcaaccctgccaccgagaagtggactaccgtgccggcatcaacccgtgccggcaagatctgctccgctagcatcctgtgcttcgacccggccatctccccgcatttccatgtcgttcagttgctggaccgggacccggaggccgacgaggccgacgacgaggaggaggaagactggtttgccgaggaaagcagccagttcgaggggttcaacatctactcctctgaaacaggggcctgggttttccatcctcatgacagccattggtctcccgttgcccaccggagcaggaggatcttcttcaacggccagctgcatttcgtcaccggcgacgacggcgcggtcgctgcactggacatgaaagggcagcagaaacgcagggtgattcctgtcccgcgaagcggagaggtccagctcattggccattctcaggggcgcctgctctacgcgaacagagatgctcgtaacgcctccaagctgtcgatctatgtgctcggggagggtgggaatggcaatggcaggtggactctgaagcactgcgttgagacttcatcaggcctgtttgctggtgaagagtatttgcagtctgggctgttggtgggagtggccgccattcatccgcacggcgattctgtcttcttgtttgattcgttgcagggaaggttgatgtcatatggtatggggagccggcgaggtcatgtcgtcggcaatgtcgaagaatcgccgctgtggtcatttgtaccgtatgttccactctacttggagatggcagcactggaaaactccaagtag

SEQ ID NO: 12210 - protein, 414 aa, Sorghum bicolor
  misc_feature: Ceres ANNOT ID no. 6067815
  misc_feature (24)..(71): Pfam Id: F-box Pfam Desc: F-box domain
  misc_feature (56)..(406): NCBI GI: 50508392 NCBI Desc: receptor-like kinase-like [oryza sativa (japonica cultivar-group)]
  misc_feature (29)..(409): NCBI GI: 115462391 NCBI Desc: os05g0177100 [oryza sativa (japonica cultivar-group)]
  misc_feature (29)..(338): NCBI GI: 115462393 NCBI Desc: os05g0177400 [oryza sativa (japonica cultivar-group)]
  misc_feature (27)..(201): NCBI GI: 117670145 NCBI Desc: f-box-like protein [hordeum vulgare]
  misc_feature (223)..(382): NCBI GI: 20804769 NCBI Desc: p0698a10.24 [oryza sativa (japonica cultivar-group)]
MEEARDTKKKRSLAVTSSASTAAATGVGLTDDHIVDILSRVPVKSICRFKCVSPSWRSLISHPDNRKKLPQTVTGFFYFDEFDSCTFVSLLAEPPRRTTGRGWVRPRSPCDFLPANTGGGVVDCCNGLVLLNNSRGGGGGGGSEPRASYVVCNPATEKWTTVPASTRAGKICSASILCFDPAISPHFHVVQLLDRDPEADEADDEEEEDWFAEESSQFEGFNIYSSETGAWVFHPHDSHWSPVAHRSRRIFFNGQLHFVTGDDGAVAALDMKGQQKRRVIPVPRSGEVQLIGHSQGRLLYANRDARNASKLSIYVLGEGGNGNGRWTLKHCVETSSGLFAGEEYLQSGLLVGVAAIHPHGDSVFLFDSLQGRLMSYGMGSRRGHVVGNVEESPLWSFVPYVPLYLEMAALENSK

SEQ ID NO: 12211 - DNA, 1824 bp, Sorghum bicolor
  misc_feature: Ceres ANNOT ID no. 6067879
  misc_feature: Encodes the peptide sequence at SEQ ID NO 12212
atggctgggcctgggttcctgctgcaactgcaaccccaccacgtcctcctcctgctcctcgtcctcccctgcctgcttccctgtctccgcgcgacgaccgagatggcgccaaccgccgccgccggcggctccgacgagggcgccagcgcgctgctcgggctcctgcagcgggtgcagtcggaggcgctgcgcgtgctggggcctcacgacttcgaccccaagttctacgtcgacctgccgctggccaccgacgagcgcgccgcggacgccgccctcgcggcgctgccgcgccacccggcgccgtcgcgagcggagctagatgacttcctgtcccgccacttcggggaccccgggacggacctcgtggacgccgacccaccggacttcgacgccgagccgcgcgggttcctgccccgcgtccacagccccgaggcgcgggcgtgggcgctggaggtgcacgcgctgtggaagcaactggcgcggcgggtggcgcccgacgtcgcggcgcggccggaccggcacacgctactgccgctgcccggcggggtcgtcgtgccgggctccaggttccgagaggtatactactgggactcctactgggtcgtcaggggattgctagtgagcaaaatgtatgacacggcaaaggctattgtgcttaaccttgtatacatgttggaaaaatatggttttgttccgaatggtgcaagatcctactacattaaccgaagccaaccaccacttttaagctccatggttttagaagtatacagggcaactcgtgacgtggagtttgttaggacagtattcccctctctgcttaaagagcatagcttctggatgtcagatattcataatgtggctatagcggacaatcatggtcaggtccataatttgtctcggtatcaggctaggtggaacaaacctaggcctgaaagtgcgacaattgatgaggaactggcttcgaaggttaattctatggccgccaaggaaaaactgtaccgtgaaattgcttcaacagcagaatcaggatgggattttagctctcgatggatgaggaattctactgacatgacaacattggcaaccacttacatcattcctgtggacttgaacatattcatatttaagatggagctggatattggtgccttggctaaacttgtaggagacagtgcaacttcagaaaaatttttaagggcttcaaaagcacgtcatattgcaattgactctattttgtggaactctgagatggaacagtggcttgactattggcttcctgctgacgcagactgtcagggagttcacgaatggaagaccaactcacagaaccgcaacatatttgcttctaacttcattccgctgtggctaaatgcataccattctggattggtacgctttgctgatgaggcaaaatcaaagagagtcatggcaagcctcaaggcatctggattacttcatgccgcaggaatagcaacttctctgataaacacaggccaacaatgggatttcccaaatggatgggccccgctgcagcatcttatagctgaggggctgtcgcattctggattatcagaggctaaaaaattagctgaggacattgctacaaggtgggtgagaacaaactatgccgcttacaaatcgacgggtgcgatgcatgagaagtacaatgttaccgcttgtggagaatctggaggcggtggtgaatacaagccccagactggttttggctggtccaatggtgtggtattgtcattcttggaagaattcgggtggccagaggacaaggaaatagcctgctcaggcaaagtgctcacgacagggtga

SEQ ID NO: 12212 - protein, 607 aa, Sorghum bicolor
  misc_feature: Ceres ANNOT ID no. 6067879
  misc_feature (68)..(590): Pfam Id: Trehalase Pfam Desc: Trehalase
  misc_feature (48)..(599): NCBI GI: 4559292 NCBI Desc: trehalase 1 gmtre1 [glycine max]
  misc_feature (38)..(597): NCBI GI: 6651011 NCBI Desc: trehalase; tre [arabidopsis thaliana]
  misc_feature (38)..(597): NCBI GI: 2262112 NCBI Desc: trehalase precusor isolog [arabidopsis thaliana]
  misc_feature (321)..(594): NCBI GI: 109138543 NCBI Desc: trehalase [saccharum officinarum]
  misc_feature (72)..(470): NCBI GI: 164737 NCBI Desc: alpha,alpha-trehalose glucohydrolase
MAGPGFLLQLQPHHVLLLLLVLPCLLPCLRATTEMAPTAAAGGSDEGASALLGLLQRVQSEALRVLGPHDFDPKFYVDLPLATDERAADAALAALPRHPAPSRAELDDFLSRHFGDPGTDLVDADPPDFDAEPRGFLPRVHSPEARAWALEVHALWKQLARRVAPDVAARPDRHTLLPLPGGVVVPGSRFREVYYWDSYWVVRGLLVSKMYDTAKAIVLNLVYMLEKYGFVPNGARSYYINRSQPPLLSSMVLEVYRATRDVEFVRTVFPSLLKEHSFWMSDIHNVAIADNHGQVHNLSRYQARWNKPRPESATIDEELASKVNSMAAKEKLYREIASTAESGWDFSSRWMRNSTDMTTLATTYIIPVDLNIFIFKMELDIGALAKLVGDSATSEKFLRASKARHIAIDSILWNSEMEQWLDYWLPADADCQGVHEWKTNSQNRNIFASNFIPLWLNAYHSGLVRFADEAKSKRVMASLKASGLLHAAGIATSLINTGQQWDFPNGWAPLQHLIAEGLSHSGLSEAKKLAEDIATRWVRTNYAAYKSTGAMHEKYNVTACGESGGGGEYKPQTGFGWSNGVVLSFLEEFGWPEDKEIACSGKVLTTG

SEQ ID NO: 12213 - DNA, 1668 bp, Sorghum bicolor
  misc_feature: Ceres ANNOT ID no. 6067947
  misc_feature: Encodes the peptide sequence at SEQ ID NO 12214
atggctgtttccgcgtacgaccagtggcttgctcgccgcgaggagcagcgccgccgcatatgcggcgatgaccgcctgagcgcccttcctgacgacgtgatccgcctcatcctccgctgcctcgacacacgctcggcgctcgccaccgccgcggtttccaagcattgggcgcgcttccgtcgcgagcaccccgtgctcgagttcaaagtcactgatatcctgcctgagcgctaccatcggtacctccggcggcggcgtcggcgtcagaacaccaccaccgccgccgccgggaagaaccacaataagaagctggacgacttgatcagccggtacgagcggcggagcatgcgctccatggccatatccatgaatagcttcttggacgcggatgaagtcgtcgaccacgggcagggtcgtcgtcgtcgtcgtgcccatgctatgactctagaactattcccaggccacaacactgcgccgttcaaccgcctcgttaccaaggccattggtgactggggagttgaagacctagagatcgtcgtgctccatccaactccatgccacggccacgacgtgagctacagcttccctcaccattgttttgacgacgacgacgacctcaaatctcccactactggtggtggcctgaagaaactgaagctaactaattgcacggcccacgacccattggccgccgccggcggcggcggctcatcgctgccggcgtttagctccctcaccatgctcgtcttgcaagacatgcccaagtggacgcgcggccgcgtgtaccagtgcatcgtccgcgcgtgcccgagcctgcaggtgctgcacctcaagtcctgtgtcttctgggacttggagagcatgtccatagacgctcctgcctcgcagataacagagctggtcgtcgacggctgcacgttcgtctccatgaccctccgttctctaccaaggcttgagcgactggctctcgtgggtgctcctgtggcgtttgcctttggctctctgccgcgtctcaatcgcctcaacctcagcttcgtccaagacccgatcccagcaagcagccgccatcctatgttccctgacatgcgagacgagtactctgttttctctgtcatcgatccctcggacagtttccgggacttggagtgccttgtagttcgtttcacggggccggagaattgggtcgtgccaatcgagggcttgtcgctgggcaatgtgaggcggctgctcttagcagacatgccgcgttcgtgggacatctcgtggacatgtcgcctcctggaagctgcgccttatctggagacactgcatgtccattttgttgatgatcttcatgtgggaatggcggcggtcgtcgatccagcgattacgaggccaccgtccgacttcaagaaccgtgcgcttaaagaggtggtgatcataggcttcaaggggactgatgggaagcatgttcgctttgtgaggcttcttattaggaacgggtgcagcacgctggagaatgttacgctactcaagcatggacgcgtgcgggagatggggctttgggactggcaagtggtggccaccccggaagagtgccaatggagcgacgaggaaagggacgccttgttgaaggagatacacaagggtgggaatacttcttccacgacgcgaattattcttggatga

SEQ ID NO: 12214 - protein, 555 aa, Sorghum bicolor
  misc_feature: Ceres ANNOT ID no. 6067947
  misc_feature (24)..(71): Pfam Id: F-box Pfam Desc: F-box domain
  misc_feature (239)..(555): NCBI GI: 115455907 NCBI Desc: os03g0796100 [oryza sativa (japonica cultivar-group)]
  misc_feature (32)..(345): NCBI GI: 32526680 NCBI Desc: plant disease resistance polyprotein -like protein [oryza sativa (japonica cultivar-group)]
  misc_feature (239)..(552): NCBI GI: 38346115 NCBI Desc: osjnbb0006n15.10 [oryza sativa (japonica cultivar-group)]
  misc_feature (142)..(521): NCBI GI: 21743052 NCBI Desc: osjnba0083d01.2 [oryza sativa (japonica cultivar-group)]
  misc_feature (22)..(199): NCBI GI: 21743054 NCBI Desc: osjnba0083d01.4 [oryza sativa (japonica cultivar-group)]
MAVSAYDQWLARREEQRRRICGDDRLSALPDDVIRLILRCLDTRSALATAAVSKHWARFRREHPVLEFKVTDILPERYHRYLRRRRRRQNTTTAAAGKNHNKKLDDLISRYERRSMRSMAISMNSFLDADEVVDHGQGRRRRRAHAMTLELFPGHNTAPFNRLVTKAIGDWGVEDLEIVVLHPTPCHGHDVSYSFPHHCFDDDDDLKSPTTGGGLKKLKLTNCTAHDPLAAAGGGGSSLPAFSSLTMLVLQDMPKWTRGRVYQCIVRACPSLQVLHLKSCVFWDLESMSIDAPASQITELVVDGCTFVSMTLRSLPRLERLALVGAPVAFAFGSLPRLNRLNLSFVQDPIPASSRHPMFPDMRDEYSVFSVIDPSDSFRDLECLVVRFTGPENWVVPIEGLSLGNVRRLLLADMPRSWDISWTCRLLEAAPYLETLHVHFVDDLHVGMAAVVDPAITRPPSDFKNRALKEVVIIGFKGTDGKHVRFVRLLIRNGCSTLENVTLLKHGRVREMGLWDWQVVATPEECQWSDEERDALLKEIHKGGNTSSTTRIILG

SEQ ID NO: 12215 - DNA, 681 bp, Sorghum bicolor
  misc_feature: Ceres ANNOT ID no. 6067972
  misc_feature: Encodes the peptide sequence at SEQ ID NO 12216
atggcgacagagcaagcggcggagaactacacggtggaggacctcgtggccctgaacccctacaaccccgacatcctcaacgacctcgagaagttcgtcaacgagcaggtctcgtctcaaacatataacctggatgcaaatctcagccttcttcgcctgtaccagttcgagccagaaaggatgagtatacagattgtggcccacatactgattaaggctctcatggcaatgccggccccggacttcagtctttgcttattcttaatacctgaacatgtgcaaatggaggagcagttcaagacattgatagttctttctcactacctagagactgctaggttcagtcagttttgggatgaagcagcaaagaaccgccacatattggaagcagttccaggttttgaacaggcaatccaatcctatgcgattcatgtactttccttgacataccagaaagttccaaggcctattcttgcagaggcaatcaacattgaaggtcttgcgttggacaagtttcttgagtatcatgctgcaaactcaggttgggtgattgagaagggtgggcagtctcaagtgattgttcttccacgcaatgagttcaatcacccagagctcaagaagaacacagctgatatcgttccctttgagcacgtaacacgcatattccctgtccttagctga

SEQ ID NO: 12216 - protein, 226 aa, Sorghum bicolor
  misc_feature: Ceres ANNOT ID no. 6067972
  misc_feature (19)..(164): Pfam Id: SAC3_GANP Pfam Desc: SAC3/GANP/Nin1/mts3/eIF-3 p25 family
  misc_feature (1)..(226): NCBI GI: 23396617 NCBI Desc: eukaryotic translation initiation factor 3 subunit 11 (eif-3 p25) (eif3k)
  misc_feature (1)..(226): NCBI GI: 115451149 NCBI Desc: os03g0182700 [oryza sativa (japonica cultivar-group)]
  misc_feature (15)..(221): NCBI GI: 119577211 NCBI Desc: eukaryotic translation initiation factor 3, subunit 12, isoform cra_e [homo sapiens]
  misc_feature (15)..(221): NCBI GI: 5114051 NCBI Desc: hspc029 [homo sapiens]
  misc_feature (15)..(221): NCBI GI: 55669683 NCBI Desc: chain a, crystal structure of human eif3k
MATEQAAENYTVEDLVALNPYNPDILNDLEKFVNEQVSSQTYNLDANLSLLRLYQFEPERMSIQIVAHILIKALMAMPAPDFSLCLFLIPEHVQMEEQFKTLIVLSHYLETARFSQFWDEAAKNRHILEAVPGFEQAIQSYAIHVLSLTYQKVPRPILAEAINIEGLALDKFLEYHAANSGWVIEKGGQSQVIVLPRNEFNHPELKKNTADIVPFEHVTRIFPVLS

SEQ ID NO: 12217 - DNA, 1416 bp, Sorghum bicolor
  misc_feature: Ceres ANNOT ID no. 6068030
  misc_feature: Encodes the peptide sequence at SEQ ID NO 12218
atgctgcgcgtcgtcgtctccaccctccccactctccgcccgctcctccggcgtgggcctctgctaaaccataaacccctgctccgctcgcggcttcagccgtggccgttccgcgcgctctcgtcgcctgccgccgccgccgccgctagcgcgcccagcgcctcagtgaagggggaggacgttgcgttggaggagcaccttacgcggtgcgcggcggcaggcagggcaccgttgcgggtggcggtgctggtgagcggcggggtggacagcagcgtcgcgctccgcctcctccacgccgcgggccatcactgcaccgcgttctacctgaagatttggttccaggaagatttcaggaacttttggtccgagtgcccatgggacgaggatttaaaatatgcgcaagctgtttgtgacaaggtgtcacatatgatcaatgagtatcgctgtggtcgtacaccaaatcctgatgttctgtgcaacacgagaataaagtttggggctttcttagaagctattgaaaatttgggatttgactacatagcttcagggcattatgcacacgtagtacatccttccactgaaaatactgaagcgccatccatactgcaattatcaaaggacaaggtcaaagatcaaacctatttcctctcacatctatctcaacctcagcttagaaggcttcttttcccactaggatgtattacaaaggacgaggttcgcagactggctactcaaatgggccttcctaaccaaggtaggaaggactcacaggggatatgctttcttggaaaggtcaagtttagtgagtttgttgaaagacatataggagaaatggaaggaatcatactggaagccgagtctggagattacttagggaaacaccgtgggttttggttctatacaattggtcagcggcaaggattacggcttcctggaggaccttggtatgttgtagagaaagatgttcaaaacaatgtggtttttgtatcaaggaattactattcattggataagcggaggcgcacatttcgtgttggatcactaaactggtttgacagttctgggcctggaaacaacgagcaacttaaatgcaaggtgcgacatagccctgaatttcacgactgcactttgataaaagagcatactgaagaaaatgaggatgctttggtggtgcatctgtccgaagatgaccagggcttagcagctggtcagtttgcagcgttctatagtgaacattcatgcctgggatcaggcatcattttggattcatgggacaagatgagcttccctgtctgctcaagggcactcgaaattgctaaattggaggacaaatcgagcttagggaagccagtaagaatcctgaacttggaacatgtcgtgaagccagaaaaacaggaggaaatcaaagttgcctga

SEQ ID NO: 12218 - protein, 471 aa, Sorghum bicolor
  misc_feature: Ceres ANNOT ID no. 6068030
  misc_feature (78)..(420): Pfam Id: tRNA_Me_trans Pfam Desc: tRNA methyl transferase
  misc_feature (140)..(456): NCBI GI: 145336613 NCBI Desc: trna (5-methylaminomethyl-2-thiouridylate)-methyltransferase [arabidopsis thaliana]
  misc_feature (78)..(420): NCBI GI: 8134738 NCBI Desc: probable trna (5-methylaminomethyl-2-thiouridylate)-methyltransferase
  misc_feature (78)..(420): NCBI GI: 73920033 NCBI Desc: probable trna (5-methylaminomethyl-2-thiouridylate)-methyltransferase
  misc_feature (80)..(420): NCBI GI: 34396421 NCBI Desc: trna (5-methylaminomethyl-2-thiouridylate)-methyltransferase [porphyromonas gingivalis w83]
  misc_feature (79)..(420): NCBI GI: 30173411 NCBI Desc: probable trna (5-methylaminomethyl-2-thiouridylate)-methyltransferase
MLRVVVSTLPTLRPLLRRGPLLNHKPLLRSRLQPWPFRALSSPAAAAAASAPSASVKGEDVALEEHLTRCAAAGRAPLRVAVLVSGGVDSSVALRLLHAAGHHCTAFYLKIWFQEDFRNFWSECPWDEDLKYAQAVCDKVSHMINEYRCGRTPNPDVLCNTRIKFGAFLEAIENLGFDYIASGHYAHVVHPSTENTEAPSILQLSKDKVKDQTYFLSHLSQPQLRRLLFPLGCITKDEVRRLATQMGLPNQGRKDSQGICFLGKVKFSEFVERHIGEMEGIILEAESGDYLGKHRGFWFYTIGQRQGLRLPGGPWYVVEKDVQNNVVFVSRNYYSLDKRRRTFRVGSLNWFDSSGPGNNEQLKCKVRHSPEFHDCTLIKEHTEENEDALVVHLSEDDQGLAAGQFAAFYSEHSCLGSGIILDSWDKMSFPVCSRALEIAKLEDKSSLGKPVRILNLEHVVKPEKQEEIKVA

SEQ ID NO: 12219 - DNA, 1050 bp, Sorghum bicolor
  misc_feature: Ceres ANNOT ID no. 6068031
  misc_feature: Encodes the peptide sequence at SEQ ID NO 12220
atggcgccgctcgtgccgatgtcgcagccatgggtggagaaataccggccgaggcaggtcaaggatgtggctcaccaggaggaggtgattcgggtgctcaccaacaccctccagaccgccgacctgccgcacatgctgttctacggcccgccggggacgggaaagaccaccaccgcactcgccattgcctaccagctctacgggtataccctcgtgctggaccgtcttttagttccagagctatataagtcgagagttttggagctcaatgctagtgatgatcgtggaattaatgtggtgaggacgaaaatcaaggactttgctgctgttgctgttggtactgcacggaaagctggttatccctgcccaccttacaagattattatacttgatgaagcagattcaatgacagaagatgcccagaatgctttgaggcgtaccatggagacttactccaaagtgacccgattcttttttatatgcaactatatcagcaggataatagaaccacttgcatcgagatgtgccaagtttaggttcaagcctctttcagaagaagtgatgagcagccgcattatgcatatatgcaatgaagaaggtctcaatcttgatgctcaggcgctgtccacgctgagtgccatttctcaaggtgaccttcgtcgtgctataacctatcttcagagtgcagctcgcttatttggatcttctctctcttccagtgacttgatcagtgtttcaggggttatccctgaagatgttgtcaagtcactgcttgcagcctgcaaatctggtgaatttgacgtggcgaacaaggaagttagcaacattattgcagatggatatccagtctcacagctgatggcgcagtttctagatgtgattgttagcgcggatgatattcaagatgatcaaaaggcaaggatatgtaaaaagcttggggaaactgacaagtgcttggttgatggggcagatgagtatctacagctgttggatgtcgccagtgagactattcgtgctcttttcaacatgccacaaacgctggtcttctaa

SEQ ID NO: 12220 - protein, 349 aa, Sorghum bicolor
  misc_feature: Ceres ANNOT ID no. 6068031
  misc_feature (247)..(336): Pfam Id: Rep_fac_C Pfam Desc: Replication factor C
  misc_feature (44)..(236): Pfam Id: AAA Pfam Desc: ATPase family associated with various cellular activities(AAA)
  misc_feature (1)..(349): NCBI GI: 115487618 NCBI Desc: os12g0176500 [oryza sativa (japonica cultivar-group)]
  misc_feature (1)..(345): NCBI GI: 92870525 NCBI Desc: chaperonin clpa/b; checkpoint protein rad24; dead/deah box helicase, n-terminal [medicago truncatula]
  misc_feature (1)..(227): NCBI GI: 5263320 NCBI Desc: similar to gbm87339 replication factor c, 37-kda subunit from homo sapiens and is a member of pf00004 atpases associated with various cellular activities. [arabidopsis
  misc_feature (1)..(227): NCBI GI: 5263320 (continued) thaliana]
  misc_feature (10)..(330): NCBI GI: 62858553 NCBI Desc: rfc4 [xenopus tropicalis]
  misc_feature (10)..(330): NCBI GI: 120537910 NCBI Desc: rfc2 protein [xenopus laevis]
MAPLVPMSQPWVEKYRPRQVKDVAHQEEVIRVLTNTLQTADLPHMLFYGPPGTGKTTTALAIAYQLYGYTLVLDRLLVPELYKSRVLELNASDDRGINVVRTKIKDFAAVAVGTARKAGYPCPPYKIIILDEADSMTEDAQNALRRTMETYSKVTRFFFICNYISRIIEPLASRCAKFRFKPLSEEVMSSRIMHICNEEGLNLDAQALSTLSAISQGDLRRAITYLQSAARLFGSSLSSSDLISVSGVIPEDVVKSLLAACKSGEFDVANKEVSNIIADGYPVSQLMAQFLDVIVSADDIQDDQKARICKKLGETDKCLVDGADEYLQLLDVASETIRALFNMPQTLVF

SEQ ID NO: 12221 - DNA, 1248 bp, Sorghum bicolor
  misc_feature: Ceres ANNOT ID no. 6068037
  misc_feature: Encodes the peptide sequence at SEQ ID NO 12222
atggcggcgccgtatcaccagccgacaagcctggaggaggtccgcacgctgtggatcggcgacctccagtactggaccgacgagaactacctctacagctgcttcgcccacaccggggaggtacaatctgttaaaataatacgcaacaaagtaacaagccttccagagggttatgggtttatagagtttgtttcgcatgaagctgctgagaaaattctccagacttacaatggcacacagatgcctggaactgaacacacattcagattgaattgggcctctttcagctccggtgagaggcgtcctgatccaggatctgatcattcgattttcgtaggggacttggcacctgacgtcacagattacttactacaggagacattccgagtgaactatccatctgttagaggggctaaggttgtcacagatccaaatactgggagatctaaaggatatggatttgtaaagttcgcagatgaaaatgaaaagaaccgtgcaatgacagaaatgaatggtgtgtactgttcaacaagacctatgcggataagtgcagcaatacctaagaaatccactggctctcagcttcagtattcagctgctaaagcggtgtatccagcaacagcttatgcaatgcctcagctccaggcagttctccctgacagtgatcctacaaacactacaatatttattgggaacttggacccaaatgtgacagaagatgagctgaggcagatatgtgtacaatttggagagcttatatatgtgaaaattcctgttggcaaaggatgtggatttgtacagtatgcatctagggcctcagctgaagaggcagtacaacgtcttcatggcacaatgattggccaacaagctgttcggctttcatggggccgaagtcctgcgagtaaacaggacccatcagctgtgtggagtcagcaagcagatccaaatcagtgggcaaacacttactatggctatggatatgatgcatatggatatgctcaggatccgtcatacgcgtatggtgcctatgcaggatatagccaatatccccaacagattgagggaggtgttgatgccacttctgttgctggtagccatccgggcatggaacaaaaagaggagccatatgatccaatgaacatacctgatgtcgacaagctgaatgcttcatacatggctgttcatggtagagccatgctagggcggtcattgtggttgaagaccaacccgctgccccaaccaacataa

SEQ ID NO: 12222 - protein, 415 aa, Sorghum bicolor
  misc_feature: Ceres ANNOT ID no. 6068037
  misc_feature (17)..(88): Pfam Id: RRM_1 Pfam Desc: RNA recognition motif. (a.k.a. RRM, RBD, or RNP domain)
  misc_feature (110)..(182): Pfam Id: RRM_1 Pfam Desc: RNA recognition motif. (a.k.a. RRM, RBD, or RNP domain)
  misc_feature (228)..(293): Pfam Id: RRM_1 Pfam Desc: RNA recognition motif. (a.k.a. RRM, RBD, or RNP domain)
  misc_feature (2)..(413): NCBI GI: 115451047 NCBI Desc: os03g0174100 [oryza sativa (japonica cultivar-group)]
  misc_feature (1)..(409): NCBI GI: 92891584 NCBI Desc: rna-binding region rnp-1 (rna recognition motif) [medicago truncatula]
  misc_feature (2)..(353): NCBI GI: 115475137 NCBI Desc: os08g0190200 [oryza sativa (japonica cultivar-group)]
  misc_feature (4)..(352): NCBI GI: 9663767 NCBI Desc: rna binding protein 45 [nicotiana plumbaginifolia]
  misc_feature (8)..(352): NCBI GI: 39545835 NCBI Desc: osjnbb0060e08.6 [oryza sativa (japonica cultivar-group)]
  misc_feature: The sequence is a functional homolog of SEQ ID NO 536 in the 10/666,642 US patent application
  misc_feature: Useful for making plants with altered terpenoid content
  misc_feature: Functional homolog of the protein sequence given in SEQ ID NO 12954
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO. 339 in the 11/188,298 US application
  misc_feature: The sequence is a functional homolog of SEQ ID NO. 458 in the 11/188,298 US application
MAAPYHQPTSLEEVRTLWIGDLQYWTDENYLYSCFAHTGEVQSVKIIRNKVTSLPEGYGFIEFVSHEAAEKILQTYNGTQMPGTEHTFRLNWASFSSGERRPDPGSDHSIFVGDLAPDVTDYLLQETFRVNYPSVRGAKVVTDPNTGRSKGYGFVKFADENEKNRAMTEMNGVYCSTRPMRISAAIPKKSTGSQLQYSAAKAVYPATAYAMPQLQAVLPDSDPTNTTIFIGNLDPNVTEDELRQICVQFGELIYVKIPVGKGCGFVQYASRASAEEAVQRLHGTMIGQQAVRLSWGRSPASKQDPSAVWSQQADPNQWANTYYGYGYDAYGYAQDPSYAYGAYAGYSQYPQQIEGGVDATSVAGSHPGMEQKEEPYDPMNIPDVDKLNASYMAVHGRAMLGRSLWLKTNPLPQPT

SEQ ID NO: 12223 - DNA, 1740 bp, Sorghum bicolor
  misc_feature: Ceres ANNOT ID no. 6068211
  misc_feature: Encodes the peptide sequence at SEQ ID NO 12224
atgagagatggaagcaacaccaccaagaagagcaagttgtcatggtccaagagcttggtgaggaagtggttcaacatcaggagcaaggcccatgacttccatgctgacgatgtacccgcgattggtaggacagttgcgggagggggcgatgatgagtggaggaggggcagcagcttcacccgtagggagcctagcacagtaaagaagagcaagacagagaggtcctcgaggaggagcaatgggcactcgaggcggggaaagatcgaccttgatgccgccgaagctacagtgacattggactataggatatttgttgctacatggaatgtggctggccgttccccgccaaataacatgagccttgaggactggctccatgctgcacctcctgctgacatctatgtcctcgggtttcaagaaatcgttccactcaatgctgggaacgttcttgggacagaggacaatgtcccagcaaagaggtgggtgtcactggtcaggaggacactgaacaatttgccaggtactagtggcaatgggagcttccggacaccatctccggctcctaaccctgtggtggagatcgatgatgattttgagggtttgtcatcgaggcagaacaatgcgacattctttcatcgtcggtctttccaggctgggcttagtcggagtttgagaatggagggtgacattcttgctcctcagccaaggctggaacgtcggtacagtgtctgtgaccgagcaatctatggtcgtaggcctagcgactatgagaacaactaccgatggggtggatcatcagatgacgagaataatactggagagtctccgagtactgtgtattcaccaatgtcatatggatacggcaatgcatcatctctggaagatagtcagagacgagctggtcaaactagatactgtctggtggcaagcaagcaaatggtgggattgtttctgatgatttgggctcggaaagacataagagatgacataagaaatctgaaagtttcttgtgttgggagaggactgatgggctaccttgggaataagggttcaatttcgattagcatgtcattgcaccaaacaagcttctgcttcgtctgcagccacctgacttcaggacagaaggaaggtgatgagctgcggaggaactccgatgtgctggaaatcctcagaaagaccaggtttccaatggtctatgggcagtatgagcattcaccagaaacaatcttagagcatgatcgaatcatctggctcggggacctaaattaccgaatcgcactttcctatcggtcagtgaaggcccttgtcgagatgcgcaattggaaagccttgctagagaaagatcagctaaggatcgagcaaagaggtggaagagtatttgttgggtggagtgaggggaatatatatttcccaccaacatacaagtactcaaacaattctgacaagtatgctggagatgacatgaaccagaaggaaaagaggagaaccccggcatggtgcgaccgtattttatggtacggaagaggccttggtcaactgtcatacgtacgaggtgaatctcgcttttcggaccatagaccagtctacagcgtcttcagtgctgaagtggaatcaatcaatcatagccggatccaaaagatgagttgctcaagttctcaactggacattgaagaactgttgccttactcatatggatacactgacatcaacccatatggatacgacctaaacttctactga

SEQ ID NO: 12224 - protein, 579 aa, Sorghum bicolor
  misc_feature: Ceres ANNOT ID no. 6068211
  misc_feature (103)..(532): Pfam Id: Exo_endo_phos Pfam Desc: Endonuclease/Exonuclease/phosphatase family
  misc_feature (48)..(311): NCBI GI: 115450875 NCBI Desc: os03g0160600 [oryza sativa (japonica cultivar-group)]
  misc_feature (1)..(572): NCBI GI: 92883941 NCBI Desc: inositol polyphosphate related phosphatase [medicago truncatula]
  misc_feature (249)..(565): NCBI GI: 47155293 NCBI Desc: inositol 1,4,5-trisphosphate 5-phosphatase [arabidopsis thaliana]
  misc_feature (71)..(571): NCBI GI: 7523406 NCBI Desc: inositol-1, 4, 5-trisphosphate 5-phosphatase-like protein [arabidopsis thaliana]
  misc_feature (193)..(570): NCBI GI: 15220522 NCBI Desc: endonuclease/exonuclease/phosphatase family protein [arabidopsis thaliana]
  misc_feature (193)..(570): SWISSPROT Homolog: EC 3.1.3.56 Type I inositol-1,4,5-trisphosphate 5-phosphatase CVP2
MRDGSNTTKKSKLSWSKSLVRKWFNIRSKAHDFHADDVPAIGRTVAGGGDDEWRRGSSFTRREPSTVKKSKTERSSRRSNGHSRRGKIDLDAAEATVTLDYRIFVATWNVAGRSPPNNMSLEDWLHAAPPADIYVLGFQEIVPLNAGNVLGTEDNVPAKRWVSLVRRTLNNLPGTSGNGSFRTPSPAPNPVVEIDDDFEGLSSRQNNATFFHRRSFQAGLSRSLRMEGDILAPQPRLERRYSVCDRAIYGRRPSDYENNYRWGGSSDDENNTGESPSTVYSPMSYGYGNASSLEDSQRRAGQTRYCLVASKQMVGLFLMIWARKDIRDDIRNLKVSCVGRGLMGYLGNKGSISISMSLHQTSFCFVCSHLTSGQKEGDELRRNSDVLEILRKTRFPMVYGQYEHSPETILEHDRIIWLGDLNYRIALSYRSVKALVEMRNWKALLEKDQLRIEQRGGRVFVGWSEGNIYFPPTYKYSNNSDKYAGDDMNQKEKRRTPAWCDRILWYGRGLGQLSYVRGESRFSDHRPVYSVFSAEVESINHSRIQKMSCSSSQLDIEELLPYSYGYTDINPYGYDLNFY

SEQ ID NO: 12225 - DNA, 984 bp, Sorghum bicolor
  misc_feature: Ceres ANNOT ID no. 6068255
  misc_feature: Encodes the peptide sequence at SEQ ID NO 12226
atggcgtcgcagctgccacgagtgtgcgtcactggaggcggcgggttcatcgcctcctggctcgtgaagctgctcctctcccgtggctatgccgtccatgccactctccgtgacccatgcatgtacctatctattcacaattcacgtgatccaaagaatgcccatctgaagaagctggatagagccccagagaatctgcatctgttcaaggctgatgtgctggactgcgagactctgacgcccgcagttcaaggatgtcagggagtcttccatcttgccactccggtgcctgaagataagattcttcatcctgacgtttgctcaactctgaaggttcacaaagttgttgtgatgtcctccaatgctgctgttacttccaacccgaattggcctcaagatagactcaaagatgagagttgctggtcagacacagagttctgcaaggagaaggaggactggtattctgttgccaagactctggctgaacaagaagcctcggaatatgcacgtaacaatggactaaatgttgttgcactgtgccctccttatgtttttggtccactgttgcagtcttcagtgaacacaagcagcaaactcctcatctatgttataaaaggaggtcctgatgtgatgaccaacagaatgtgggacgtagtagacgtccgtgatgtggccgatgctctgctcctgttgtacgagaatgatcggtcatcagggagatacatttgctcgccgaatcgcgtttgcacgagggatttggtggacctgttgaagaagatgtacccagagtacggttacgtaaataacgtcgtcgatgctgaccatgcaggaccacctttatctagtcagaagctgaaggatctgggttgggaaccaaggaagctggaatcgacgctctcagacagcgtccagtcatatgaaaaggcagggcttctccaggggaatccttgtcgcctcccctttctcattcgtgcgtggctgtag

SEQ ID NO: 12226 - protein, 327 aa, Sorghum bicolor
  misc_feature: Ceres ANNOT ID no. 6068255
  misc_feature (8)..(244): Pfam Id: Epimerase Pfam Desc: NAD dependent epimerase/dehydratase family
  misc_feature (9)..(280): Pfam Id: 3Beta_HSD Pfam Desc: 3-beta hydroxysteroid dehydrogenase/isomerase family
  misc_feature (7)..(310): NCBI GI: 145337634 NCBI Desc: cinnamoyl-coa reductase [arabidopsis thaliana]
  misc_feature (8)..(312): NCBI GI: 3341511 NCBI Desc: cinnamoyl-coa reductase [saccharum officinarum]
  misc_feature (8)..(310): NCBI GI: 17978649 NCBI Desc: cinnamoyl-coa reductase [pinus taeda]
  misc_feature (1)..(312): NCBI GI: 9964087 NCBI Desc: cinnamoyl coa reductase [lolium perenne]
  misc_feature (8)..(310): NCBI GI: 104162062 NCBI Desc: cinnamoyl coa reductase [picea abies]
  misc_feature: Useful for making plants with altered cell wall content and/or composition
  misc_feature: Functional homolog of the protein sequence encoded by LOCUS at1g76470
  misc_feature: Useful for making plants with altered carbohydrate content
  misc_feature: Functional homolog of the protein sequence given in SEQ ID NO 13693
  misc_feature: Useful for making plants with altered cell wall content and/or composition
  misc_feature: Functional homolog of the protein sequence given in SEQ ID NO 13694
MASQLPRVCVTGGGGFIASWLVKLLLSRGYAVHATLRDPCMYLSIHNSRDPKNAHLKKLDRAPENLHLFKADVLDCETLTPAVQGCQGVFHLATPVPEDKILHPDVCSTLKVHKVVVMSSNAAVTSNPNWPQDRLKDESCWSDTEFCKEKEDWYSVAKTLAEQEASEYARNNGLNVVALCPPYVFGPLLQSSVNTSSKLLIYVIKGGPDVMTNRMWDVVDVRDVADALLLLYENDRSSGRYICSPNRVCTRDLVDLLKKMYPEYGYVNNVVDADHAGPPLSSQKLKDLGWEPRKLESTLSDSVQSYEKAGLLQGNPCRLPFLIRAWL

SEQ ID NO: 12227 - DNA, 831 bp, Sorghum bicolor
  misc_feature: Ceres ANNOT ID no. 6068433
  misc_feature: Encodes the peptide sequence at SEQ ID NO 12228
atgagcaaaggcccagttccatttgtcaacattgggaagagagcaaaagatctcctgtacaaggactacaactttgaccagaagttttctttgtcgacatctagcagctctggtttgaatctcacagccactggtgtgaagatcaatgaagacttcattggtgttatacggacacagcataaaagtggtagaactactgttgatgtcataattgatagtgattctaaagtgtcaaccacagtcactgttgatgaagcactaactggtttgaagacctcattcgccttcaaggttccagatcacaagtctggaaagcttgacctgcaatatgcccacaatcgtttttcattgaattcgaccattggtttgacatcaacacctttggttgagctggctgcaactgttggcacaagtgaacttaccattggtgctgaggtcgggtttgacagtacttcagctgctgttactaagtacaactcagggattggatacaacaagtccgatttttctgcttccttactacttgctgataaaggggagactttgaaggcatcttacattcatttgttcaatccaaccaatggagctacggtggcagctgaggtaacacacaagttcaaaaccaaggagaactatttcacagttgggagctcccatgcccttgatccttcaacattgctaaagacgcgattcagcaactccgggaaggtcggtcttctctgtcagcatgagtggaggccaaagtcccttgtgactctttcagcagagtatgatccaaaggtggtaagtgcgccttcaagaatcggagtggccatatctctcaagccttga

SEQ ID NO: 12228 - protein, 276 aa, Sorghum bicolor
  misc_feature: Ceres ANNOT ID no. 6068433
  misc_feature (4)..(269): Pfam Id: Porin_3 Pfam Desc: Eukaryotic porin
  misc_feature (1)..(276): NCBI GI: 36957233 NCBI Desc: vdac3.1 [lotus corniculatus var. japonicus]
  misc_feature (1)..(276): NCBI GI: 36957183 NCBI Desc: vdac1.2 [lotus corniculatus var. japonicus]
  misc_feature (1)..(276): NCBI GI: 36957170 NCBI Desc: vdac1.1 [lotus corniculatus var. japonicus]
  misc_feature (1)..(276): NCBI GI: 1724100 NCBI Desc: porin [mesembryanthemum crystallinum]
  misc_feature (1)..(276): NCBI GI: 67848430 NCBI Desc: mitochrondrial voltage-dependent anion-selective channel [phaseolus coccineus]
MSKGPVPFVNIGKRAKDLLYKDYNFDQKFSLSTSSSSGLNLTATGVKINEDFIGVIRTQHKSGRTTVDVIIDSDSKVSTTVTVDEALTGLKTSFAFKVPDHKSGKLDLQYAHNRFSLNSTIGLTSTPLVELAATVGTSELTIGAEVGFDSTSAAVTKYNSGIGYNKSDFSASLLLADKGETLKASYIHLFNPTNGATVAAEVTHKFKTKENYFTVGSSHALDPSTLLKTRFSNSGKVGLLCQHEWRPKSLVTLSAEYDPKVVSAPSRIGVAISLKP

SEQ ID NO: 12229 - DNA, 1308 bp, Sorghum bicolor
  misc_feature: Ceres ANNOT ID no. 6068452
  misc_feature: Encodes the peptide sequence at SEQ ID NO 12230
atgacgccgccctccatcttccaccaccaccaccgcctcctccccctcccctccgcttccccgactcaaattctaaacccattcgccgcctcgtcccgtcgcctcaaccatcatctcccgaaacccaaagtcctatccttacccccgcgtccagtcttctcctccgccttcgcggtcgccgccgttggcgatgacgaggatgttgtcgtcggggattgcctcgtgttcgatgacgacgctttcgaggaacaagacctggacatcctctcgtccccgccgccgccgactagcgcctcccgccaggactggagggcggaggccggcgagggagagagcctggtgccggagagatggagggatgccgaggaggagatcaacctgacgaagaaggagaagcgccgcatcgcgcacgggctgcgattcgggagccgcctcgagcggcgggcgcccccggccgttgccgcccctgatgaattccgcgcgtaccgcaaggggatgctgagcgcggagcgtgaacatgttgctcatgtataccgggggccgctggagagggctcttccgtcggaggtggaggaacctccacccccggagcctgggacgcgtgtgactccgaggaatccgaggatggggatggatgttggcagccttgaggacattgatgagttttttagaagtcgggagtatgttcaggatgagatggaggacagcaagagccccaagggccgtcataagttgttctcaaatgaggagaaggttcttctgaacaagcgagtgcctaatctggaagctgctacttctagtaaatggcttccgcttcacacccttgctgcatctggtgatttctatctattggatagccttttaaaacataatgtggacataaatgcggttgataaggatggcttgcctgcgattcacaaaccaattctttcaaagaaggctgctattatcaactatcttttaaggaactcagcaaatccattcatccaagataaagatggtgcaactctaatgcattatgctgtccaaacagcatgtagtcagaccataaagacacttttactgtacaatgttgacatcaaccgtccagatgattgtggatggacacctttgcatcttgctgtacaaacacagaggactgacattgtgaagctacttttaataaagggcgctgatagaactcttaaaacccaagatggattgaccccgttggagttgtgccttcgattgggtcatgatgtgcgggcgtatgagcttatcaaactacttaaaagcttccgaagacaaaagcagcatgatttagtttag

SEQ ID NO: 12230 - protein, 435 aa, Sorghum bicolor
  misc_feature: Ceres ANNOT ID no. 6068452
  misc_feature (333)..(365): Pfam Id: Ank Pfam Desc: Ankyrin repeat
  misc_feature (366)..(398): Pfam Id: Ank Pfam Desc: Ankyrin repeat
  misc_feature (10)..(426): NCBI GI: 24111371 NCBI Desc: at5g66060/k2a8_13 [arabidopsis thaliana]
  misc_feature (10)..(404): NCBI GI: 166744 NCBI Desc: ankyrin repeat-containing protein
  misc_feature (10)..(367): NCBI GI: 42573808 NCBI Desc: ankyrin repeat protein / akrp (akr) [arabidopsis thaliana]
  misc_feature (230)..(424): NCBI GI: 115467292 NCBI Desc: os06g0237000 [oryza sativa (japonica cultivar-group)]
  misc_feature (230)..(424): NCBI GI: 124359844 NCBI Desc: ankyrin [medicago truncatula]
  misc_feature: The sequence is a functional homolog of SEQ ID NO 1813 in the 10/374,780US patent application
  misc_feature: The sequence is a functional homolog of SEQ ID NO 1840 in the 10/374,780US patent application
  misc_feature: The sequence is a functional homolog of SEQ ID NO 1841 in the 10/374,780US patent application
  misc_feature: The sequence is a functional homolog of SEQ ID NO 1846 in the 10/374,780US patent application
  misc_feature: The sequence is a functional homolog of SEQ ID NO 198 in the 10/412,699US patent application
  misc_feature: Useful for making plants with modulated growth and phenotype characteristics
  misc_feature: The sequence is a functional homolog of SEQ ID NO 198 in the 20040045049 US patent application
  misc_feature: The sequence is a functional homolog of SEQ ID NO 1813 in the 20060162006 US patent application
  misc_feature: The sequence is a functional homolog of SEQ ID NO 1840 in the 20060162006 US patent application
  misc_feature: The sequence is a functional homolog of SEQ ID NO 1841 in the 20060162006 US patent application
MTPPSIFHHHHRLLPLPSASPTQILNPFAASSRRLNHHLPKPKVLSLPPRPVFSSAFAVAAVGDDEDVVVGDCLVFDDDAFEEQDLDILSSPPPPTSASRQDWRAEAGEGESLVPERWRDAEEEINLTKKEKRRIAHGLRFGSRLERRAPPAVAAPDEFRAYRKGMLSAEREHVAHVYRGPLERALPSEVEEPPPPEPGTRVTPRNPRMGMDVGSLEDIDEFFRSREYVQDEMEDSKSPKGRHKLFSNEEKVLLNKRVPNLEAATSSKWLPLHTLAASGDFYLLDSLLKHNVDINAVDKDGLPAIHKPILSKKAAIINYLLRNSANPFIQDKDGATLMHYAVQTACSQTIKTLLLYNVDINRPDDCGWTPLHLAVQTQRTDIVKLLLIKGADRTLKTQDGLTPLELCLRLGHDVRAYELIKLLKSFRRQKQHDLV

SEQ ID NO: 12231 - DNA, 1038 bp, Sorghum bicolor
  misc_feature: Ceres ANNOT ID no. 6068476
  misc_feature: Encodes the peptide sequence at SEQ ID NO 12232
atgacgccgctcgcagcccgtctggccgcaccggccgcgctgctgctgctcgtcctcctgctcccggcgccggcctcggccaccaacttcacctgcgcgacggtgggcaagatgtgccagtcagccatgggctacgcggtgccgaacgccaccacctacggcgagctggcgacccggttcaacaccacgacgacgctcgcggggctcctgggcgccaacggcctcctcgccacgacgccggcgtccacgccgctggcggccaagaccacggtgcgcgtcccgttcaggtgccggtgcgggagcaacggcgtggggcagtcggacgggggccccatctacgtggtgtacccgctggacgggctggaccacatcgcccgggatgtgttcgacgccttcgtcacctaccaggagatcgccaccgccaacaacatctccgacgtcaacctcatcgaggtggggcagaagctcaggatcccgctgccctgcacctgcgaccaggtggacggagccgacgtgatgcacttcgcgtacagcgtcgccaagggggatgacccgcccggcattgccgccaagttcggggtgaccgagagcacgctgctgagtttgaataagatcaccgaccccaagagcctgcagcaggggcagatcctggatgtccccctccctggtaagcctgctgattacaatctgctcgtcccgaatggcacctacgtgctcaccgccgacgactgcatccaatgcaaatgcagtgcaagcaactacgaacatccagtgcaaggcagaaggtgcccggctgtgccgacttgcagtggaggcctgacgctcgggcgaaacaacggcaccgattgcgcgtccaggatgtgcgtgtacagcggttataccaacaccacgtctctcgccatacataccagccttgtgcctgcaaatgagactgcgtgccagaagggaggagctgcgagatcggagtttgccgggtccatgtggaggacgtccgccatcgctttcctcatggcgctgatcctgatctgcttcctttga

SEQ ID NO: 12232 - protein, 345 aa, Sorghum bicolor
  misc_feature: Ceres ANNOT ID no. 6068476
  misc_feature (113)..(159): Pfam Id: LysM Pfam Desc: LysM domain
  misc_feature (177)..(220): Pfam Id: LysM Pfam Desc: LysM domain
  misc_feature (1)..(345): NCBI GI: 108860575 NCBI Desc: chitin elicitor binding protein [oryza sativa (japonica cultivar-group)]
  misc_feature (15)..(223): NCBI GI: 115485851 NCBI Desc: os11g0549300 [oryza sativa (japonica cultivar-group)]
  misc_feature (14)..(345): NCBI GI: 28207683 NCBI Desc: erwinia induced protein 1 [solanum tuberosum]
  misc_feature (4)..(343): NCBI GI: 115480519 NCBI Desc: os09g0548200 [oryza sativa (japonica cultivar-group)]
  misc_feature (13)..(343): NCBI GI: 52076021 NCBI Desc: peptidoglycan-binding lysm domain-containing protein -like [oryza sativa (japonica cultivar-group)]
MTPLAARLAAPAALLLLVLLLPAPASATNFTCATVGKMCQSAMGYAVPNATTYGELATRFNTTTTLAGLLGANGLLATTPASTPLAAKTTVRVPFRCRCGSNGVGQSDGGPIYVVYPLDGLDHIARDVFDAFVTYQEIATANNISDVNLIEVGQKLRIPLPCTCDQVDGADVMHFAYSVAKGDDPPGIAAKFGVTESTLLSLNKITDPKSLQQGQILDVPLPGKPADYNLLVPNGTYVLTADDCIQCKCSASNYEHPVQGRRCPAVPTCSGGLTLGRNNGTDCASRMCVYSGYTNTTSLAIHTSLVPANETACQKGGAARSEFAGSMWRTSAIAFLMALILICFL

SEQ ID NO: 12233 - DNA, 1926 bp, Sorghum bicolor
  misc_feature: Ceres ANNOT ID no. 6068514
  misc_feature: Encodes the peptide sequence at SEQ ID NO 12234
atggcgaagacccgcaagcctcctcccccgcccccgcccccgccccctcctcctccgccggcccccgaagaaacgtcatccccgcagcggcggcgcaagaagaagggccgcccgtccctcctcgacctccagcgccgcagcctccgcctgcaggcccaaaaccctagccccgccccctcgcccactcgccgggaccccaacccctccgacgacgatgaggatgggaccgggagcggggggcggaggcgtcagaagcgcctcaagagcgtcctctccggcgtcgtcgtcaaggaggagacgggggagggaaagaaggatgcagcgaaagcgacggggaaaggggacgctgcgtcggatggtgggcccacggggactcccctcccagacaaaaagttgctactcttcatcctcgataggctccagaagaaggatacttacggagttttctcggagcctgtcgacgcagaggagcttccggattactttgacatcattgagcaaccgatggacttctcaacaatccgtgagaagctgttgaatgactcgtattctaagttggaacagtttgaggatgatgtgtttctactcacatcaaatgccatgtcttacaattcagcagactcaatctacttccggcaggcacgatctattgaagctcttgccaaaaaggattttgagaacttgaggcaacccagcgatgaagaagaagaacccaagccaccagctcgaagaggtaggccaccgaagaatcccaggacagagggtgatgtgtcaccagatctatccaatgtgaaaacaaacaaaactgaagacaatgttgatacattcagaaaaaggtcaactggagacagaactcgaaatacaaataccccgatgaaagatccgtccagttttcacaatatgcttggttcttctagtgcaaaaagagcagacaaaatcggtgattattcaggttcatccaagtggggaaagaaacctgttgttaccctagatgacgaccgcaggagtacatatgatcagcactattcacgtaatagctctatgtttgctgccctggatgatgaaaggaaactactggtgccggtaggggttcagcagcaacatgcatatgctaggagcttggcacgatttgcatcaaaattgggcccagttggctgggatgtggcaacaaatcgtatcagaagggcactcccccctgggacaagttttggcccaggatgggtagtagatggtgaaccacctcaaaactctcagtgggctcctgtcgcatccaccaatccctctgagtgcactgctccacccaatatgccatctaagaatgatgttctacatcacaagtctggaccgtcttcaaatggggatgttactggtgagcagcatttacctagaactcaagcagtggcttctacatcagcaagctttgataagggccctgaaattcccaataaagtaaccaaacatgagaatggagtcaacaaggcatgtggtggtatggacaatacgggatcagcagcgcctccaatgcagcaacacagccacagccgagaaatccactctaacatcaatggctttactgctatgtcaaacaccatgagtcagtatgctgggcaagggttatttggatcaggcattcctatgacacatgctcaagtgcttgggatgttttctggaatgaatggcaaagtcaatggctataatatgcataggcagccagcaactgctgatagtcttaaaacaacagcacagaacggagatgttggaaaggcaactgtcaaccctgtgcaaggtgcaggtcatgatccaaagatcgcgaatgacaataattctgctcacccaagcttaaattctggtgtccagccatcaggttccccacctaggggaaagctggcaaatccaaagcaccccgatctggctttgcagctatga

SEQ ID NO: 12234 - protein, 641 aa, Sorghum bicolor
  misc_feature: Ceres ANNOT ID no. 6068514
  misc_feature (129)..(216): Pfam Id: Bromodomain Pfam Desc: Bromodomain
  misc_feature (92)..(641): NCBI GI: 115450513 NCBI Desc: os03g0130800 [oryza sativa (japonica cultivar-group)]
  misc_feature (63)..(346): NCBI GI: 15218005 NCBI Desc: dna-binding bromodomain-containing protein [arabidopsis thaliana]
  misc_feature (48)..(298): NCBI GI: 42572127 NCBI Desc: dna-binding bromodomain-containing protein [arabidopsis thaliana]
  misc_feature (60)..(298): NCBI GI: 42572125 NCBI Desc: dna-binding bromodomain-containing protein [arabidopsis thaliana]
  misc_feature (113)..(426): NCBI GI: 140046893 NCBI Desc: bromodomain [medicago truncatula]
MAKTRKPPPPPPPPPPPPPPAPEETSSPQRRRKKKGRPSLLDLQRRSLRLQAQNPSPAPSPTRRDPNPSDDDEDGTGSGGRRRQKRLKSVLSGVVVKEETGEGKKDAAKATGKGDAASDGGPTGTPLPDKKLLLFILDRLQKKDTYGVFSEPVDAEELPDYFDIIEQPMDFSTIREKLLNDSYSKLEQFEDDVFLLTSNAMSYNSADSIYFRQARSIEALAKKDFENLRQPSDEEEEPKPPARRGRPPKNPRTEGDVSPDLSNVKTNKTEDNVDTFRKRSTGDRTRNTNTPMKDPSSFHNMLGSSSAKRADKIGDYSGSSKWGKKPVVTLDDDRRSTYDQHYSRNSSMFAALDDERKLLVPVGVQQQHAYARSLARFASKLGPVGWDVATNRIRRALPPGTSFGPGWVVDGEPPQNSQWAPVASTNPSECTAPPNMPSKNDVLHHKSGPSSNGDVTGEQHLPRTQAVASTSASFDKGPEIPNKVTKHENGVNKACGGMDNTGSAAPPMQQHSHSREIHSNINGFTAMSNTMSQYAGQGLFGSGIPMTHAQVLGMFSGMNGKVNGYNMHRQPATADSLKTTAQNGDVGKATVNPVQGAGHDPKIANDNNSAHPSLNSGVQPSGSPPRGKLANPKHPDLALQL

SEQ ID NO: 12235 - DNA, 327 bp, Sorghum bicolor
  misc_feature: Ceres ANNOT ID no. 6068527
  misc_feature: Encodes the peptide sequence at SEQ ID NO 12236
atggaggcggcggcagcggcggccggcgtggagctcggctcctcgaagccccagatcgcgacgcaggcggagatggcggaggcccgggtgcccctcgcctaccgcgaccagtgcgcgcacctcctcatcccgctcaacaagtgccgcgtcgccgagttctacctcccctggaagtgcgaacccgagcgccacgcctacgagaagtgccagtacgagctcgtcatggagcggatgctccagatgcagaagatccgcgaggcgcaggagaccaaggtcaagggcggcgcctccattggcctcatcccggccaccgccaagctctcctga

SEQ ID NO: 12236 - protein, 108 aa, Sorghum bicolor
  misc_feature: Ceres ANNOT ID no. 6068527
  misc_feature (1)..(89): Pfam Id: NDUF_B7 Pfam Desc: NADH-ubiquinone oxidoreductase B18 subunit (NDUFB7)
  misc_feature (1)..(108): NCBI GI: 115450501 NCBI Desc: os03g0129900 [oryza sativa (japonica cultivar-group)]
  misc_feature (9)..(89): NCBI GI: 38048555 NCBI Desc: similar to drosophila melanogaster cg5548 [drosophila yakuba]
  misc_feature (9)..(89): NCBI GI: 24642084 NCBI Desc: cg5548-pa [drosophila melanogaster]
  misc_feature (19)..(89): NCBI GI: 54643926 NCBI Desc: ga18962-pa [drosophila pseudoobscura]
  misc_feature (17)..(78): NCBI GI: 34485504 NCBI Desc: nadh:ubiquinone oxidoreductase b18-like subunit [chlamydomonas reinhardtii]
MEAAAAAAGVELGSSKPQIATQAEMAEARVPLAYRDQCAHLLIPLNKCRVAEFYLPWKCEPERHAYEKCQYELVMERMLQMQKIREAQETKVKGGASIGLIPATAKLS

SEQ ID NO: 12237 - DNA, 1134 bp, Sorghum bicolor
  misc_feature: Ceres ANNOT ID no. 6068533
  misc_feature: Encodes the peptide sequence at SEQ ID NO 12238
atgggctcgcagcagcacgacgatgacaatggtggtcgccgtcgccgaccggaggcgaggtggtgcgcggtgaccggaggccgggggttcatggcgaggtacctggtggcggccttgctccgctccggtgagtggcgtgtccgggtcactgacctcgctcctactcttgttttcggccccggagagacggaggaaattctcagtgatgctctctgtaatggccgtgccacctatacctcggtcgatgtctgcaacctagatcaacttaccaaagcatttgaaggggtggatgttgttttccacacagctgctgcggatcctagtaagaacaacttgcaacttcactacaaggttaacgtagtgggaacgaagaatgtaattgaagcttgcaagatatgcaaggtgaaaaggcttatacacaccagtactagtgctgttgtgtttgacggtgttcatggactttttgacgtaaatgagtcattgccatatccagataagtttcctgatgcatatgcacaaacgaaggcagaagcagagaagttagtcatcaaggccaataacattaatgaccttctaacttgttgcttacgtccgggtagcatatttggcgcaggagacaagtttataacaactttggatcgttatggttggacaaatgttacaattggtgatgggaagaattatgatgattttgtgtatgttgaaaatgttgtacatggtcatctttgtgctgagaagactctttctactattgagggcgcaagaactagcggaggaaaagcatactttataactaatatggagccaatgaatatgtgggactttacatatcttgttcaagaagaacttggatacaaaagaatatccaagataaagatacctatagtttttatcaagcccgcaagctatttgatagagtggatatatagggttgttttctctcatttcggaacttgcgagcctcaaattctaacaccggcaagggttagatatgtgacactcaatagaacatttagttgtaataaagcttttgaagaacttggctacaaacctattgtgacactacaggacggtttaaggaaagcagtgaaattgtatattcaattaagtaataaagatttatctaagagatag

SEQ ID NO: 12238 - protein, 377 aa, Sorghum bicolor
  misc_feature: Ceres ANNOT ID no. 6068533
  misc_feature (23)..(295): Pfam Id: 3Beta_HSD Pfam Desc: 3-beta hydroxysteroid dehydrogenase/isomerase family
  misc_feature (22)..(265): Pfam Id: Epimerase Pfam Desc: NAD dependent epimerase/dehydratase family
  misc_feature (24)..(241): Pfam Id: NAD_binding_4 Pfam Desc: Male sterility protein
  misc_feature (20)..(376): NCBI GI: 18401656 NCBI Desc: 3-beta hydroxysteroid dehydrogenase/isomerase family protein [arabidopsis thaliana]
  misc_feature (20)..(376): NCBI GI: 63034416 NCBI Desc: 4alpha-carboxysterol-c3-dehydrogenase/c4-decarboxylase isoform 1-1 [arabidopsis thaliana]
  misc_feature (20)..(377): NCBI GI: 3075392 NCBI Desc: 3-beta-hydroxysteroid dehydrogenase [arabidopsis thaliana]
  misc_feature (20)..(377): NCBI GI: 42569340 NCBI Desc: 3-beta hydroxysteroid dehydrogenase/isomerase family protein [arabidopsis thaliana]
  misc_feature (27)..(300): NCBI GI: 110346532 NCBI Desc: sterol decarboxylase [nicotiana benthamiana]
MGSQQHDDDNGGRRRRPEARWCAVTGGRGFMARYLVAALLRSGEWRVRVTDLAPTLVFGPGETEEILSDALCNGRATYTSVDVCNLDQLTKAFEGVDVVFHTAAADPSKNNLQLHYKVNVVGTKNVIEACKICKVKRLIHTSTSAVVFDGVHGLFDVNESLPYPDKFPDAYAQTKAEAEKLVIKANNINDLLTCCLRPGSIFGAGDKFITTLDRYGWTNVTIGDGKNYDDFVYVENVVHGHLCAEKTLSTIEGARTSGGKAYFITNMEPMNMWDFTYLVQEELGYKRISKIKIPIVFIKPASYLIEWIYRVVFSHFGTCEPQILTPARVRYVTLNRTFSCNKAFEELGYKPIVTLQDGLRKAVKLYIQLSNKDLSKR

SEQ ID NO: 12239 - DNA, 729 bp, Sorghum bicolor
  misc_feature: Ceres ANNOT ID no. 6068633
  misc_feature: Encodes the peptide sequence at SEQ ID NO 12240
atggccacggccgtgcccgccgcgtccctccgcgcgccgtcctcctctccagcggccgccgcacgccgccttggggccggggccccgtcgctgcgcaagcggcattgcgccgtcgcgcccgtcgccgccgcctgtggccccgcgccgccgcggcagctcgacaacgaggaggcggcttgctccggacggcggcgggtgcttgtggccggtgccgccgcgttcctctcccggcctaatccggcggcattcgcagcagaggctaagaaaggtttcctgcctgtcgtcgacaagaaggctggctactccttcctctacccgttcggatgggaggaagtggctgtgcaagggcaagacaaggtgtacaaagatgtgatagagcctctggagagtgtgagcgtcaactctattccaactagcaaggaggatattcgtgatcttggacctccggataaggttgccgaagctttgataaaaaaagttctggcaccgccaacacagaagacaaagttaattgaggcgaaagagaatgatgttgatgggagagcttactacacttttgagttcacagctcaggctccaaactacaccagacatgcacttggtgctattgtgattgcaaatggtaaattttacacattgaccactggagcaaacgagagaagatgggaaaagatgaaggataggctgcatactgttgtcgattccttcaaaatcgaaaatagaatatga

SEQ ID NO: 12240 - protein, 242 aa, Sorghum bicolor
  misc_feature: Ceres ANNOT ID no. 6068633
  misc_feature (59)..(239): Pfam Id: PsbP Pfam Desc: PsbP
  misc_feature (2)..(241): NCBI GI: 38636895 NCBI Desc: oxygen evolving complex protein-like [oryza sativa (japonica cultivar-group)]
  misc_feature (43)..(240): NCBI GI: 74272685 NCBI Desc: chloroplast oxygen-evolving complex/thylakoid lumenal 25.6kda protein [chlamydomonas incerta]
  misc_feature (64)..(238): NCBI GI: 145348519 NCBI Desc: lumenal psbp-like protein [ostreococcus lucimarinus cce9901]
  misc_feature (63)..(238): NCBI GI: 119513527 NCBI Desc: photosystem ii oxygen evolving complex protein psbp [nodularia spumigena ccy9414]
  misc_feature (87)..(238): NCBI GI: 22299618 NCBI Desc: photosystem ii oxygen-evolving complex 23k protein psbp homolog [thermosynechococcus elongatus bp-1]
MATAVPAASLRAPSSSPAAAARRLGAGAPSLRKRHCAVAPVAAACGPAPPRQLDNEEAACSGRRRVLVAGAAAFLSRPNPAAFAAEAKKGFLPVVDKKAGYSFLYPFGWEEVAVQGQDKVYKDVIEPLESVSVNSIPTSKEDIRDLGPPDKVAEALIKKVLAPPTQKTKLIEAKENDVDGRAYYTFEFTAQAPNYTRHALGAIVIANGKFYTLTTGANERRWEKMKDRLHTVVDSFKIENRI

SEQ ID NO: 12241 - DNA, 351 bp, Sorghum bicolor
  misc_feature: Ceres ANNOT ID no. 6068675
  misc_feature: Encodes the peptide sequence at SEQ ID NO 12242
atggcgatggcgaggcggcagctgatggggtgggtgtcggcggcggcggacgcgacgtcgtggtgcgtggcgctgtcgctggtggcgatgctgctggtggtgtgcacgctgggcggcgccggcgatggtgccggtgctgcggagggcggcggcgtggtggtggtgcggggcgcggcgctgtcggcgcggccgtgcgaggagatctacgtggtggcggagggcgagacgctgcacagcatcagcgacaggtgcggcgaccccttcatcctggagcggaacccgcacgtgcacgaccccgacgacgtcttccccggcctcgtcatccggatcacgccgtccaagccaaggtag

SEQ ID NO: 12242 - protein, 116 aa, Sorghum bicolor
  misc_feature: Ceres ANNOT ID no. 6068675
  misc_feature (69)..(111): Pfam Id: LysM Pfam Desc: LysM domain
  misc_feature (2)..(114): NCBI GI: 116309923 NCBI Desc: osigba0147h17.4 [oryza sativa (indica cultivar-group)]
MAMARRQLMGWVSAAADATSWCVALSLVAMLLVVCTLGGAGDGAGAAEGGGVVVVRGAALSARPCEEIYVVAEGETLHSISDRCGDPFILERNPHVHDPDDVFPGLVIRITPSKPR

SEQ ID NO: 12243 - DNA, 795 bp, Sorghum bicolor
  misc_feature: Ceres ANNOT ID no. 6068692
  misc_feature: Encodes the peptide sequence at SEQ ID NO 12244
atggcggccaagtccgaggtctgcagctgggaaccgcacccgcttcaccccgacggcactgaaccgctgcagcagatcgccgtggactactgtccggaggcatgcctcgaagagcgccacgcgggcgagatccacgtcacctacgaccaccgcggcggcgcgcgctggcgctcccgccgccggttccgccccggcagcgccgtggccaccacgatccgcgcgccggcgggggacacttcgggcctcaactacaacatctacctgtcctccctggagggctccaaagaccaggacgagatcgacttcgagttcctcggccacgataagcgcgccgtccagaccaactaccacgtcaatggcgacggcgggcgggagcagatccacgcgctcccgttcgactcctccgacggcttccaccactacgccatcgcctgggacgcggccaccatcgagtggcgcgtcgacggcgagctcatccgccgcgaggagcggcgcgagggggagccgtggccggagaagcccatgtacctgtacgcctccgtgtgggacgccagctacatcgccgacgggaagtggaccggcacgtaccacggccgcgacgcgccctacgtctgcagctacaaggacgtcatggtgcccactgccaagcatttagtggaagaagacgaagagaatcaggatgcagatgccgctgatgcgcctgctgtcgatcctgcagccgacgctgatgctgcggcggcagcggcagcggcagcggcgggaaaagagaaggacgccggagccggtgaagtttag

SEQ ID NO: 12244 - protein, 264 aa, Sorghum bicolor
  misc_feature: Ceres ANNOT ID no. 6068692
  misc_feature (22)..(194): Pfam Id: Glyco_hydro_16 Pfam Desc: Glycosyl hydrolases family 16
  misc_feature (42)..(209): NCBI GI: 92874622 NCBI Desc: glycoside hydrolase, family 16; xyloglucan endo-transglycosylase, c-terminal [medicago truncatula]
  misc_feature (39)..(233): NCBI GI: 124109193 NCBI Desc: xyloglucan endotransglycosylase/hydrolase precursor xth-39 [populus tremula]
  misc_feature (45)..(212): NCBI GI: 13560781 NCBI Desc: endoxyloglucan transferase [daucus carota]
  misc_feature (42)..(209): NCBI GI: 17402583 NCBI Desc: xyloglucan endo-transglycosylase [vitis labrusca x vitis vinifera]
  misc_feature (46)..(208): NCBI GI: 563235 NCBI Desc: xyloglucan endo-transglycosylase homolog; similar to triticum aestivum endo-xyloglucan transferase, pir accession number e49539
  misc_feature: The sequence is a functional homolog of SEQ ID NO. 381 in the 11/188,298 US application
MAAKSEVCSWEPHPLHPDGTEPLQQIAVDYCPEACLEERHAGEIHVTYDHRGGARWRSRRRFRPGSAVATTIRAPAGDTSGLNYNIYLSSLEGSKDQDEIDFEFLGHDKRAVQTNYHVNGDGGREQIHALPFDSSDGFHHYAIAWDAATIEWRVDGELIRREERREGEPWPEKPMYLYASVWDASYIADGKWTGTYHGRDAPYVCSYKDVMVPTAKHLVEEDEENQDADAADAPAVDPAADADAAAAAAAAAAGKEKDAGAGEV

SEQ ID NO: 12245 - DNA, 1053 bp, Sorghum bicolor
  misc_feature: Ceres ANNOT ID no. 6068762
  misc_feature: Encodes the peptide sequence at SEQ ID NO 12246
atgggcgtcaagcaggtcctcgtccgcccccgctacggcgacgacgacgacggcagcagctgcagcaccggcagcagcagcagcgccggccgatgcgacgacgaggcgctcgaccagtcgccgtcgccgccgcccatgtcgtcctgcggacgctacctcctccaccgcgtctgcaggttcgacacactcgccggcgtcgccatcaagtacggcgtcgaggtggcggacgtgaagcgcgccaacggcctcaccaccgacctgcagatgttcgcgcacaagacgctgcgggtcccgctccacgggaggcacgcgcccgccaccgcgccatctcctccctcctcttccccgagccacgccgatcgcgccgccagagaatggactacacgccgccctcccaaaattgctgcttccttggacccattccttaaaccaccacggagcacagtttcgcagtctatgagccttctgcaggggtactatggccttacaccaactcctaaggagaacctgaccaatgaaggcactgaaatggcggcatacgctaaaggtcaccataggaaagctcgaagcttatcaagcaacttctctcttgaaaatggagatggcactagggagatggatgatgctgaaaagcccataaggcggcgccagaaaaccgatggtgaggtgacagctagggaggacaatggcggtagcatgttggcgaggtctgggcaaggcttggcccttaggccaaaatctggcagtcgaccagatatgaatggcagccagcaagacctcttggccacgtgggtgccgtcatatggggatgggttgcacgctgtgaagaaatcatcgagcactccagagttccaagattcagacagcatcagcattgcctcggtatggctgaagagcaagtggaacttgaaaccggatgctttcaccctcacgcttcctctcccgctgttcgacggcatctccaagcctctcttcgacagcatcccgaagcctctcctggacaacattccgaactcgatcgctgcttggaggaacaaggcggccaaagattag

SEQ ID NO: 12246 - protein, 350 aa, Sorghum bicolor
  misc_feature: Ceres ANNOT ID no. 6068762
  misc_feature (55)..(98): Pfam Id: LysM Pfam Desc: LysM domain
  misc_feature (40)..(277): NCBI GI: 115450233 NCBI Desc: os03g0110600 [oryza sativa (japonica cultivar-group)]
MGVKQVLVRPRYGDDDDGSSCSTGSSSSAGRCDDEALDQSPSPPPMSSCGRYLLHRVCRFDTLAGVAIKYGVEVADVKRANGLTTDLQMFAHKTLRVPLHGRHAPATAPSPPSSSPSHADRAAREWTTRRPPKIAASLDPFLKPPRSTVSQSMSLLQGYYGLTPTPKENLTNEGTEMAAYAKGHHRKARSLSSNFSLENGDGTREMDDAEKPIRRRQKTDGEVTAREDNGGSMLARSGQGLALRPKSGSRPDMNGSQQDLLATWVPSYGDGLHAVKKSSSTPEFQDSDSISIASVWLKSKWNLKPDAFTLTLPLPLFDGISKPLFDSIPKPLLDNIPNSIAAWRNKAAKD

SEQ ID NO: 12247 - DNA, 1299 bp, Sorghum bicolor
  misc_feature: Ceres ANNOT ID no. 6068773
  misc_feature: Encodes the peptide sequence at SEQ ID NO 12248
atgagctgttccgcggccgtctccaacggcattgcgccgcgcttcctcatctgcgcgcgcggggtgctcgctctcggttcccacagccacaggagtagtagtaggagggcgaggcgcaggcacgcagtggtcttcgcgaggacgaggcggcagcgacggcggcggcccagcgagtggcagcggccgtggtggaggaccttctttgctgactggaacgaggacgaggagagcctggccgggctcagggaggacgacgagctgctggaggcgattggggccaacccggagctgtcggagaacgaaaagttccaggagtggaggaggaaggccgaggccattgttgagctgcgcgaggcccagcaggatgccatgaacgccgaggcgcggtcgtgggaggattggaccagtggtgccgtctccggcgccggcggcgcgtcggggaatggaggtggaggtggggactggggcggggaggagagcttgttggacgagataactgatgatcctgcggagatcgtgtgggataagggcgttattgaggctttcagagataccgttgatgaggattatgaggacatgctcttcgaagatcgagtctttatgtatgcctccacaaactcggccaagtttctagcattgttgattgtggttccgtgggtgatagattttgcagtccatcactatgttatgatgcccttcttagacaggtatgtcgagaaggtgccacttgcagctgaattacttgatgtaaggcgcagccagaagctgcacatggttaaagacctaaacatggaaaaagcaagataccgtcttgaagtagagattggcaaatctcctccactttctgatgaggaggtctggtttgagctgcgggaaaaagcgatagagttgagggatgattggaggctagaaaatcgagaagcttttgcaaatatatggtccgatatggtttatgggattgttctattccttcttctctgcttcaaccagagcaaagttgcgatgctgaagttcacaggatataagttgctaaataacatttcagacactgggaaggcctttcttattattctaatatcagacatccttctagggtaccattcagagtcaggttggcatacaatggtagaagttgttctcgagcattacgggcttgaatctgatgaagcggcggtcacattttttgtttgtctggttccagttgctttggatgtgtacataaagttttgggtatacaaataccttccaagattatcacccagtgtgggcaacgttctggatgaaataaagcgccattag

SEQ ID NO: 12248 - protein, 432 aa, Sorghum bicolor
  misc_feature: Ceres ANNOT ID no. 6068773
  misc_feature (199)..(431): Pfam Id: CemA Pfam Desc: CemA family
  misc_feature (180)..(421): NCBI GI: 3603000 NCBI Desc: heme binding protein cema [guillardia theta]
  misc_feature (158)..(421): NCBI GI: 81299800 NCBI Desc: cytoplasmic membrane protein [synechococcus elongatus pcc 7942]
  misc_feature (158)..(421): NCBI GI: 56750562 NCBI Desc: cytoplasmic membrane protein [synechococcus elongatus pcc 6301]
  misc_feature (85)..(421): NCBI GI: 119483463 NCBI Desc: proton extrusion protein pcxa [lyngbya sp. pcc 8106]
  misc_feature (191)..(421): NCBI GI: 5880731 NCBI Desc: chloroplast envelope membrane protein [nephroselmis olivacea]
MSCSAAVSNGIAPRFLICARGVLALGSHSHRSSSRRARRRHAVVFARTRRQRRRRPSEWQRPWWRTFFADWNEDEESLAGLREDDELLEAIGANPELSENEKFQEWRRKAEAIVELREAQQDAMNAEARSWEDWTSGAVSGAGGASGNGGGGGDWGGEESLLDEITDDPAEIVWDKGVIEAFRDTVDEDYEDMLFEDRVFMYASTNSAKFLALLIVVPWVIDFAVHHYVMMPFLDRYVEKVPLAAELLDVRRSQKLHMVKDLNMEKARYRLEVEIGKSPPLSDEEVWFELREKAIELRDDWRLENREAFANIWSDMVYGIVLFLLLCFNQSKVAMLKFTGYKLLNNISDTGKAFLIILISDILLGYHSESGWHTMVEVVLEHYGLESDEAAVTFFVCLVPVALDVYIKFWVYKYLPRLSPSVGNVLDEIKRH

SEQ ID NO: 12249 - DNA, 1002 bp, Sorghum bicolor
  misc_feature: Ceres ANNOT ID no. 6068809
  misc_feature: Encodes the peptide sequence at SEQ ID NO 12250
atgtcggagagcgagttagcagtaataaaaccagaggcgttgaagacttatatttggcttcagtgctttgatggttccatacagcaagtggaggaggaggttgcgatgttttgccccatgatatgtcgggaaattgtgaaaaatggcacagggtcatccaaaaatcatgctattgctctcccggaaagagttaatccaaccagtttgagtttgattcttgactattgtcggtttcatcaggttgctgggcgctcaaacaaggagcgcaagtcctttgatgaaaagtttgttaggatagaaacagaaagactctgtgaattgacttctgcagctgacagtctacagttaaagccacttgttgatcttactagtcgagcacttgctcgaatcattgaaggaaagacacctgaggaaattcgtgacattttccatttaccagatgacttaacagaggaagagaaattggagcccctaaaaaatataaatgatgatcctaggatacgcctattgaaccgattgtacgcgaagaagcggaaagagctccaggagcgccaccagcgccagaagctgaagggtgttcaagtacaaaaagagcaaaaagatgagagatctttggatgagttactttgttttattaatggggatggaggtgggaaagctaccaagagtaagaaaaagaataaaagaaggaaggatcatgctaagaaccctccgaaagctgactctgagcctttaaatgcggagggagctgcttgtgtggttccgtgcaaagtggatagcagtaatgtttctagacttccatgccagaatccagatgtgcaagatgatgtcgagtacccctttgaagatgctgacctcgatgatggacttgatcctgcaatgaaagaagagcttgatagagaagtcgaggactttgcaaggaggttgaattcagtttggaatgagtcacatattggtggtaatggttctgtgcagagatttcctgggtttaatcacaggtga

SEQ ID NO: 12250 - protein, 333 aa, Sorghum bicolor
  misc_feature: Ceres ANNOT ID no. 6068809
  misc_feature (90)..(164): Pfam Id: Skp1 Pfam Desc: Skp1 family, dimerisation domain
  misc_feature (1)..(329): NCBI GI: 42569956 NCBI Desc: skp1 family protein [arabidopsis thaliana]
  misc_feature (1)..(329): NCBI GI: 145331413 NCBI Desc: ask20 (arabidopsis skp1-like 20) [arabidopsis thaliana]
  misc_feature (1)..(315): NCBI GI: 144923915 NCBI Desc: skp1 component [medicago truncatula]
  misc_feature (1)..(300): NCBI GI: 124359727 NCBI Desc: skp1 component [medicago truncatula]
  misc_feature (18)..(156): NCBI GI: 62467589 NCBI Desc: skp1 [capsicum annuum]
MSESELAVIKPEALKTYIWLQCFDGSIQQVEEEVAMFCPMICREIVKNGTGSSKNHAIALPERVNPTSLSLILDYCRFHQVAGRSNKERKSFDEKFVRIETERLCELTSAADSLQLKPLVDLTSRALARIIEGKTPEEIRDIFHLPDDLTEEEKLEPLKNINDDPRIRLLNRLYAKKRKELQERHQRQKLKGVQVQKEQKDERSLDELLCFINGDGGGKATKSKKKNKRRKDHAKNPPKADSEPLNAEGAACVVPCKVDSSNVSRLPCQNPDVQDDVEYPFEDADLDDGLDPAMKEELDREVEDFARRLNSVWNESHIGGNGSVQRFPGFNHR

SEQ ID NO: 12251 - DNA, 2139 bp, Sorghum bicolor
  misc_feature: Ceres ANNOT ID no. 6068859
  misc_feature: Encodes the peptide sequence at SEQ ID NO 12252
atgcggcgggcgagggatttgcatccgctgtgctgcctccccgccgccgacgacgacggcggatcccctccgcctccgccgccgtccctggccgggctgctctacaagtggaccaacatcggcaagggctggcgcccgcgctggttcgccatccgcggcgccatcctcacttactccaagatcccacgctgctcctcctccgccgccgcccattacggccaggaccgccccgtcgtcggcctcgtgcacctcaagatctcctcattccgtgaaagcaagtcagatgacaggcggttctacataattactccaaccaagacactgcagctgagaacagactgtgctaatgaacgagtggcttggattgaagcccttgtttctgctcgagctgaatcttctccagattggggtttattgtgtaaccagaatgatgcatcattttctaccgagagacttagaaatcgcatgcatgaagaagggcttcgtgaggacataattaaagattgtgaacagatcgtccattctgaattctcacagtatcacacacagatgaaacaacgttgtgaagaatatgtaagctttatcagaagtcttccaaggcagcttgaggtacttaatgcagatgataatgctaatatgattgagctccgctcgcacttggtgaagcctgaatattccagctctggacagggaaaatgcagtgagagcagcaatacagaatcttctgatgatgttgggcaacaggagttggatgaacttttggatgacgatgactatcatttttatgatacaaggcagagtttcagtgattcagtaacaatttcttgcttgaagatgaaaggttcaaattctggcaaggataactttctttatggtgataaatttgtgaaatcaaaggctggtatggctaacagtgagtgcatgtcgccgtttttcaagcgacgcacgaagttgcctgatccagttgagaaggaaaagggtgttagtctttggtcaatgatcaaggataatgtcggaagagatcttacacgagtatgtctgcctgtttactttaacgaaccattatcatctcttcaaaaatgctttgaagatttggagtattcttatttgttggatcgtgcatatgaatgtggcctaaagggggacagtttgatgagaattcttaaggttgctgcatttgcggtttctgggtatgcttcctcggatgggcgtccctgcaaacctttcaatccattgttaggggaaacctatgaagctgattactctgaaaatggaatccgtttcttctctgaaaaggttagccatcatccaatggtcatggcttgtcattgtgaaggaaaaggctggaaattttggggagacagcaatgtaaagagcaagttctgggggcaaacaatccagctggatcctgttggtgtgttaactctagaatttgatgatggagaaactttccagtggagtaaggttacaacaacaattaataaccttatcatcggcagagtttattgtaatcaccatggcacgatgaatataaccggtaacaggggatattcatgcaagctgatattcaaacaacaatctttccttgagcgcagccctcggcaggttcaaggattcgttaaggatgttgatggttccaatgttgcgaccctaatgggaaagtgggacgagagcatgtactgcaccatcgctaacgatgcacccagagtaaactgcagtgcatcaggccagaatgcagatgcgactctgttgtgggagaaaaatgaaccttcaacttatcccactcgctataacctttcatcgttcgcgatcactctgaacgagttgactccagaactcaaggagagacttccaccaacggattcaagactcagaccagatcagcgacatgtagagaacggggagtatggtaaggccaatgctgagaagctgcgactggagacgaggcaacgaatgtcacggaagatgcaggacagtggttggaaaccaagatggttccggagggatggcagcgacgggacattccgctatgtcggaggttactgggaggcaagagagcaggcgaaatgggatggatgctatgatatatttggtgaagtctccgacagcagcccaaggcatgcagcacagcaacgttga

SEQ ID NO: 12252 - protein, 712 aa, Sorghum bicolor
  misc_feature: Ceres ANNOT ID no. 6068859
  misc_feature (294)..(687): Pfam Id: Oxysterol_BP Pfam Desc: Oxysterol-binding protein
  misc_feature (28)..(130): Pfam Id: PH Pfam Desc: PH domain
  misc_feature (76)..(702): NCBI GI: 22654958 NCBI Desc: at4g08180/t12g13_20 [arabidopsis thaliana]
  misc_feature (76)..(702): NCBI GI: 42570131 NCBI Desc: oxysterol-binding family protein [arabidopsis thaliana]
  misc_feature (76)..(702): NCBI GI: 42572843 NCBI Desc: oxysterol-binding family protein [arabidopsis thaliana]
  misc_feature (74)..(702): NCBI GI: 140054118 NCBI Desc: oxysterol-binding protein; pleckstrin-like [medicago truncatula]
  misc_feature (65)..(704): NCBI GI: 78440948 NCBI Desc: oxysterol-binding related protein 1 [petunia integrifolia]
MRRARDLHPLCCLPAADDDGGSPPPPPPSLAGLLYKWTNIGKGWRPRWFAIRGAILTYSKIPRCSSSAAAHYGQDRPVVGLVHLKISSFRESKSDDRRFYIITPTKTLQLRTDCANERVAWIEALVSARAESSPDWGLLCNQNDASFSTERLRNRMHEEGLREDIIKDCEQIVHSEFSQYHTQMKQRCEEYVSFIRSLPRQLEVLNADDNANMIELRSHLVKPEYSSSGQGKCSESSNTESSDDVGQQELDELLDDDDYHFYDTRQSFSDSVTISCLKMKGSNSGKDNFLYGDKFVKSKAGMANSECMSPFFKRRTKLPDPVEKEKGVSLWSMIKDNVGRDLTRVCLPVYFNEPLSSLQKCFEDLEYSYLLDRAYECGLKGDSLMRILKVAAFAVSGYASSDGRPCKPFNPLLGETYEADYSENGIRFFSEKVSHHPMVMACHCEGKGWKFWGDSNVKSKFWGQTIQLDPVGVLTLEFDDGETFQWSKVTTTINNLIIGRVYCNHHGTMNITGNRGYSCKLIFKQQSFLERSPRQVQGFVKDVDGSNVATLMGKWDESMYCTIANDAPRVNCSASGQNADATLLWEKNEPSTYPTRYNLSSFAITLNELTPELKERLPPTDSRLRPDQRHVENGEYGKANAEKLRLETRQRMSRKMQDSGWKPRWFRRDGSDGTFRYVGGYWEAREQAKWDGCYDIFGEVSDSSPRHAAQQR

SEQ ID NO: 12253 - DNA, 798 bp, Sorghum bicolor
  misc_feature: Ceres ANNOT ID no. 6068888
  misc_feature: Encodes the peptide sequence at SEQ ID NO 12254
atgcagcgggtcgtcgtcatgcgccacggcgatcgcctcgaccactccgagcctatgtggccagccaacaagccgtggccctgggacccgccgctcgacgacgccggactcctccgcgcctggaccgtcgggaagtgcatcagggccgccgccgccaagcagggatgggccctccaccgggtcctcgtctccccgttcctgcgatgccgacagaccgccgcgcgggcggtcgccgcgctatgcgccgtccccgacgacgacgcgctgctcgcggtcggcgacccggacaatgtgcccctcgacacctcacgcatcaaggtgtctatcgagtatggattgtctgagatgatgaacactcaagcaatgggtgttattgttagcaagctagcttccagcatcaacaagtggttccctgacttaccagagctcgaagccgacttcccggctggaaccatcgaccattctgcagaaccaatctacccggaggtaccgaagtgggaggaatctgtcatggaggcaagaagcagatatgcaagcatcatcaaggctcttgctgacaaatatcctcatgaaaacctgctcttagtaacacacggtgagggtgttggtgcatcggtgtcttactttgagatgggactagagatctacgacgtggaatactgtgcttactctgttctggagaggcaggtgtctgcggagcttgatgatgagcatgggggctttaccgcggatagcttcaaggtgctgacaaagagtggcagcacaggcatccgatacgcctcggtgtcagagggctag

SEQ ID NO: 12254 - protein, 265 aa, Sorghum bicolor
  misc_feature: Ceres ANNOT ID no. 6068888
  misc_feature (3)..(205): Pfam Id: PGAM Pfam Desc: Phosphoglycerate mutase family
  misc_feature (2)..(260): NCBI GI: 21553703 NCBI Desc: prib5 protein [arabidopsis thaliana]
  misc_feature (28)..(259): NCBI GI: 3378491 NCBI Desc: prib5 protein [ribes nigrum]
  misc_feature (2)..(84): NCBI GI: 126658848 NCBI Desc: phosphoglycerate/bisphosphoglycerate mutase [cyanothece sp. ccy0110]
  misc_feature (1)..(73): NCBI GI: 83757683 NCBI Desc: phosphoglycerate mutase family protein [salinibacter ruber]
  misc_feature (2)..(73): NCBI GI: 113475773 NCBI Desc: phosphoglycerate mutase [trichodesmium erythraeum ims101]
  misc_feature: Useful for making plants with modulated nitrogen use efficiency
  misc_feature: Functional homolog of the protein sequence given in SEQ ID NO 13078
MQRVVVMRHGDRLDHSEPMWPANKPWPWDPPLDDAGLLRAWTVGKCIRAAAAKQGWALHRVLVSPFLRCRQTAARAVAALCAVPDDDALLAVGDPDNVPLDTSRIKVSIEYGLSEMMNTQAMGVIVSKLASSINKWFPDLPELEADFPAGTIDHSAEPIYPEVPKWEESVMEARSRYASIIKALADKYPHENLLLVTHGEGVGASVSYFEMGLEIYDVEYCAYSVLERQVSAELDDEHGGFTADSFKVLTKSGSTGIRYASVSEG

SEQ ID NO: 12255 - DNA, 639 bp, Sorghum bicolor
  misc_feature: Ceres ANNOT ID no. 6072064
  misc_feature: Encodes the peptide sequence at SEQ ID NO 12256
atggccgccacatccgtcaaggtcgcgcgcctcaccaccctcgcgctcttctctccgtctccaaccccctccggtccgaagtccaccaagcgcagagctagggccccaccacccatctccatctccatggatccggccctcgtggacccagcccacctccaggcccttatgctcgcctgcgcccacaactgcgcgctccgcctctcgccggcgctatcagtttccgctgtcgagccggtcgacctcagcaagctacggactgcacttgcgcacagcttcatcgtcgtatctgtcttctgcggcgctaggttcttgacagacgacagggaaggggagggggagggacagagattcttgggcttggagctcgggctcgagcgtcagggggagcggcggcttgtcgggtttgggcgcgccgtctccgacctcgggctcaccgcatccgtccatgacatcgtgaggagaggaattggccgaaagatagtgaacaaaattacaagggtacttcatagcagaggtatatatgacatctctgcattatgtacagaaaaggagaggcccttttttgaagcttgtggatttggtgatgatatgatgggttcaacaacaatgttgtatactagaaaatcacacaaatag

SEQ ID NO: 12256 - protein, 212 aa, Sorghum bicolor
  misc_feature: Ceres ANNOT ID no. 6072064
  misc_feature (1)..(153): NCBI GI: 115464889 NCBI Desc: os05g0516300 [oryza sativa (japonica cultivar-group)]
  misc_feature (118)..(206): NCBI GI: 86607997 NCBI Desc: acetyltransferase, gnat family [cyanobacteria bacterium yellowstone b-prime]
  misc_feature (118)..(206): NCBI GI: 86606814 NCBI Desc: acetyltransferase, gnat family [cyanobacteria bacterium yellowstone a-prime]
  misc_feature (118)..(206): NCBI GI: 113475326 NCBI Desc: gcn5-related n-acetyltransferase [trichodesmium erythraeum ims101]
  misc_feature (129)..(205): NCBI GI: 86608795 NCBI Desc: acetyltransferase, gnat family [cyanobacteria bacterium yellowstone b-prime]
MAATSVKVARLTTLALFSPSPTPSGPKSTKRRARAPPPISISMDPALVDPAHLQALMLACAHNCALRLSPALSVSAVEPVDLSKLRTALAHSFIVVSVFCGARFLTDDREGEGEGQRFLGLELGLERQGERRLVGFGRAVSDLGLTASVHDIVRRGIGRKIVNKITRVLHSRGIYDISALCTEKERPFFEACGFGDDMMGSTTMLYTRKSHK

SEQ ID NO: 12257 - DNA, 1428 bp, Sorghum bicolor
  misc_feature: Ceres ANNOT ID no. 6073354
  misc_feature: Encodes the peptide sequence at SEQ ID NO 12258
atggaggcggcgtcgccggacctgtcgctgcacatcagcctgcccagcagcgcctcggggcccggcccgtccggcggcgggcgcgccgccgtggggggagcgggaggaggaggaggaggaggcgctgggggaggagacccgtggcggagactgaacgggtcgacggcgtccacggagctgtccctgtcgccgccggccgagcaggagcacgcggacgcgctgccgtggcgacaccggccgtcggcggcggcggcggcggccgtgtcctcctccgcggccaccacgtcggtggggggcgccgcgctgatgatgcccgccgccatgccgatgccgatgctgcagccgctggacggtgggggcgggctagccggctccggcggagggggcgcgtcggtggcgccgcctatccgagggatacctatctacagcggcccggggggattcccgttcctgccgccggcaaccggggcagacggcggccccctccaccaccaccaccaacagcaacagcagcagaagctcgggttctacggctcgtaccacccgagcacgtggccgtcgtcgctcggctccacgtcgccgtcgccgtcgccgctcgcgccgggcacgccgccgccgtccacgctggaccccgcgtcggcgttcctgtcgtccccggccgcgcaccaccaccaccaccggatgctgtcggcatcgggcaggctcaacggcatgctcacggacaccctccgcggctacggcggtagcggcgtggtcggtggcctgggcggcatcccgttcggcctgggctcccggttcatgcccaagctccccgccaagcgcagcatgcgcgcgccgcgcatgcggtggaccagcacgctccacgcccgcttcgtgcacgccgtcgagctcctcggaggccacgagagggctacgcccaagtcggtgctggagctcatggacgtgaaggatctgaccctagcgcacgtcaagagccatctccagatgtatcggaccgtgaagagcactgacaagcctgcggcgtcatcaggcgggaacgacggcggctccggcgacgaggacttccccggcgccggccaggcagcctccggcggcgagaacaacatgtgcgtgaggacgttcggggagcaccaccagcggtccacctccgagggcgcggcgagctcggtgggtggcggcggcggcgacatggaccagtcttcggcgggcaacaccagcaccaggtggagcaactcgtccagggacccatggctgtcgtcgaattcatgcaacatggacgctcatcgtttggcagggttgtcttctccaattgagaacgcggagccttgccgatcgagcagctcgcaggtgtcaaaccacgagctgagcagcccgagcctggagttcacgcttgggagaccggactggcagggcacggatcatgactag

SEQ ID NO: 12258 - protein, 475 aa, Sorghum bicolor
  misc_feature: Ceres ANNOT ID no. 6073354
  misc_feature (280)..(331): Pfam Id: Myb_DNA-binding Pfam Desc: Myb-like DNA-binding domain
  misc_feature (13)..(438): NCBI GI: 115479007 NCBI Desc: os09g0395300 [oryza sativa (japonica cultivar-group)]
  misc_feature (138)..(465): NCBI GI: 82754247 NCBI Desc: kanadi1-like protein [zea mays]
  misc_feature (138)..(465): NCBI GI: 82754249 NCBI Desc: kanadi1-like protein [zea mays]
  misc_feature (23)..(423): NCBI GI: 29837235 NCBI Desc: myb family transcription factor-like [oryza sativa (japonica cultivar-group)]
  misc_feature (135)..(475): NCBI GI: 84778270 NCBI Desc: kanadi-like transcription factor feathered [ipomoea nil]
  misc_feature: The sequence is a functional homolog of SEQ ID NO 1108 in the 11/479,226US patent application
  misc_feature: The sequence is a functional homolog of SEQ ID NO 116 in the 10/286,264US patent application
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1459 in the 11/479,226US patent application
  misc_feature: The sequence is a functional homolog of SEQ ID NO 1857 in the 10/374,780US patent application
  misc_feature: The sequence is a functional homolog of SEQ ID NO 2056 in the 10/374,780US patent application
  misc_feature: The sequence is a functional homolog of SEQ ID NO 208 in the 10/374,780US patent application
  misc_feature: The sequence is a functional homolog of SEQ ID NO 482 in the 10/412,699US patent application
  misc_feature: The sequence is a functional homolog of SEQ ID NO 590 in the 10/225,066US patent application
  misc_feature: Useful for making plants with altered Lignin content
  misc_feature: Useful for making plants with altered alkaloid content
  misc_feature: Useful for making plants with modulated growth and phenotype characteristics
  misc_feature: Functional homolog of the protein sequence given in SEQ ID NO 12899
  misc_feature: The sequence is a functional homolog of SEQ ID NO 116 in the 20030093837 US patent application
  misc_feature: The sequence is a functional homolog of SEQ ID NO 590 in the 20050160493 US patent application
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MEAASPDLSLHISLPSSASGPGPSGGGRAAVGGAGGGGGGGAGGGDPWRRLNGSTASTELSLSPPAEQEHADALPWRHRPSAAAAAAVSSSAATTSVGGAALMMPAAMPMPMLQPLDGGGGLAGSGGGGASVAPPIRGIPIYSGPGGFPFLPPATGADGGPLHHHHQQQQQQKLGFYGSYHPSTWPSSLGSTSPSPSPLAPGTPPPSTLDPASAFLSSPAAHHHHHRMLSASGRLNGMLTDTLRGYGGSGVVGGLGGIPFGLGSRFMPKLPAKRSMRAPRMRWTSTLHARFVHAVELLGGHERATPKSVLELMDVKDLTLAHVKSHLQMYRTVKSTDKPAASSGGNDGGSGDEDFPGAGQAASGGENNMCVRTFGEHHQRSTSEGAASSVGGGGGDMDQSSAGNTSTRWSNSSRDPWLSSNSCNMDAHRLAGLSSPIENAEPCRSSSSQVSNHELSSPSLEFTLGRPDWQGTDHD

SEQ ID NO: 12259 - DNA, 321 bp, Sorghum bicolor
  misc_feature: Ceres ANNOT ID no. 6073497
  misc_feature: Encodes the peptide sequence at SEQ ID NO 12260
atggaggagaggaggcgtcgccgctcgccgtgccacggcggccgccgccgccggcggcgtgcggtggagatggcgctggggcgcaaggttcgcgagctgcggcggctggtgcccggcgccgccgcgatgcctgccgagcgcctgctcctccgtaccgccgactacatcgtgcgcctccgggcgaaggtcgagctcctcagggcggtctcggagctcatcgccgtcaccaacctggtgggacgattatcgtcggcggtggcggccatcacgacggtaacttatcggcaacttagcgagctaagatggtgcatgaagaattga

SEQ ID NO: 12260 - protein, 106 aa, Sorghum bicolor
  misc_feature: Ceres ANNOT ID no. 6073497
  misc_feature (7)..(72): NCBI GI: 115476414 NCBI Desc: os08g0414500 [oryza sativa (japonica cultivar-group)]
  misc_feature (29)..(74): NCBI GI: 38345201 NCBI Desc: osjnba0015k02.11 [oryza sativa (japonica cultivar-group)]
  misc_feature (33)..(74): NCBI GI: 116310033 NCBI Desc: h0112g12.1 [oryza sativa (indica cultivar-group)]
  misc_feature: The sequence is a functional homolog of SEQ ID NO 368 in the 10/666,642US patent application
  misc_feature: Useful for making plants with modulated growth and phenotype characteristics
  misc_feature: Useful for making plants with modulated low light sensitivity
  misc_feature: Functional homolog of the protein sequence given in SEQ ID NO 12994
  misc_feature: The sequence is a functional homolog of SEQ ID NO 368 in the 20070033671 US patent application
MEERRRRRSPCHGGRRRRRRAVEMALGRKVRELRRLVPGAAAMPAERLLLRTADYIVRLRAKVELLRAVSELIAVTNLVGRLSSAVAAITTVTYRQLSELRWCMKN

SEQ ID NO: 12261 - DNA, 1089 bp, Sorghum bicolor
  misc_feature: Ceres ANNOT ID no. 6073665
  misc_feature: Encodes the peptide sequence at SEQ ID NO 12262
atgccccgcgccgctacgggcgcgatcgccgcggcgttcctgcgagcgcaggccccgcacatggcgccgccggcgtcgcgcatcgcgcgcgcgttccccggcctcgccaccgccgccgcgacgcgcttcgctccctcctcgttcgcgtcctcgccgcggcttgctctccacccgcgcctccgatccgcgcgctccttctacagcggcgtcgcccgtgcgtcttccggtggcggcaccgtttctggctccttgacgtcggaggaggaccagcggctgcagtccgagctcatcttcctcggcacgggcaccagtgagggcatcccgcgcgtcagttgcctcacccatcccaccaagacttgccccgtttgtagcaaggcggctgagccagggaacccgaataggaggcgcaacacctctatccttctgcgccacgccaccccgtctggcaccaccaacatcgttgttgatgccggcaatttgaggacgatcgatggtgtcattattacccattctcatgctgatgccattggagggcttgactgtcttcgtgattggacgaacaatgttcagtcatcaattccaatttatgtggcagaacgtgattatgaggtgatgaagatgacccactattatctgatcgacacaagtgtagttatacctggagcggcagtttcagcattgcaattcaacattataaaagaggaaccatttatggttcacaatcttgaggtgattcctttacctgtttggcacggtcagggttaccgctcgcttggttttcgtttcggtgatgtatgctatataagtgatgtcagtgatatacctgaagaaacatacaagcttctggaaaactgtgaacttcttataatggatgctctaagacctgatcgttcttcatcaacacactttggactaccaagggcccttgaggaagttaggaaaatcaaaccaaagaaaacactctttactggaatgatgcatttgatggaccatgagaaagtaaacagtgatcttgccaggctgatggaaacagagggtcttgatatccagcttagttatgacggtctcagcatacctgtaaggctctag

SEQ ID NO: 12262 - protein, 362 aa, Sorghum bicolor
  misc_feature: Ceres ANNOT ID no. 6073665
  misc_feature (136)..(325): Pfam Id: Lactamase_B Pfam Desc: Metallo-beta-lactamase superfamily
  misc_feature (4)..(360): NCBI GI: 115478803 NCBI Desc: os09g0363800 [oryza sativa (japonica cultivar-group)]
  misc_feature (88)..(362): NCBI GI: 50726197 NCBI Desc: hydrolase-like protein [oryza sativa (japonica cultivar-group)]
  misc_feature (35)..(362): NCBI GI: 92870467 NCBI Desc: beta-lactamase-like [medicago truncatula]
  misc_feature (62)..(362): NCBI GI: 42564134 NCBI Desc: metallo-beta-lactamase family protein [arabidopsis thaliana]
  misc_feature (83)..(362): NCBI GI: 9294602 NCBI Desc: hydrolase-like protein [arabidopsis thaliana]
MPRAATGAIAAAFLRAQAPHMAPPASRIARAFPGLATAAATRFAPSSFASSPRLALHPRLRSARSFYSGVARASSGGGTVSGSLTSEEDQRLQSELIFLGTGTSEGIPRVSCLTHPTKTCPVCSKAAEPGNPNRRRNTSILLRHATPSGTTNIVVDAGNLRTIDGVIITHSHADAIGGLDCLRDWTNNVQSSIPIYVAERDYEVMKMTHYYLIDTSVVIPGAAVSALQFNIIKEEPFMVHNLEVIPLPVWHGQGYRSLGFRFGDVCYISDVSDIPEETYKLLENCELLIMDALRPDRSSSTHFGLPRALEEVRKIKPKKTLFTGMMHLMDHEKVNSDLARLMETEGLDIQLSYDGLSIPVRL

SEQ ID NO: 12263 - DNA, 1047 bp, Sorghum bicolor
  misc_feature: Ceres ANNOT ID no. 6074408
  misc_feature: Encodes the peptide sequence at SEQ ID NO 12264
atgtggaggctaaagatcggagagggaggagggccatggatgcagacggtgagtgacttccatggccggcaggtttgggagttcgacccggatgccggcacctacgaggagcgcagcaaggtggagcagcttcgccggaggttcacagagaaccgcttccgaaggagggaaccgcaggacctcctcatgcgtatgcagttcactggagaagaacatctgcatgccgatatgcccccggccaccaagatagaggatggcgacgaggtgacgccagaaattttgcaggagtcgctgaggcgagcgctgggttggatgtctgctctccaagctgaagatggtcactggcctggtgattacagcgggattatgtacctgctgccgttctggattttcgccctgcacatcacaggatcgatcgatgctgtcctgtcgaaagagcatatacgtgagatatgccgccatatctacaaccatcagaacgaggacggcggatggggtttcaatattttggacgagagcgctatgttttccacgtgcttgaactacaccaccttgaggcttctcggtgaggtgcaaaaggaggaaaacgatggactagctaaaggtcgagcatggatcctatcccatggaactgcaactgcagcaccacagtgggcaaagatactactctcggttattggtgtatatgattggcgtggcaataatccagttgtgcctgaactatggttggtaccacgtttcctcccaattcacccagggcggttctggtgcttcactaggattacttacatgtcaatagctttcctttatggcaaaaaatttgttggtcccattacaccaactatattagcactaagggatgaactctacagttcgccgtatgatcaaattgattggaataaagctcgtaattcttgtgccaaggtttgtcactgtcctttcttgagccttaatcattactatagctataaatattttaaactgtgtaatgtcatttgtacaaatttcttacttgaaggacatgaaatatacgcaatgtcaggatga

SEQ ID NO: 12264 - protein, 348 aa, Sorghum bicolor
  misc_feature: Ceres ANNOT ID no. 6074408
  misc_feature (146)..(189): Pfam Id: Prenyltrans Pfam Desc: Prenyltransferase and squalene oxidase repeat
  misc_feature (1)..(313): NCBI GI: 47834397 NCBI Desc: beta-amyrin synthase [avena prostrata]
  misc_feature (1)..(313): NCBI GI: 15866696 NCBI Desc: beta-amyrin synthase [avena strigosa]
  misc_feature (1)..(313): NCBI GI: 47834395 NCBI Desc: beta-amyrin synthase [avena longiglumis]
  misc_feature (1)..(313): NCBI GI: 47834393 NCBI Desc: beta-amyrin synthase [avena longiglumis]
  misc_feature (1)..(313): NCBI GI: 47834401 NCBI Desc: beta-amyrin synthase [avena ventricosa]
  misc_feature (1)..(308): SWISSPROT Homolog: EC 5.4.99.8 Cycloartenol synthase
  misc_feature: The sequence is a functional homolog of SEQ ID NO 15 in US patent 7186884
  misc_feature: The sequence is a functional homolog of SEQ ID NO 6 in US patent 7122717
  misc_feature: The sequence is a functional homolog of SEQ ID NO. 343 in the 11/188,298 US application
MWRLKIGEGGGPWMQTVSDFHGRQVWEFDPDAGTYEERSKVEQLRRRFTENRFRRREPQDLLMRMQFTGEEHLHADMPPATKIEDGDEVTPEILQESLRRALGWMSALQAEDGHWPGDYSGIMYLLPFWIFALHITGSIDAVLSKEHIREICRHIYNHQNEDGGWGFNILDESAMFSTCLNYTTLRLLGEVQKEENDGLAKGRAWILSHGTATAAPQWAKILLSVIGVYDWRGNNPVVPELWLVPRFLPIHPGRFWCFTRITYMSIAFLYGKKFVGPITPTILALRDELYSSPYDQIDWNKARNSCAKVCHCPFLSLNHYYSYKYFKLCNVICTNFLLEGHEIYAMSG

SEQ ID NO: 12265 - DNA, 1287 bp, Sorghum bicolor
  misc_feature: Ceres ANNOT ID no. 6074428
  misc_feature: Encodes the peptide sequence at SEQ ID NO 12266
atggcggacaaggagaacgcaggtcccgcggcggggcctcggctcacgcgggccgcggcgaagcgcgctgcggcggcggcggtggcggtggcggcggagggtcccggtgacgccaagcggaggcgggtggcgctcggggagctaccggccctcgccaacaacgccgccgctggcctccgcgcgccgtctcgccccgccaagccctcgaagcccgcgtccaggtccgggaggcacgcgaggcccggcgcgtcggaggcccgcgggcccgccgttgccgccgccgccgccgaggccgagctctgcgcgtcctcctccccgccgcgcgccgccgaggccgacgccgagtccaactccgcctcctactccgcgccgcgtgccaccgccgacaccgactcctccttttcctcctcgccgccgcgcgccgccgcggcggcggcggcggcgcccgccgacctccagttctgcgggtcttacgcctccgacatctacacctacctccgctccctggaggtggagccgcagcggcggtccagatccgactacatcgaggcggtccaggcggacgttacggcccacatgcggagcatcctcgttgactggctcgtcgaggtcgccgaggagtataagctcgttgcggacacgctctacctcgccatctcctatgtcgatcgcttcctctctgtcaatgcgcttggccgagacaagctgcagctccttggcgttgcgtccatgctcattgctgcgaagtacgaggagatcagcccgcctcatcctgaggacttctgctacatcacagacaacacctacaccaaagaggagctcctcaagatggagagcgacatactcaagctcctcaagttcgagttgggcaatcctaccatcaagaccttcctgaggcggttcacaagatatgctcatgaagacaagaagcgctccatcttgttaatggaattcttggggagctacctcgctgagttgagtctactagattatggctgtctccggttcttgccgtcggtagttgctgcttcagttatgtttgttgctaggctgaccattgatccaaatgtcaatccttggaacacgaagctgcagaagatgactggctacaaagtttctgacctcaaggattgcattgtagccatacatgacttgcagctcaacaggaaatgtccatcattaatggcaattcgagacaagtacaagcaacacaagttcaaatgtgtgtcaacgcttcttccccctgttgtgatccctgcttcatactttgaagacttagatgagtag

SEQ ID NO: 12266 - protein, 428 aa, Sorghum bicolor
  misc_feature: Ceres ANNOT ID no. 6074428
  misc_feature (161)..(290): Pfam Id: Cyclin_N Pfam Desc: Cyclin, N-terminal domain
  misc_feature (292)..(419): Pfam Id: Cyclin_C Pfam Desc: Cyclin, C-terminal domain
  misc_feature (151)..(426): NCBI GI: 2190259 NCBI Desc: a-type cyclin [catharanthus roseus]
  misc_feature (151)..(426): NCBI GI: 1064931 NCBI Desc: cyclin a-like protein [nicotiana tabacum]
  misc_feature (84)..(424): NCBI GI: 7242793 NCBI Desc: cyclin a3.1 [pisum sativum]
  misc_feature (153)..(425): NCBI GI: 857393 NCBI Desc: mitotic cyclin a1-type [glycine max]
  misc_feature (140)..(425): NCBI GI: 2196455 NCBI Desc: a-type cyclin [nicotiana tabacum]
  misc_feature: Useful for making plants with modulated nitrogen use efficiency
  misc_feature: Useful for making plants with modulated nitrogen use efficiency
  misc_feature: GREAT-hit functional homolog of the protein sequence given in SEQ ID NO 13108
  misc_feature: Functional homolog of the protein sequence given in SEQ ID NO 13132
  misc_feature: Useful for making plants with modulated nitrogen use efficiency
  misc_feature: Functional homolog of the protein sequence given in SEQ ID NO 13108
  misc_feature: Useful for making plants with modulated oxidative stress sensitivity
  misc_feature: Functional homolog of the protein sequence given in SEQ ID NO 13710
  misc_feature: The sequence is a functional homolog of SEQ ID NO. 336 in the 11/188,298 US application
  misc_feature: The sequence is a functional homolog of SEQ ID NO. 511 in the 11/188,298 US application
MADKENAGPAAGPRLTRAAAKRAAAAAVAVAAEGPGDAKRRRVALGELPALANNAAAGLRAPSRPAKPSKPASRSGRHARPGASEARGPAVAAAAAEAELCASSSPPRAAEADAESNSASYSAPRATADTDSSFSSSPPRAAAAAAAAPADLQFCGSYASDIYTYLRSLEVEPQRRSRSDYIEAVQADVTAHMRSILVDWLVEVAEEYKLVADTLYLAISYVDRFLSVNALGRDKLQLLGVASMLIAAKYEEISPPHPEDFCYITDNTYTKEELLKMESDILKLLKFELGNPTIKTFLRRFTRYAHEDKKRSILLMEFLGSYLAELSLLDYGCLRFLPSVVAASVMFVARLTIDPNVNPWNTKLQKMTGYKVSDLKDCIVAIHDLQLNRKCPSLMAIRDKYKQHKFKCVSTLLPPVVIPASYFEDLDE

SEQ ID NO: 12267 - DNA, 834 bp, Sorghum bicolor
  misc_feature: Ceres ANNOT ID no. 6074441
  misc_feature: Encodes the peptide sequence at SEQ ID NO 12268
atgccgtcgccggcgccgccgagaggcagaggggacgacgtcgtggtggtggtggggggggctgcagctgcagcggatgatcaggtcgccaccacgagcggcggcggcggcacggcggcagaggaggaggaggatgtcaacgccgtggtgcagcaggaggagcatggccaccaagggttggcgaagcggaagaagcgctccaggcgccgccgcgaccgggagcagcagcagccccccacccctacccagacacaggaggagtacctggcgcagtgcctcgtcatgctggccaccggccgccgcgaccgcgacgtcccggcgcccgcgccgccgcaggaccacgcgtgctccgtctgcggcaaggtgttcccgacgtaccaggcgctcggcggccacaaggccagccaccgcaccaagccctcgccggcgccgacgacgcctggcgtaggagatggggatcaccaccacgatgaggaggagaagaagccgcccgtgctgccgtcctcgtcgtcggctggttccgccgacaccaagcccgctgccccggcggcgacgcacgagtgcaacgtgtgcggcaaggcgttcccgacggggcaggcgctgggcggccacaagcgccgccactacgacggtaccatcggcagcgccgccgcacccgcgcgcgcgtcctcctcctctgcggccaccagcagccgcaacacggcgccgccgccggcggtcgccttcgacctcaacctgccggcgctgccggagcgatgcgccgtggcggaggacgacgaggtgctcagcccgctcgccttcaagaagcctcgcttcatgatcatcccggcttaa

SEQ ID NO: 12268 - protein, 277 aa, Sorghum bicolor
  misc_feature: Ceres ANNOT ID no. 6074441
  misc_feature (58)..(277): NCBI GI: 28849865 NCBI Desc: zinc finger transcription factor zfp2 [oryza sativa (japonica cultivar-group)]
  misc_feature (46)..(273): NCBI GI: 485816 NCBI Desc: zinc-finger protein wzf1 [triticum aestivum]
  misc_feature (53)..(273): NCBI GI: 12698882 NCBI Desc: zinc finger transcription factor zf1 [oryza sativa]
  misc_feature (65)..(276): NCBI GI: 71979887 NCBI Desc: cys2-his2 type zinc finger protein [nicotiana tabacum]
  misc_feature (65)..(276): NCBI GI: 33771374 NCBI Desc: zinc finger protein pif1 [nicotiana benthamiana]
  misc_feature: The plant flowers significantly late compared to wild-type.
  misc_feature: The plant is abnormally small.
  misc_feature: The sequence is a functional homolog of SEQ ID NO 1013 in the 10/666,642US patent application
  misc_feature: The sequence is a functional homolog of SEQ ID NO 104 in the 10/374,780US patent application
  misc_feature: The sequence is a functional homolog of SEQ ID NO 1092 in the 10/666,642US patent application
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1212 in the 10/412,699US patent application
  misc_feature: The sequence is a functional homolog of SEQ ID NO 1213 in the 10/412,699US patent application
  misc_feature: The sequence is a functional homolog of SEQ ID NO 1214 in the 10/412,699US patent application
  misc_feature: The sequence is a functional homolog of SEQ ID NO 1215 in the 10/412,699US patent application
  misc_feature: The sequence is a functional homolog of SEQ ID NO 1288 in the 10/666,642US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 1292 in the 10/666,642US patent application
  misc_feature: The sequence is a functional homolog of SEQ ID NO 155 in the 11/479,226US patent application
  misc_feature: The sequence is a functional homolog of SEQ ID NO 2 in the 10/374,780US patent application
  misc_feature: The sequence is a functional homolog of SEQ ID NO 2216 in the 10/374,780US patent application
  misc_feature: The sequence is a functional homolog of SEQ ID NO 34 in the 10/412,699US patent application
  misc_feature: The sequence is a functional homolog of SEQ ID NO 346 in the 10/412,699US patent application
  misc_feature: The sequence is a functional homolog of SEQ ID NO 426 in the 11/435,388US patent application
  misc_feature: The sequence is a functional homolog of SEQ ID NO 464 in the 11/435,388US patent application
  misc_feature: The sequence is a functional homolog of SEQ ID NO 52 in the 10/903,236US patent application
  misc_feature: The sequence is a functional homolog of SEQ ID NO 58 in the 10/225,068US patent application
  misc_feature: The sequence is a functional homolog of SEQ ID NO 622 in the 10/374,780US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 626 in the 10/374,780US patent application
  misc_feature: The sequence is a functional homolog of SEQ ID NO 780 in the 10/225,066US patent application
  misc_feature: The sequence is a functional homolog of SEQ ID NO 813 in the 11/479,226US patent application
  misc_feature: The sequence is a functional homolog of SEQ ID NO 830 in the 10/666,642US patent application
  misc_feature: The sequence is a functional homolog of SEQ ID NO 831 in the 10/666,642US patent application
  misc_feature: The sequence is a functional homolog of SEQ ID NO 903 in the 10/374,780US patent application
  misc_feature: The sequence is a functional homolog of SEQ ID NO 904 in the 10/374,780US patent application
  misc_feature: The sequence is a functional homolog of SEQ ID NO 905 in the 10/374,780US patent application
  misc_feature: The sequence is a functional homolog of SEQ ID NO 906 in the 10/374,780US patent application
  misc_feature: The sequence is a functional homolog of SEQ ID NO 907 in the 10/374,780US patent application
  misc_feature: Useful for making plants with altered Lignin content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 13179
  misc_feature: Functional homolog of the protein sequence given in SEQ ID NO 13281
  misc_feature: The sequence is a functional homolog of SEQ ID NO 12 in the 20040045049 US patent application
  misc_feature: The sequence is a functional homolog of SEQ ID NO 1212 in the 20040045049 US patent application
  misc_feature: The sequence is a functional homolog of SEQ ID NO 1213 in the 20040045049 US patent application
  misc_feature: The sequence is a functional homolog of SEQ ID NO 1214 in the 20040045049 US patent application
  misc_feature: The sequence is a functional homolog of SEQ ID NO 1215 in the 20040045049 US patent application
  misc_feature: The sequence is a functional homolog of SEQ ID NO 34 in the 20040045049 US patent application
  misc_feature: The sequence is a functional homolog of SEQ ID NO 346 in the 20040045049 US patent application
  misc_feature: The sequence is a functional homolog of SEQ ID NO 622 in the 20060162006 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 626 in the 20060162006 US patent application
  misc_feature: The sequence is a functional homolog of SEQ ID NO 907 in the 20060162006 US patent application
  misc_feature: The sequence is a functional homolog of SEQ ID NO 1013 in the 20070033671 US patent application
  misc_feature: The sequence is a functional homolog of SEQ ID NO 1092 in the 20070033671 US patent application
  misc_feature: The sequence is a functional homolog of SEQ ID NO 830 in the 20070033671 US patent application
  misc_feature: The sequence is a functional homolog of SEQ ID NO 831 in the 20070033671 US patent application
  misc_feature: Functional homolog of the protein sequence given in SEQ ID NO 13580
  misc_feature: The sequence is a functional homolog of SEQ ID NO. 457 in the 11/188,298 US application
  misc_feature: The sequence is a functional homolog of SEQ ID NO. 351 in the 11/188,298 US application
MPSPAPPRGRGDDVVVVVGGAAAAADDQVATTSGGGGTAAEEEEDVNAVVQQEEHGHQGLAKRKKRSRRRRDREQQQPPTPTQTQEEYLAQCLVMLATGRRDRDVPAPAPPQDHACSVCGKVFPTYQALGGHKASHRTKPSPAPTTPGVGDGDHHHDEEEKKPPVLPSSSSAGSADTKPAAPAATHECNVCGKAFPTGQALGGHKRRHYDGTIGSAAAPARASSSSAATSSRNTAPPPAVAFDLNLPALPERCAVAEDDEVLSPLAFKKPRFMIIPA

SEQ ID NO: 12269 - DNA, 915 bp, Sorghum bicolor
  misc_feature: Ceres ANNOT ID no. 6074550
  misc_feature: Encodes the peptide sequence at SEQ ID NO 12270
atggttgaaaaggggtgtgagaggtgcaaggagtggcaggagcactactactgggagcacatggatgtcagcaagatccgcttcttcaagcgcatgacaggagattttgctcatcgcactagcataccggagaagtttgtgaagaaattcaatgggcagatcaccgaaggtgttgacatgaaaacacccagtggtgaaacatggcacgttggtgtagccaagaatcaggatgaactattcttcgtgtctggatgggaggactttgtcaaggcacatgaactgaaggagaatgacctccttctcttcacatgcagaggcagctcttcctttcaggtggtcatctttgaagggagtggctgtgagaaagtgtcttctgtttttggaaacagatttgggaaacaacctgaatctccaaacagtaatagtgactatgatgtcaagcaacaaggaacccgtgaagaggatagtgatagtgacaacgaatacactgacttcaagtactactactcgaggactgccaatcgactgagcaatgacgaaaaaagtaaaataatcagtttggcttcgatccaacctgacaatcctgcgtttattactgtcctacagatgaccaatgtccgccctaggaacaactctctgaccatccccagacaatttgctgctgatcatcttgaggagagatcacaagagatcatacttcgtaggccaaacaggaaagacaagtggtatgtcaggtactattacacgacagccatccgaagccttaaaagctaccactggtccaagtttgtgcgcgaaaacaagcttcgcgagggtgacatctgcgtcttcgaactgatgaaaggcgcaaagagggttactatgagtgttcacgtcatcaagaaggttgaaaaccggtttgttctgttaggataa

SEQ ID NO: 12270 - protein, 304 aa, Sorghum bicolor
  misc_feature: Ceres ANNOT ID no. 6074550
  misc_feature (27)..(120): Pfam Id: B3 Pfam Desc: B3 DNA binding domain
  misc_feature (198)..(294): Pfam Id: B3 Pfam Desc: B3 DNA binding domain
  misc_feature (2)..(158): NCBI GI: 20145851 NCBI Desc: auxin response factor 36 [arabidopsis thaliana]
  misc_feature (10)..(142): NCBI GI: 140069091 NCBI Desc: hmg-i and hmg-y, dna-binding; transcriptional factor b3; cupredoxin [medicago truncatula]
  misc_feature (4)..(146): NCBI GI: 92872624 NCBI Desc: transcriptional factor b3; cupredoxin [medicago truncatula]
  misc_feature (10)..(133): NCBI GI: 144924216 NCBI Desc: transcriptional factor b3; cupredoxin [medicago truncatula]
  misc_feature (10)..(132): NCBI GI: 140069092 NCBI Desc: transcriptional factor b3; cupredoxin [medicago truncatula]
  misc_feature: The sequence is a functional homolog of SEQ ID NO. 467 in the 11/188,298 US application
MVEKGCERCKEWQEHYYWEHMDVSKIRFFKRMTGDFAHRTSIPEKFVKKFNGQITEGVDMKTPSGETWHVGVAKNQDELFFVSGWEDFVKAHELKENDLLLFTCRGSSSFQVVIFEGSGCEKVSSVFGNRFGKQPESPNSNSDYDVKQQGTREEDSDSDNEYTDFKYYYSRTANRLSNDEKSKIISLASIQPDNPAFITVLQMTNVRPRNNSLTIPRQFAADHLEERSQEIILRRPNRKDKWYVRYYYTTAIRSLKSYHWSKFVRENKLREGDICVFELMKGAKRVTMSVHVIKKVENRFVLLG

SEQ ID NO: 12271 - DNA, 945 bp, Sorghum bicolor
  misc_feature: Ceres ANNOT ID no. 6074554
  misc_feature: Encodes the peptide sequence at SEQ ID NO 12272
atggccccccatctgaggtgtgagagctgcaggaagtggcaagagcactgctaccaggagcacatggcgagggagagggtgagtttcttcaagcccatgacaggagattttgcgcagggcattagcataccggagaagtttgttagcaatctaaatgggcagatcaccaaagtgttcaacctgaaagcacccagtggcgaaacatggcttgtcaatgtcacaaagaatgccgatgagctgctcttcaagtcaggatgggatgattttgccagagcacatgagctccaagagaatgaccttgtgatcttcacgtgcagtggcaactgctcctttgatgtcctgatcttggactcgagtggctgtgaaaaggtgtcttgtttcttcaccactaagaagggtccttgcatgcacaagcattttaatgggaaagagcctgaatctccaatcaatagcaattactatatcaagcaagaggcgattagcggtgaagagcagagtgacgaagactggcttgccgatcccagctactactactcaaagtctgccaacatcctaactggtggtgaacgggatcaaatatccagtttggctttgattcaaccaggcaatccagcatttgtggctgtcctgcataagacccatgttgggtacaagaacaacatgctgaccatccaccatggatttgcagcagagcaccttgaggagagatcccatgagatcctgctcctcaggccaaacaggaaagagaagtggtatgtcaagtactactacgccagccacaccagaggctttcactgctgccgctgggtcaagttcgtccgcgataacaggctgcgaaaggaccacatctgcgtctttgagctgatgaaaggcgccaagaggacgacgatggttgtccatgtcctcaggaaggttgataatggaaggattgtgctggtggcctaa

SEQ ID NO: 12272 - protein, 314 aa, Sorghum bicolor
  misc_feature: Ceres ANNOT ID no. 6074554
  misc_feature (28)..(121): Pfam Id: B3 Pfam Desc: B3 DNA binding domain
  misc_feature (205)..(307): Pfam Id: B3 Pfam Desc: B3 DNA binding domain
  misc_feature (7)..(152): NCBI GI: 20145851 NCBI Desc: auxin response factor 36 [arabidopsis thaliana]
  misc_feature (8)..(173): NCBI GI: 140069091 NCBI Desc: hmg-i and hmg-y, dna-binding; transcriptional factor b3; cupredoxin [medicago truncatula]
  misc_feature (6)..(157): NCBI GI: 144924215 NCBI Desc: transcriptional factor b3; cupredoxin [medicago truncatula]
  misc_feature (5)..(157): NCBI GI: 140069093 NCBI Desc: hmg-i and hmg-y, dna-binding; transcriptional factor b3; cupredoxin [medicago truncatula]
  misc_feature (11)..(137): NCBI GI: 144924216 NCBI Desc: transcriptional factor b3; cupredoxin [medicago truncatula]
  misc_feature: Useful for making plants with modulated drought sensitivity
  misc_feature: Useful for making plants with modulated flowering time
  misc_feature: Functional homolog of the protein sequence given in SEQ ID NO 13423
  misc_feature: Functional homolog of the protein sequence given in SEQ ID NO 13426
  misc_feature: The sequence is a functional homolog of SEQ ID NO. 467 in the 11/188,298 US application
MAPHLRCESCRKWQEHCYQEHMARERVSFFKPMTGDFAQGISIPEKFVSNLNGQITKVFNLKAPSGETWLVNVTKNADELLFKSGWDDFARAHELQENDLVIFTCSGNCSFDVLILDSSGCEKVSCFFTTKKGPCMHKHFNGKEPESPINSNYYIKQEAISGEEQSDEDWLADPSYYYSKSANILTGGERDQISSLALIQPGNPAFVAVLHKTHVGYKNNMLTIHHGFAAEHLEERSHEILLLRPNRKEKWYVKYYYASHTRGFHCCRWVKFVRDNRLRKDHICVFELMKGAKRTTMVVHVLRKVDNGRIVLVA

SEQ ID NO: 12273 - DNA, 651 bp, Sorghum bicolor
  misc_feature: Ceres ANNOT ID no. 6074556
  misc_feature: Encodes the peptide sequence at SEQ ID NO 12274
atgagcacgaccggcagtgcaggtgtgccgacgacgacgacacctcctgatctctccctccacatcagcccaccgtcgccaccggcaggcggcgtcaagatgccgccggagccgaggctgatgctggggctggagctcgacgacgacgacaccatggcggcggcctcaaagaaggtggacgacgcggcggcggtgaacgagcacaacctccaggtgcagcggctccggctgcaccaccagccgagccagacggcccacgggttcaagaagaactcgcctggcggcggcggcggcgcgaggagaagttccagggcgccgcggatgcggtggaccaccgcgctgcacgcgcacttcgtgcacgccgtcgagctccttggcggccacgagagagcaacaccaaagtcagtattggaactgatgaacgtgaaggatcttacactagcacatatgtacagaacagtgaagggcacagacagatcatgtgtagcaggccctggtcatcaccaagccagagacatggtccttctcagaactggtgttggtgaaggggatggctttgatgttttcaacagcaacaactcagtcaacaccatccctaccttcaacaacaatactgataggtttgcattgctgcatttcttctcagattaa

SEQ ID NO: 12274 - protein, 216 aa, Sorghum bicolor
  misc_feature: Ceres ANNOT ID no. 6074556
  misc_feature (65)..(167): NCBI GI: 140069101 NCBI Desc: homeodomain-related [medicago truncatula]
  misc_feature (99)..(165): NCBI GI: 29837235 NCBI Desc: myb family transcription factor-like [oryza sativa (japonica cultivar-group)]
  misc_feature (99)..(203): NCBI GI: 41053208 NCBI Desc: myb family transcription factor-like [oryza sativa (japonica cultivar-group)]
  misc_feature (78)..(185): NCBI GI: 84778270 NCBI Desc: kanadi-like transcription factor feathered [ipomoea nil]
  misc_feature (99)..(187): NCBI GI: 115479007 NCBI Desc: os09g0395300 [oryza sativa (japonica cultivar-group)]
  misc_feature: The sequence is a functional homolog of SEQ ID NO 1108 in the 11/479,226US patent application
  misc_feature: The sequence is a functional homolog of SEQ ID NO 116 in the 10/286,264US patent application
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 2056 in the 10/374,780US patent application
  misc_feature: The sequence is a functional homolog of SEQ ID NO 482 in the 10/412,699US patent application
  misc_feature: Useful for making plants with modulated growth and phenotype characteristics
  misc_feature: The sequence is a functional homolog of SEQ ID NO 116 in the 20030093837 US patent application
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: Useful for making plants with altered alkaloid content
  misc_feature: Useful for making plants with altered lignin content
  misc_feature: Functional homolog of the protein sequence given in SEQ ID NO 12899
MSTTGSAGVPTTTTPPDLSLHISPPSPPAGGVKMPPEPRLMLGLELDDDDTMAAASKKVDDAAAVNEHNLQVQRLRLHHQPSQTAHGFKKNSPGGGGGARRSSRAPRMRWTTALHAHFVHAVELLGGHERATPKSVLELMNVKDLTLAHMYRTVKGTDRSCVAGPGHHQARDMVLLRTGVGEGDGFDVFNSNNSVNTIPTFNNNTDRFALLHFFSD

SEQ ID NO: 12275 - DNA, 1284 bp, Sorghum bicolor
  misc_feature: Ceres ANNOT ID no. 6074577
  misc_feature: Encodes the peptide sequence at SEQ ID NO 12276
atgaagggcgcgaccatcccctcggtcgcgatcatgccctcgccgctcttcctctggcggtttaaggttgtgttgtttcttctctggggcttatgttgttgcaagataagttgggactcagttatgagaatgagtgttgatctcagagacttatttctttacgaggctttcttgtactataatcctcttcttcttgtggccttgatgatttggttgtggggagtaaatctatgggtctttgcacaatcatctgtgaattatgcaaaagtgtttgatcttgcacaaacacatttatctcaccgagagatatggaggtgtgctacttggctgactttaattgtccctactagcatgacagcctacctatatctgtactcacatggagaagtgtctcttgcagcatctcaaccagttctcttgtatgctattcttctgatgatcctcctttctccttttgatatgttttacttatcatcacgcttttactttctgaggacagtctggcgtataatactgcctttacaagcaattacatttcctgacttctttttggctgatatttttacatccatgtcaaaggtgttctcagatctggagcgttcggtttgtcgtatggtaaatcgccaggttgcaacaatcgcttggtttgaagcagattctgtttgtggcagtcattctgtagctattcctcttgttcttgtgttcccctacttgtggcgtttcttccaatgtctccggcagtacaaggatacaaaggagaagacatgtctcttgaatgctctcaagtactcgacagcaattcctgtgatttttctttctgctctcaagtaccatgtatatcctgatcagtgggttggcttctaccggcccctttggcttatctctagtgttattaattcactgtattccttctactgggatataaagcgagattgggatctgagcatcctaaccaggattttcatgttcaaaaacccaagcatatggactaatcttctttatgggcagaactgggtattctactgggtgttgggcagcaatttggttctgcgatgcacatggacatacaagctctcagcgcatcttcggcacaactacctgacagtgttcaccatagcagctctggaaatactgagacggtggcagtgggtgttcttccgagtcgagaatgagtggaacaagatgacagccaaacaaaacttggagatgtcatctgacatgccttccgaaggagacaggctactggattctagtaaccatacaattgtcttcgcttacgactaa

SEQ ID NO: 12276 - protein, 427 aa, Sorghum bicolor
  misc_feature: Ceres ANNOT ID no. 6074577
  misc_feature (221)..(393): Pfam Id: EXS Pfam Desc: EXS family
  misc_feature (1)..(422): NCBI GI: 115489386 NCBI Desc: os12g0595000 [oryza sativa (japonica cultivar-group)]
  misc_feature (175)..(422): NCBI GI: 124359306 NCBI Desc: exs, c-terminal [medicago truncatula]
  misc_feature (103)..(419): NCBI GI: 30685255 NCBI Desc: exs family protein / erd1/xpr1/syg1 family protein [arabidopsis thaliana]
  misc_feature (1)..(391): NCBI GI: 116126430 NCBI Desc: ensangp00000017656 [anopheles gambiae str. pest]
  misc_feature (1)..(391): NCBI GI: 108869205 NCBI Desc: xenotropic and polytropic murine leukemia virus receptor xpr1 [aedes aegypti]
MKGATIPSVAIMPSPLFLWRFKVVLFLLWGLCCCKISWDSVMRMSVDLRDLFLYEAFLYYNPLLLVALMIWLWGVNLWVFAQSSVNYAKVFDLAQTHLSHREIWRCATWLTLIVPTSMTAYLYLYSHGEVSLAASQPVLLYAILLMILLSPFDMFYLSSRFYFLRTVWRIILPLQAITFPDFFLADIFTSMSKVFSDLERSVCRMVNRQVATIAWFEADSVCGSHSVAIPLVLVFPYLWRFFQCLRQYKDTKEKTCLLNALKYSTAIPVIFLSALKYHVYPDQWVGFYRPLWLISSVINSLYSFYWDIKRDWDLSILTRIFMFKNPSIWTNLLYGQNWVFYWVLGSNLVLRCTWTYKLSAHLRHNYLTVFTIAALEILRRWQWVFFRVENEWNKMTAKQNLEMSSDMPSEGDRLLDSSNHTIVFAYD

SEQ ID NO: 12277 - DNA, 1527 bp, Sorghum bicolor
  misc_feature: Ceres ANNOT ID no. 6074590
  misc_feature: Encodes the peptide sequence at SEQ ID NO 12278
atgagttggttcaaagaaattttcaagggttcagtaaacagaagagtttcaaggggtcactatgatggaggctggcatgaaggacattcatctgatcacaccagagatacctacaatgacagtgataatgaagatatagatcgtgctattgcattatcgctagctgaagctgaggaagatcagaataagggaaaggcagcggctattgatactgactataatttggaggaagatgaacaacttgcacgggctctgcaggagagcctgaattcagagtctcctcctcgacggaatgttcctattgaggatgttccagtgcctcctcgatgggatgttcctgttgagcgtgtgcctcctcggcagtatgttccagcaaatgaaccacctccacacgtttattcacagagtggatccaggatttgtgctggatgccacaacccaattggccatgggcgtttccttagctgtatggattcagtttggcatcctcaatgcttcagatgttttgcttgcaacaagcccatatcagagtatgagtttgctatgcatgatgatcagccgtaccacaaatcctgctacaaagagttttttcatccaaaatgtgatgtctgcaacaactttattccaacaaatagagatggcctcattgaatacagagcacatcctttctggatgcagaagtactgtccttcccatgaagatgatggcactcctagatgctgcagttgtgaacgaatggagccaagggagatcaagtacataacattagatgatgggaggaaactctgcttggaatgtctcacttcttcagtaatggatactccagaatgtcaacatctttacatggatattcaggaattttttgaaggtttgaacatgaaagtagaacagcaaattccattacttttagttgagaggcaggctctgaatgaagccttggaagctgagaaaaatgggcaccacctaccagaaaccagaggtctatgtctttctgaagagcaaattgttagaacgatcttaaaaagaccacagattggaccaggaaacagaatcatagatatgattataggaccatacaagctgtctcggctgtgtgaagtgactgcaatccttatattatatggtctgccaagattacaaactggttccattctggcccacgagatgatgcatgcatatcttcgtctcaaaggattccgaaatcttagtattgaggttgaagaaggcatctgccaagttctggcccacctgtggttagagtcagaaatcatcgctggttctagtagcaacgtcgcatccagttcagaagcatcgtcatcttcgtcatcctcaggtcctacctcttcaaagaagggtgcaaagaccgaattcgagaagaagcttggggcattcatcaagcaccagatcgaaacagattcttctgaggcatatggaggtggtttcagagcaggctatccggctgttgagcgctatggcttgaaaagaacccttgatcatattaagttgacagggactttcccatattaa

SEQ ID NO: 12278 - protein, 508 aa, Sorghum bicolor
  misc_feature: Ceres ANNOT ID no. 6074590
  misc_feature (141)..(196): Pfam Id: LIM Pfam Desc: LIM domain
  misc_feature (15)..(507): NCBI GI: 115454203 NCBI Desc: os03g0626600 [oryza sativa (japonica cultivar-group)]
  misc_feature (40)..(507): NCBI GI: 140063803 NCBI Desc: lim, zinc-binding; ubiquitin interacting motif; peptidase m, neutral zinc metallopeptidases, zinc-binding site [medicago truncatula]
  misc_feature (59)..(508): NCBI GI: 55771369 NCBI Desc: lim domain containing protein-like [oryza sativa (japonica cultivar-group)]
  misc_feature (128)..(507): NCBI GI: 15221983 NCBI Desc: ubiquitin interaction motif-containing protein / lim domain-containing protein [arabidopsis thaliana]
  misc_feature (139)..(505): NCBI GI: 8954064 NCBI Desc: contains a weak similarity to an actin-binding lim protein, isoform a, from homo sapiens gi4504999 and contains multiple lim proteins pf00412 and ppr repeats pf01535. est
  misc_feature (139)..(505): NCBI GI: 8954064 (continued) gbn96780 comes from this gene. [arabidopsis thaliana]
MSWFKEIFKGSVNRRVSRGHYDGGWHEGHSSDHTRDTYNDSDNEDIDRAIALSLAEAEEDQNKGKAAAIDTDYNLEEDEQLARALQESLNSESPPRRNVPIEDVPVPPRWDVPVERVPPRQYVPANEPPPHVYSQSGSRICAGCHNPIGHGRFLSCMDSVWHPQCFRCFACNKPISEYEFAMHDDQPYHKSCYKEFFHPKCDVCNNFIPTNRDGLIEYRAHPFWMQKYCPSHEDDGTPRCCSCERMEPREIKYITLDDGRKLCLECLTSSVMDTPECQHLYMDIQEFFEGLNMKVEQQIPLLLVERQALNEALEAEKNGHHLPETRGLCLSEEQIVRTILKRPQIGPGNRIIDMIIGPYKLSRLCEVTAILILYGLPRLQTGSILAHEMMHAYLRLKGFRNLSIEVEEGICQVLAHLWLESEIIAGSSSNVASSSEASSSSSSSGPTSSKKGAKTEFEKKLGAFIKHQIETDSSEAYGGGFRAGYPAVERYGLKRTLDHIKLTGTFPY

SEQ ID NO: 12279 - DNA, 1620 bp, Sorghum bicolor
  misc_feature: Ceres ANNOT ID no. 6074607
  misc_feature: Encodes the peptide sequence at SEQ ID NO 12280
atggatggacctgttgatgaccctgtggagaacaacctcaccggaggtcctagtatccttggcaatgaggaagaagccaatacttatgctgatgtgcaagtcaaggaagaaccagaaaagctctatgacgaggaatccaaggacctaatgcaagatgagttgggtaaccaagagcatgcgaacatgaacaatgaagatgtgggaggtcagaacaaagaggaccaagctacccccacagaccacggtgtggaagctggggtgaagcagcaggatgctacagttcctgatgacaagaagtggcctggatggcctggagagagtgttttccgtatactggttcctaccacaaaggttggtgccgtcattgggcgcaaaggggatttcatcaagaaaatgtgtgaggaatcaagagctcgcatcaaggttcttgagggaccaccagctgtgccagaaagagtggtaatgatttcagcaaaggatgaactagacacagtgctacctccagctgttgatgggctgcttagagttcataaaaggataacagatggtttagatggtgaaactgatcagcctcaacgagctactgtcaccgctgggcccacaaggctactggtcccagcttcccaagctggcagcctgattgggaagcaaggagcaactattaaatcaatacaggatgcttcaaagtgtgttctccggattgttgagaatgttccacctgttgcattgaatgatgacagagttgtagagatacagggtgaacctcttgatgctcacaaagccgtggagctgattgcaagtcatttaagaaaatttcttgttgaccgtagtgtcctccctttgtttgaaacacagatgaaagtgcacagtgtgcacagagagcaacctatgcctcctccacaggcatggggtccccctccaccctcaccctggggtcatccaccaccaaaccttcctcctcctggtggcccaggttatggtgggaacccacagtacatgcctccacctccacggccacaagagagctattatcctccgcctgatgtgccccctgtagaaaagcaaccacactatggaatttcttcatatggacgcgatgcacctccgagtgttcccccagggaatcaaaaccaagcacatgggtcttctcaggtgacacacagcatgcaagttcctctttcctatgctgatgctgtgataggatcagccggtgccagtatcagctacatccgcaggcatagtggagcaactataagtattcaagaaggtgctcctggggagatgacagtggagataacaggaagtgcttcacaagtacagactgctcaacagctaatcaagaacttcatggctgaagcttccccccagggaccaccggctccagctccacccgctcaaccagtggacacaggttacagctcgtatccaccttacggtggactccagctcctcacaacggcggaagctatggcgcgtacccaccgagctatggatactaatccggagcaggagctggattcagacttagggaaggagggttatgttatgggttcgcttgtctgttcatcttttgagaactcaacctcgttaggacttctgaacttacttttggtgttgtaa

SEQ ID NO: 12280 - protein, 539 aa, Sorghum bicolor
  misc_feature: Ceres ANNOT ID no. 6074607
  misc_feature (108)..(162): Pfam Id: KH_1 Pfam Desc: KH domain
  misc_feature (200)..(265): Pfam Id: KH_1 Pfam Desc: KH domain
  misc_feature (386)..(446): Pfam Id: KH_1 Pfam Desc: KH domain
  misc_feature (154)..(480): NCBI GI: 115489418 NCBI Desc: os12g0597600 [oryza sativa (japonica cultivar-group)]
  misc_feature (23)..(481): NCBI GI: 61661326 NCBI Desc: flk [arabidopsis thaliana]
  misc_feature (58)..(307): NCBI GI: 92877479 NCBI Desc: kh, type 1 [medicago truncatula]
  misc_feature (97)..(283): NCBI GI: 140067267 NCBI Desc: kh, type 1 [medicago truncatula]
  misc_feature (106)..(348): NCBI GI: 140064615 NCBI Desc: kh, type 1 [medicago truncatula]
MDGPVDDPVENNLTGGPSILGNEEEANTYADVQVKEEPEKLYDEESKDLMQDELGNQEHANMNNEDVGGQNKEDQATPTDHGVEAGVKQQDATVPDDKKWPGWPGESVFRILVPTTKVGAVIGRKGDFIKKMCEESRARIKVLEGPPAVPERVVMISAKDELDTVLPPAVDGLLRVHKRITDGLDGETDQPQRATVTAGPTRLLVPASQAGSLIGKQGATIKSIQDASKCVLRIVENVPPVALNDDRVVEIQGEPLDAHKAVELIASHLRKFLVDRSVLPLFETQMKVHSVHREQPMPPPQAWGPPPPSPWGHPPPNLPPPGGPGYGGNPQYMPPPPRPQESYYPPPDVPPVEKQPHYGISSYGRDAPPSVPPGNQNQAHGSSQVTHSMQVPLSYADAVIGSAGASISYIRRHSGATISIQEGAPGEMTVEITGSASQVQTAQQLIKNFMAEASPQGPPAPAPPAQPVDTGYSSYPPYGGLQLLTTAEAMARTHRAMDTNPEQELDSDLGKEGYVMGSLVCSSFENSTSLGLLNLLLVL

SEQ ID NO: 12281 - DNA, 975 bp, Sorghum bicolor
  misc_feature: Ceres ANNOT ID no. 6074667
  misc_feature: Encodes the peptide sequence at SEQ ID NO 12282
atggagttgtccagttccatcgcgtccacggaggcggtggcgcaggcgcggctgctccggccgccgtcatttcgccggccggggccggcgggattcgtgacttgtaggagttatgctacaagaagcaaactgatgaggcagatgcctccggcccttggtaccttccggcctgcgtctcctcactacccaagttttcaagacacaaacagcaaaaagcgaaatgttccttgctatcagagacaacaaacctcacagattgaagccaagtcaatggaggaggtatatgacactttggctgaacaccttctttctgtcttgaagaatatcgaacatcttgattcaaaatacattgttggcctagctggcccacctggtgcaggcaagtccacagttgcctctgaagttgttcgacgtgttaatatgctttggtcccagaagcatgcaaagggtagtggagcactgcttcctaccgaggaaattgctgcaatgcttccaatggatggtttccacctttatcgtgcccaactcgatgcaatggaggatccaaaagaagcacatgcaagaagaggagcaccttggacattcaatccagcactgtttctgaaatgtctacagaccctaagaacagagggttcagtttatgctccatcgtttgatcatggtgttggcgacccagttgagaaagacatatttgttaagccacagcacaaaatagtgatagttgaagggaactatctattgctggaagaagatgtttggactgaaattagggacttgtttgatgagaaatggttcattgacattgacattgatgtctccatgcaaagagtgctcaagagacatattgccacaggaaaagagccagatgtagcagcatggcggatctcgtacaacgaccgaccgaatgcagagcttatcctggaatcaaggaagaatgctgaccttgtgatcagatcagtggacttttcaagctag

SEQ ID NO: 12282 - protein, 324 aa, Sorghum bicolor
  misc_feature: Ceres ANNOT ID no. 6074667
  misc_feature (117)..(323): Pfam Id: PRK Pfam Desc: Phosphoribulokinase / Uridine kinase family
  misc_feature (213)..(321): NCBI GI: 4587575 NCBI Desc: belongs to pf01121 uncharacterized protein family upf0038 containing atp/gtp binding domain. ests gbaa585719, gbaa728503 and gbt22272 come from this gene. [arabidopsis
  misc_feature (213)..(321): NCBI GI: 4587575 (continued) thaliana]
  misc_feature (159)..(318): NCBI GI: 119946429 NCBI Desc: phosphoribulokinase/uridine kinase family protein [psychromonas ingrahamii 37]
  misc_feature (91)..(319): NCBI GI: 66849789 NCBI Desc: kinase-related protein [aspergillus fumigatus af293]
  misc_feature (96)..(317): NCBI GI: 126137511 NCBI Desc: pantothenate kinase-like protein [pichia stipitis cbs 6054]
  misc_feature (91)..(320): NCBI GI: 66853402 NCBI Desc: phosphoribulokinase/uridine kinase family protein [aspergillus fumigatus af293]
  misc_feature: The sequence is a functional homolog of SEQ ID NO. 532 in the 11/188,298 US application
MELSSSIASTEAVAQARLLRPPSFRRPGPAGFVTCRSYATRSKLMRQMPPALGTFRPASPHYPSFQDTNSKKRNVPCYQRQQTSQIEAKSMEEVYDTLAEHLLSVLKNIEHLDSKYIVGLAGPPGAGKSTVASEVVRRVNMLWSQKHAKGSGALLPTEEIAAMLPMDGFHLYRAQLDAMEDPKEAHARRGAPWTFNPALFLKCLQTLRTEGSVYAPSFDHGVGDPVEKDIFVKPQHKIVIVEGNYLLLEEDVWTEIRDLFDEKWFIDIDIDVSMQRVLKRHIATGKEPDVAAWRISYNDRPNAELILESRKNADLVIRSVDFSS

SEQ ID NO: 12283 - DNA, 888 bp, Sorghum bicolor
  misc_feature: Ceres ANNOT ID no. 6074677
  misc_feature: Encodes the peptide sequence at SEQ ID NO 12284
atggcgggtggcggcgccgacgacgacgacgtggtggaggtgagctgcggcggcagaggcggcggcgaccccggcgcgtacgccgcggtgctcaagaggaagctcgacctgtactgcgccgccgtcgccaaatccatggaagctaaatcacaagaatcttcgttgggctaccccaactcacaagcttcagatacttcgcaattgatttctcaagcttcctttgatggcaagccaaccaatagtggtacatcaaaggaactgtcagacgatgatggtgaccttgaagagaacactgaccccactaacgccaagaagatgaggagaatgctgtcaaatcgggaatcagctaggcgatcaagaaagaggaagcaagcacacttgaacgatcttgaatcacaggtttccaggttaacatctgagaatgcatctttgctaaagcgtctggctgatatgactcagaaatacaaggatgcttcccttgacaataaaaatctaacagttgatattgagactatgaggagaaaggtgaacatagccgaggaagctgtcaggagactaactggaacaaccctcatgttatcaaccgcatttgacaagcccatgagcagcacacccttgtcatcatgtgcatctgatgcggcttctgcctctgtcgccattgaagatagcgcgaaacatttcctccatgcgccacttcaaagcggtcagatgaagcttgacatcctgaacgcggcgattcctctgaccagtgaggggataggcaccaagccagcttctctgcagcgtgttgctagcttggagaacctgcagaagaggatcattggagattcgatgcactctgagactgcatcaacattctcagagcctgaagctcttgccgataggtaa

SEQ ID NO: 12284 - protein, 295 aa, Sorghum bicolor
  misc_feature: Ceres ANNOT ID no. 6074677
  misc_feature (100)..(160): Pfam Id: bZIP_1 Pfam Desc: bZIP transcription factor
  misc_feature (100)..(154): Pfam Id: bZIP_2 Pfam Desc: Basic region leucine zipper
  misc_feature (51)..(284): NCBI GI: 1144536 NCBI Desc: opaque-2 heterodimerizing protein 1b
  misc_feature (51)..(284): NCBI GI: 168530 NCBI Desc: opaque2 heterodimerizing protein 1
  misc_feature (24)..(284): NCBI GI: 4115746 NCBI Desc: bzip protein [oryza sativa (indica cultivar-group)]
  misc_feature (77)..(226): NCBI GI: 16797791 NCBI Desc: bzip transcription factor [nicotiana tabacum]
  misc_feature (77)..(226): NCBI GI: 1905785 NCBI Desc: g/hbf-1 [glycine max]
  misc_feature: The sequence is a functional homolog of SEQ ID NO 1108 in the 10/225,066US patent application
  misc_feature: The sequence is a functional homolog of SEQ ID NO 1120 in the 11/479,226US patent application
  misc_feature: The sequence is a functional homolog of SEQ ID NO 12 in the 10/412,699US patent application
  misc_feature: The sequence is a functional homolog of SEQ ID NO 1232 in the 10/412,699US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 486 in the 10/412,699US patent application
  misc_feature: The sequence is a functional homolog of SEQ ID NO 910 in the 10/374,780US patent application
  misc_feature: The sequence is a functional homolog of SEQ ID NO 926 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 1232 in the 20040045049 US patent application
  misc_feature: The sequence is a functional homolog of SEQ ID NO 486 in the 20040045049 US patent application
  misc_feature: The sequence is a functional homolog of SEQ ID NO 910 in the 20060162006 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MAGGGADDDDVVEVSCGGRGGGDPGAYAAVLKRKLDLYCAAVAKSMEAKSQESSLGYPNSQASDTSQLISQASFDGKPTNSGTSKELSDDDGDLEENTDPTNAKKMRRMLSNRESARRSRKRKQAHLNDLESQVSRLTSENASLLKRLADMTQKYKDASLDNKNLTVDIETMRRKVNIAEEAVRRLTGTTLMLSTAFDKPMSSTPLSSCASDAASASVAIEDSAKHFLHAPLQSGQMKLDILNAAIPLTSEGIGTKPASLQRVASLENLQKRIIGDSMHSETASTFSEPEALADR

SEQ ID NO: 12285 - DNA, 831 bp, Sorghum bicolor
  misc_feature: Ceres ANNOT ID no. 6074787
  misc_feature: Encodes the peptide sequence at SEQ ID NO 12286
atggcgaggctggcggtggccgcgagggcgttctccgcctcggcttccggcgcgggcgccggcggcgtgtccatggtgcagggggcgtcccggggcatcggcctcgagttcgtgcggcagctgctgcggagaagcggcgaaggccgcgtcgtcgccacgtgccgcgcgccgggttccgcggccgagctccagaagctcaaggaggagcacgcgccggggcgcctcaccgtgctgccgctcgacgtcaccgacgagaacaccatagaggcagccgcggcctcaattacagagacccatggttctctggacctgctgatcaactccaccggcatcctttcgatcccgaacgtgatacagccagagactacactaagcaaggttcagaagtcatccctgatgctggcatatgaggtgaatgcagtcggcccaatcttagtgatcaagcacatgtggccattgctgaaaattggaggtcgttccgagactgggagaggatttgcattggttgcaaatatgagcgctagagtcagttcaataggagacaatgctttgggaggctggcatgcatacagagcttctaaaacggcgctgaatcagttgaccaagactgtgtcagtggagtttggcaggaaggacaacattgcctgcatcctgctccatcctggaaccgtggacactgacctctcaaggccatttcagagaaatgtgcccaaggataagctcttcacaagagagttctctgtacagaagcttctctccatcattgacaacgtcaagaaaagcgacaacggcaagttcttcgcgtgggatggccaagaaatcccttggtga

SEQ ID NO: 12286 - protein, 276 aa, Sorghum bicolor
  misc_feature: Ceres ANNOT ID no. 6074787
  misc_feature (22)..(209): Pfam Id: adh_short Pfam Desc: short chain dehydrogenase
  misc_feature (1)..(276): NCBI GI: 115489512 NCBI Desc: os12g0609500 [oryza sativa (japonica cultivar-group)]
  misc_feature (1)..(276): NCBI GI: 23507787 NCBI Desc: at4g20760/f21c20_110 [arabidopsis thaliana]
  misc_feature (114)..(276): NCBI GI: 7268872 NCBI Desc: cell-cell signaling protein csga-like [arabidopsis thaliana]
  misc_feature (20)..(276): NCBI GI: 121997711 NCBI Desc: short-chain dehydrogenase/reductase sdr [halorhodospira halophila sl1]
  misc_feature (24)..(276): NCBI GI: 81301393 NCBI Desc: probable short chain dehydrogenase [synechococcus elongatus pcc 7942]
  misc_feature: The sequence is a functional homolog of SEQ ID NO. 389 in the 11/188,298 US application
  misc_feature: The sequence is a functional homolog of SEQ ID NO. 453 in the 11/188,298 US application
MARLAVAARAFSASASGAGAGGVSMVQGASRGIGLEFVRQLLRRSGEGRVVATCRAPGSAAELQKLKEEHAPGRLTVLPLDVTDENTIEAAAASITETHGSLDLLINSTGILSIPNVIQPETTLSKVQKSSLMLAYEVNAVGPILVIKHMWPLLKIGGRSETGRGFALVANMSARVSSIGDNALGGWHAYRASKTALNQLTKTVSVEFGRKDNIACILLHPGTVDTDLSRPFQRNVPKDKLFTREFSVQKLLSIIDNVKKSDNGKFFAWDGQEIPW

SEQ ID NO: 12287 - DNA, 426 bp, Sorghum bicolor
  misc_feature: Ceres ANNOT ID no. 6074801
  misc_feature: Encodes the peptide sequence at SEQ ID NO 12288
atgaacaggttcaggaacgtggtgctgcgcaagtgcaagagcctgtcacgggtagcagggcggccgagcgcgtcgtcgtactcgtacagcagcctccggtccatgtccacccgggacgccgccgcggaggtcgtcgacgacgacgacacgtctgtgcgcggcggcggcggcggcggcttggtggcagtgttcgtgggcagctcgcggcggcggtacgtgatcagcgcggagcacctcagccacccgctgatcgccgcgctcatcgacgacgacgacgggcggcggcacaaggatcagcccatcgccgtcaactgcgaggtcgtgctgttcgaccacctgctgtggatgctggacaacgccgtcgacctccacgacgacggcgacgacgacgccatgagggagctggcccagctctacgcgtgctga

SEQ ID NO: 12288 - protein, 141 aa, Sorghum bicolor
  misc_feature: Ceres ANNOT ID no. 6074801
  misc_feature (14)..(118): Pfam Id: Auxin_inducible Pfam Desc: Auxin responsive protein
  misc_feature (51)..(141): NCBI GI: 51090654 NCBI Desc: auxin-induced protein-like [oryza sativa (japonica cultivar-group)]
  misc_feature (60)..(141): NCBI GI: 15242071 NCBI Desc: auxin-responsive protein-related [arabidopsis thaliana]
  misc_feature (8)..(141): NCBI GI: 42407659 NCBI Desc: auxin-induced protein-related-like protein [oryza sativa (japonica cultivar-group)]
  misc_feature (59)..(126): NCBI GI: 79328260 NCBI Desc: calmodulin binding [arabidopsis thaliana]
  misc_feature (59)..(114): NCBI GI: 38454136 NCBI Desc: at4g34750 [arabidopsis thaliana]
MNRFRNVVLRKCKSLSRVAGRPSASSYSYSSLRSMSTRDAAAEVVDDDDTSVRGGGGGGLVAVFVGSSRRRYVISAEHLSHPLIAALIDDDDGRRHKDQPIAVNCEVVLFDHLLWMLDNAVDLHDDGDDDAMRELAQLYAC

SEQ ID NO: 12289 - DNA, 675 bp, Sorghum bicolor
  misc_feature: Ceres ANNOT ID no. 6074939
  misc_feature: Encodes the peptide sequence at SEQ ID NO 12290
atggattctgatgacaagaagtttggaaacgggccaagggagctcactggtgctgttgatttgatcagccactacaaactgctgccacaccatgatttcttttgcaagaaacctttgccactggcaatatcagatacacattatcttcacaatgttgtgggagacactgaaattcgcaaaggagaaggaatggagttagatcaacttgttcagaatgcatatatgagggataaacctgcttatattcagcccttcgatatggaaacactggggcaagcgttccaacttcgagaaacagctcctgtggatttgccctctactgaaaagggtataccgactatctcggggaaaccaaaaagtgagtccaaggacaaagagaagaagcataaaaagcacaaagacaaagacagggacaaagataaggaacataagaagcacaaacatcggcataaggatcggagtaaggacaaagataaagacaaagacaaggataagaaaaaagataaaagtggtcatcatgattctgattcaaagaaacatcatgaaaagaagaggaagcatgagggaacagaagattcagcggatgtgcataagcacaagaagagtaaggagactgatggtctctgccatcaaaccctgtgcagagtagtgggtgtcatgagttggatgtcttga

SEQ ID NO: 12290 - protein, 224 aa, Sorghum bicolor
  misc_feature: Ceres ANNOT ID no. 6074939
  misc_feature (1)..(203): NCBI GI: 115489560 NCBI Desc: os12g0614000 [oryza sativa (japonica cultivar-group)]
  misc_feature (1)..(218): NCBI GI: 38454176 NCBI Desc: at5g12230 [arabidopsis thaliana]
  misc_feature (117)..(206): NCBI GI: 23498767 NCBI Desc: heat shock protein 86 family protein [plasmodium falciparum 3d7]
  misc_feature (98)..(205): NCBI GI: 2642506 NCBI Desc: o1 [plasmodium falciparum]
  misc_feature (103)..(213): NCBI GI: 24580623 NCBI Desc: cg31921-pa [drosophila melanogaster]
  misc_feature: Useful for making plants with altered oil content
  misc_feature: Useful for making plants with modulated biomass
  misc_feature: Useful for making plants with modulated heat sensitivity
  misc_feature: GREAT-hit functional homolog of the protein sequence given in SEQ ID NO 13434
  misc_feature: GREAT-hit functional homolog of the protein sequence given in SEQ ID NO 13457
  misc_feature: Useful for making plants with altered oil content
  misc_feature: Functional homolog of the protein sequence given in SEQ ID NO 13457
MDSDDKKFGNGPRELTGAVDLISHYKLLPHHDFFCKKPLPLAISDTHYLHNVVGDTEIRKGEGMELDQLVQNAYMRDKPAYIQPFDMETLGQAFQLRETAPVDLPSTEKGIPTISGKPKSESKDKEKKHKKHKDKDRDKDKEHKKHKHRHKDRSKDKDKDKDKDKKKDKSGHHDSDSKKHHEKKRKHEGTEDSADVHKHKKSKETDGLCHQTLCRVVGVMSWMS

SEQ ID NO: 12291 - DNA, 1509 bp, Sorghum bicolor
  misc_feature: Ceres ANNOT ID no. 6075211
  misc_feature: Encodes the peptide sequence at SEQ ID NO 12292
atggctctccggcgcagcgccggatccctcgcgctccgcgccgccgccgcctacctccgccgccaccgtccccatcctcctcccccactggccctcgccgcccccgcccccgctcccactcccatacgcagcccgctcgccccgccatgccggcacttcgccgctccgcctggtactcaggtcaataagaagcgaggcaaggaggaggacgaaggcccccgcttgaacaacgccatcacggcgcccttggtcaggctcgtcacggatgaaggccacaacgttgtccccctgcatgaagcactgcagcttgcgagcaggatggacatggacttggttgaggtcgacagaaaattataccctcctgctgtgaaaatcatggattttcacaaagagatgtataagaaagaaaccaaagtgaaagaacgcttgaaagccaagtctgctattgtcttacgtggtggggagaacaaagaagtgcgatttaaggggaaaactgaactaaaagatttgatggtcaaagcagatgggattaccagattaatggagcggggttacagggtgaagtgcatggccatgccctcaggtaatgaaggagaagatttaggaacaccactatctcggttattaggacttatacaagatgtgtgcattgtcgaaagtgggccacacttagactcgaagcatgcatatgttattgtcaggcatgtgaagtttgcaacaaagaaaggtgggaagaaagctagccaggccatagaagagtcaggaaaaggtaccagcagtgctgtctccgagtcaattgttgatggtagcaatagcgcagacaagacagttggagatggtttaggaaaacctgatgatcgtaccatctcagatcgtgttaagaaaacagccacccatctctccgcagactctgctgcccaaaaagaggggcaggatagagaatttaaaagggacttcaattggtcaaaatccaacccaggggctgggggaaacaggattaatcctggacagttaggaccacaagcatctgaacgtggacttggctacaaggatgggcaacctggcatggaaaagcgagagagtaacgtgcaggatcagggtcctgttgaaaccaacagatacgctgctcggaggcagccaatacgaggagacaacaaccgaggtttcaaccaaggaagaccccctcaagatgatagaaggaatgaaaatggaggccgttatgacaaccagagacctctggaacagcagcataaccgaccactaccgaggttcaaccaaggtggattgccacaagatccaaggaacgaaaggagaggtccttttccactgaataacaaccaaaggccaccagcaggtggtggtgatcctaatcgagcaagcaagggttttgggatcttcagtagtactccgaaacctggatcatctgagcagagtaagtcggatggtagcagtaagcctggtacagctgacccgcctaaaagctttgggatttttagttctagaaaatga

SEQ ID NO: 12292 - protein, 502 aa, Sorghum bicolor
  misc_feature: Ceres ANNOT ID no. 6075211
  misc_feature (70)..(138): Pfam Id: IF3_N Pfam Desc: Translation initiation factor IF-3, N-terminal domain
  misc_feature (155)..(237): Pfam Id: IF3_C Pfam Desc: Translation initiation factor IF-3, C-terminal domain
  misc_feature (1)..(502): NCBI GI: 41053222 NCBI Desc: translation initiation factor 3 (if-3)-like protein [oryza sativa (japonica cultivar-group)]
  misc_feature (60)..(502): NCBI GI: 45773942 NCBI Desc: at1g34360 [arabidopsis thaliana]
  misc_feature (65)..(264): NCBI GI: 62896304 NCBI Desc: translation initiation factor if-3 [streptomyces griseus subsp. griseus]
  misc_feature (21)..(261): NCBI GI: 67986973 NCBI Desc: initiation factor 3 [kineococcus radiotolerans srs30216]
  misc_feature (50)..(261): NCBI GI: 118051233 NCBI Desc: translation initiation factor if-3 [comamonas testosteroni kf-1]
MALRRSAGSLALRAAAAYLRRHRPHPPPPLALAAPAPAPTPIRSPLAPPCRHFAAPPGTQVNKKRGKEEDEGPRLNNAITAPLVRLVTDEGHNVVPLHEALQLASRMDMDLVEVDRKLYPPAVKIMDFHKEMYKKETKVKERLKAKSAIVLRGGENKEVRFKGKTELKDLMVKADGITRLMERGYRVKCMAMPSGNEGEDLGTPLSRLLGLIQDVCIVESGPHLDSKHAYVIVRHVKFATKKGGKKASQAIEESGKGTSSAVSESIVDGSNSADKTVGDGLGKPDDRTISDRVKKTATHLSADSAAQKEGQDREFKRDFNWSKSNPGAGGNRINPGQLGPQASERGLGYKDGQPGMEKRESNVQDQGPVETNRYAARRQPIRGDNNRGFNQGRPPQDDRRNENGGRYDNQRPLEQQHNRPLPRFNQGGLPQDPRNERRGPFPLNNNQRPPAGGGDPNRASKGFGIFSSTPKPGSSEQSKSDGSSKPGTADPPKSFGIFSSRK

SEQ ID NO: 12293 - DNA, 1590 bp, Sorghum bicolor
  misc_feature: Ceres ANNOT ID no. 6075254
  misc_feature: Encodes the peptide sequence at SEQ ID NO 12294
atggctgctgctgctgcggcggcctccggcgtcgggttccagctcattggcgccgccgcggccacgctcctagcggcggtccttgttgcggccgttctggggcgccgccgccgccgggcccggccccaggcgcctctggtggaagccaaacccgcgccggagggaggctgcgcggtcggcgacggccggacggacgtcatcatcgtcggcgccggagtagctggatctgcgctggcatacacgctgggaaaggatggccgtcgggtgcatgtcatcgagagggatctgacagaacctgacagaattgtgggtgaactgttgcaacctgggggttacttgaaattaattgagttgggcctcgaagattgtgtggaagaaattgatgcccagcgtgtccttggttacgcattattcaaagatgggaggaacacaaagcttgcttatcccttggagaagttccattctgatgttgctggtaggagctttcacaatgggaggtttatacagaggatgcgtcaaaaagctgcgtctttgcccaatgtccaattagagcaaggaactgttacatcacttcttgaagaaaatggtactgttaaaggtgttcaatacaaaaccaagtcaggtgaagaactaaaagcttatgctcccctgacgattgtatgtgatggttgcttttcaaatctacgacgcgccctttgctctccaaaggttgatgttccatcatgttttgttgggctggtattggagaattgccaacttccacatccaaaccatggccatgttatcttggccaatccttctccaatcctattttacccaattagcagcacagaggtgcgctgtttggttgatgtccctggtcagaaggtgccttccatagctagcggtgaaatggcaaattatctcaaaactgttgttgcaccccagattcctccagaaatctacgactctttcatagcggccattgataagggaagcataagaacaatgccaaataggagcatgccagcggctccacatccgacccctggggcacttttgatgggggatgcattcaatatgagacaccctttaactggtggaggaatgactgttgcattatccgacattgttgtcctacgtaatcttctcaagcctctccacaatcttcatgacgcatcttccctgtgcaagtaccttgaatcgttctatacactgcggaagccggttgcttccacaataaacacattggccggcgctctgtacaaggtcttcagtgcctcgcctgatcaagctaggaatgagatgcgccaagcttgttttgattacttgagccttggaggcgtcttctcaaatgggcctattgctttactctccggtcttaatcctcggccactgagtttagttgcacacttctttgctgttgctatctacggtgttggccgcttgatgctccctcttccttcacctaagcgaatgtggattggagccagactgatttctggtgcatgtggcatcatcctccctatcattaaagctgaaggcgtgagacagatgttcttccctgctactgtacctgcatattaccgggccgcacctatgggagaataa

SEQ ID NO: 12294 - protein, 529 aa, Sorghum bicolor
  misc_feature: Ceres ANNOT ID no. 6075254
  misc_feature (214)..(487): Pfam Id: SE Pfam Desc: Squalene epoxidase
  misc_feature (63)..(411): Pfam Id: FAD_binding_3 Pfam Desc: FAD binding domain
  misc_feature (65)..(322): Pfam Id: DAO Pfam Desc: FAD dependent oxidoreductase
  misc_feature (5)..(527): NCBI GI: 115451725 NCBI Desc: os03g0231800 [oryza sativa (japonica cultivar-group)]
  misc_feature (60)..(526): NCBI GI: 62945915 NCBI Desc: squalene monooxygenase [datura innoxia]
  misc_feature (15)..(527): NCBI GI: 92877833 NCBI Desc: helix-turn-helix, arac type; nad-binding site; fumarate lyase [medicago truncatula]
  misc_feature (61)..(527): NCBI GI: 27475610 NCBI Desc: squalene monooxygenase 2 [medicago truncatula]
  misc_feature (61)..(527): NCBI GI: 86371770 NCBI Desc: squalene epoxidase [medicago sativa]
  misc_feature (62)..(527): SWISSPROT Homolog: EC 1.14.99.7 Squalene monooxygenase
  misc_feature: Useful for making plants with altered cell wall content and/or composition
  misc_feature: GREAT-hit functional homolog of the protein sequence encoded by LOCUS at1g58440
  misc_feature: Useful for making plants with altered cell wall content and/or composition
  misc_feature: Functional homolog of the protein sequence given in SEQ ID NO 13711
MAAAAAAASGVGFQLIGAAAATLLAAVLVAAVLGRRRRRARPQAPLVEAKPAPEGGCAVGDGRTDVIIVGAGVAGSALAYTLGKDGRRVHVIERDLTEPDRIVGELLQPGGYLKLIELGLEDCVEEIDAQRVLGYALFKDGRNTKLAYPLEKFHSDVAGRSFHNGRFIQRMRQKAASLPNVQLEQGTVTSLLEENGTVKGVQYKTKSGEELKAYAPLTIVCDGCFSNLRRALCSPKVDVPSCFVGLVLENCQLPHPNHGHVILANPSPILFYPISSTEVRCLVDVPGQKVPSIASGEMANYLKTVVAPQIPPEIYDSFIAAIDKGSIRTMPNRSMPAAPHPTPGALLMGDAFNMRHPLTGGGMTVALSDIVVLRNLLKPLHNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPMGE

SEQ ID NO: 12295 - DNA, 1626 bp, Sorghum bicolor
  misc_feature: Ceres ANNOT ID no. 6075410
  misc_feature: Encodes the peptide sequence at SEQ ID NO 12296
atgctgcatcaggagaacagtgaggctttcgtgaggcaccactctgagcagcttgcatgtagcaacatgaggggagcagataatggtcgtccgaatttccttcctgagaaatgccagattgcagtttgccaaaggggtgaaaaagttgacctatttgatgaagagttggtacaaggtgttcatctagccaatcctactgttcattcaccattggtgccaagtggtgtcaaagaaacacctatagttgatcataacaagagacctgcatccagtgacatgctggatatagttgaatgcaaacggctgaagcaggaagatcaaattgtaactaaggaagacaaccatacatctgctgtggaggattttcgtgagtacccaacatacacgacttgtgaaagaagctttgactcaccactgtatgagagcgaggaaagtgaagatgagggtgtagattcacctctccattattcacatgctcacacctatgtggaggatgatctatggcctgccagctttcatcaatctgtgggcccttttccctcgaggaaagctgttcctattgggccaaatcatcaggctgaattacctgagtgcaggccatttagtggaaggactgaagaaggagaaagtgtcaagtggatcagaaacggtgttattccaatgcctggtactgatgcatcgtctttggtgttggaacctgttcactgcaaggcaggctgtgagtgtcttgacgaaggttcaatcaattgtgtgaaaaagcatgtgagggaagcaagagaaaagctgaagggttctgttggttcagacgccttcagagagttgggtttctatgatatgggagaagaggttgcctcaaggtggacagaagaggaggaacatttgttccagcaagtggtcttggcaaaccccgcttctctgcgtagaaacttttgggacgaactccctcttgctttcccttccaagtccagcaaagaactagtgagctactacttcaatgtcttcatgttgaggaagagggctgagcagaacaggttcgacccaatgaacatcgacagtgacgatgacgaatggcaggcaggtggtgatggtgagtttccaatcacaggaagagctgacgaatacttgccaactgagtcccttactgatcaagatgatattgcatgcaatccagttcctctagaggaggatttctatgaagattctgatgatgaggatgagcttgacaatgccagtggagacaggcataatggttgtcagagggccagcatgttgtcagagggccatcctgtaatgtcatttatagataataatcaacagacgttcaagctagatgcagatgcacaggatgactcttgcacatcatttgaggctcatcaggttggtgttgaaggtggtacacatactgatattgctgatggcagtcactacaggagtgacggctttggtggcggtgcagagcatgggttctttggtgatcattgtgacacaaaagagtgggacttcggtttcagtaccggttgggagaagcatgattttttgtcaacaaacaatgtcatagaagaggtgttcgggaagggctccagtgaagatggaagtgacactgctactggccagggccttctctga

SEQ ID NO: 12296 - protein, 541 aa, Sorghum bicolor
  misc_feature: Ceres ANNOT ID no. 6075410
  misc_feature (284)..(334): Pfam Id: Myb_DNA-binding Pfam Desc: Myb-like DNA-binding domain
  misc_feature (126)..(420): NCBI GI: 115453611 NCBI Desc: os03g0425800 [oryza sativa (japonica cultivar-group)]
  misc_feature (113)..(469): NCBI GI: 42570671 NCBI Desc: myb family transcription factor / elm2 domain-containing protein [arabidopsis thaliana]
  misc_feature (174)..(356): NCBI GI: 87162913 NCBI Desc: elm2; at-rich interaction region; homeodomain-related [medicago truncatula]
  misc_feature (182)..(360): NCBI GI: 38346465 NCBI Desc: osjnba0019g23.13 [oryza sativa (japonica cultivar-group)]
  misc_feature (182)..(360): NCBI GI: 116311096 NCBI Desc: osigba0136o08-osigba0153h12.2 [oryza sativa (indica cultivar-group)]
MLHQENSEAFVRHHSEQLACSNMRGADNGRPNFLPEKCQIAVCQRGEKVDLFDEELVQGVHLANPTVHSPLVPSGVKETPIVDHNKRPASSDMLDIVECKRLKQEDQIVTKEDNHTSAVEDFREYPTYTTCERSFDSPLYESEESEDEGVDSPLHYSHAHTYVEDDLWPASFHQSVGPFPSRKAVPIGPNHQAELPECRPFSGRTEEGESVKWIRNGVIPMPGTDASSLVLEPVHCKAGCECLDEGSINCVKKHVREAREKLKGSVGSDAFRELGFYDMGEEVASRWTEEEEHLFQQVVLANPASLRRNFWDELPLAFPSKSSKELVSYYFNVFMLRKRAEQNRFDPMNIDSDDDEWQAGGDGEFPITGRADEYLPTESLTDQDDIACNPVPLEEDFYEDSDDEDELDNASGDRHNGCQRASMLSEGHPVMSFIDNNQQTFKLDADAQDDSCTSFEAHQVGVEGGTHTDIADGSHYRSDGFGGGAEHGFFGDHCDTKEWDFGFSTGWEKHDFLSTNNVIEEVFGKGSSEDGSDTATGQGLL

SEQ ID NO: 12297 - DNA, 402 bp, Sorghum bicolor
  misc_feature: Ceres ANNOT ID no. 6075447
  misc_feature: Encodes the peptide sequence at SEQ ID NO 12298
atggtttccttcgagatgaatgacctcaagagctttggaatattcttctcctttctgggaatcgttttcttctttgacaaggggctcatcgcaatgggcaatattcttttcctgtcaggtttgggtttgacaattggtctgaaatcaactatgcagttcttcaccaagccaaagaattacaagggtactatctcatttggtgctggcttttttctggttctcattgggtggccgttttttggcatgctcttagaggcatatggctttattgtactcttcagtgggttttggccaacacttgctgtgttcttgcagaggattcctatcattggctggatttttcaacaaccatttgtgacatcgttccttgaccgctacagaggaaaacgtgttccggtctag

SEQ ID NO: 12298 - protein, 133 aa, Sorghum bicolor
  misc_feature: Ceres ANNOT ID no. 6075447
  misc_feature (23)..(123): Pfam Id: Got1 Pfam Desc: Got1-like family
  misc_feature (1)..(133): NCBI GI: 38603916 NCBI Desc: at3g03180 [arabidopsis thaliana]
  misc_feature (9)..(121): NCBI GI: 33146513 NCBI Desc: nfkb activating protein-like [oryza sativa (japonica cultivar-group)]
  misc_feature (9)..(130): NCBI GI: 47497305 NCBI Desc: nfkb activating protein-like [oryza sativa (japonica cultivar-group)]
  misc_feature (9)..(128): NCBI GI: 61677905 NCBI Desc: cg32576-pb, isoform b [drosophila melanogaster]
  misc_feature (9)..(119): NCBI GI: 24642432 NCBI Desc: cg32576-pa [drosophila melanogaster]
MVSFEMNDLKSFGIFFSFLGIVFFFDKGLIAMGNILFLSGLGLTIGLKSTMQFFTKPKNYKGTISFGAGFFLVLIGWPFFGMLLEAYGFIVLFSGFWPTLAVFLQRIPIIGWIFQQPFVTSFLDRYRGKRVPV

SEQ ID NO: 12299 - DNA, 1281 bp, Sorghum bicolor
  misc_feature: Ceres ANNOT ID no. 6075457
  misc_feature: Encodes the peptide sequence at SEQ ID NO 12300
atgagaggtttaaggcggtggctgccgttctgcggcggcggctgctgctgctgcggtgaaggaggcgccggcaggggagggggcgtggcggacggactggtgtgggatgtggccctcaaggcgcacgcgtccggtgactactccatcgccgtggcgcaggcgaacgagtcgctcgaggaccaggcgcaggtgctggcggccccggccgccacgctcgtcggcgtcttcgacgggcacggcgggcccgaggccgcgcggttcgtcaacaggcgcatcttctcccatatccaaggtgagctcgatcgatcgctgcctgcatgctgtagatcatccccgatatggctgcatgttgtacgactgtttctgactgacatgtcgagacgaccctgcgcaggctttgcggctgagaacgggggcctgtcggcggaggtgctccagaaggcgttcggcgcgacggaggaggagttcataggcctggtgcagaagtcgtggccgtcgcagccgaggatcgtctccgtgggctcctgctgcctggtgggcgccatcgagggcgggacgctgtacgtggccaacctcggcgactcgcgcgccgtgctgggccgccgcggcggcggcggcaaagggaataggcgtgtggtggcggagcgcctgtcgcaggaccacaacgtcgccgacgaggacgtgcggcgggaggtggccgagatgcacccggacgagccgcacatcgtgctcaacagccacggcgtgtggcggatcaaggggatcatccaggtgtcgcggtccatcggcgacgtgtacctcaagaagcccgacatctgcaggaacaacccggcgctgcagcagtccctctgcccgttcccgctgcgccgccccgtgatgagcgccgtgccgtccatcaccacgcgggagctgcgcccgggggaccggttcctcatcttcgcgtcggacgggctgtgggagcagctcagcgacgaggccgcggtgggcgtcgtggcgagcagcccgaggaaaggcgtggccatgcgcctggtgcgtgccgcgcagctggaggcggcgcggaagaaggaggtcaagtacgacaagatccggaccatcgagaagggccagcgccggcacttccacgacgacatcaccgtcgtcgtgctcttcctcgacaagtgcaggggcgccgccaggtccggccccgaggacatcgacggcacctatgcgccgctggacgtgttctcctacagccccgccggcgatcacgaggacccgaccaagcccgtcctgcgtcgttga

SEQ ID NO: 12300 - protein, 426 aa, Sorghum bicolor
  misc_feature: Ceres ANNOT ID no. 6075457
  misc_feature (44)..(356): Pfam Id: PP2C Pfam Desc: Protein phosphatase 2C
  misc_feature (133)..(409): NCBI GI: 56787112 NCBI Desc: bth-induced protein phosphatase 2c 2 k2 form [oryza sativa (indica cultivar-group)]
  misc_feature (121)..(395): NCBI GI: 20340237 NCBI Desc: protein phosphatase 2c-like protein [thellungiella halophila]
  misc_feature (133)..(385): NCBI GI: 10177123 NCBI Desc: protein phosphatase 2c-like protein [arabidopsis thaliana]
  misc_feature (136)..(385): NCBI GI: 9759303 NCBI Desc: protein phosphatase 2c-like [arabidopsis thaliana]
  misc_feature (136)..(385): NCBI GI: 21536936 NCBI Desc: protein phosphatase 2c-like [arabidopsis thaliana]
  misc_feature: Useful for making plants with modulated biomass
  misc_feature: Useful for making plants with modulated low light sensitivity
  misc_feature: Functional homolog of the protein sequence given in SEQ ID NO 13347
  misc_feature: The sequence is a functional homolog of SEQ ID NO. 386 in the 11/188,298 US application
  misc_feature: The sequence is a functional homolog of SEQ ID NO. 448 in the 11/188,298 US application
  misc_feature: The sequence is a functional homolog of SEQ ID NO. 406 in the 11/188,298 US application
  misc_feature: The sequence is a functional homolog of SEQ ID NO. 363 in the 11/188,298 US application
MRGLRRWLPFCGGGCCCCGEGGAGRGGGVADGLVWDVALKAHASGDYSIAVAQANESLEDQAQVLAAPAATLVGVFDGHGGPEAARFVNRRIFSHIQGELDRSLPACCRSSPIWLHVVRLFLTDMSRRPCAGFAAENGGLSAEVLQKAFGATEEEFIGLVQKSWPSQPRIVSVGSCCLVGAIEGGTLYVANLGDSRAVLGRRGGGGKGNRRVVAERLSQDHNVADEDVRREVAEMHPDEPHIVLNSHGVWRIKGIIQVSRSIGDVYLKKPDICRNNPALQQSLCPFPLRRPVMSAVPSITTRELRPGDRFLIFASDGLWEQLSDEAAVGVVASSPRKGVAMRLVRAAQLEAARKKEVKYDKIRTIEKGQRRHFHDDITVVVLFLDKCRGAARSGPEDIDGTYAPLDVFSYSPAGDHEDPTKPVLRR

SEQ ID NO: 12301 - DNA, 714 bp, Sorghum bicolor
  misc_feature: Ceres ANNOT ID no. 6075474
  misc_feature: Encodes the peptide sequence at SEQ ID NO 12302
atggcgcgcggcgctcgcttccttcttgttctcgcgctgctcgccgcgctactcgccgtcgtcctccagctctaccgcctcaggaagccgaggttgtggacagtggaggagctgtcgccgtacaatggaacgaatgaggggttgcccatactactcgcgattttgggctcagtgtttgacgtcacaaaagggaggtcacattatggtcctggcggaggttatcatcactttactgggagggatgcatcacgggcatttgtttctggaaattttacaggtaatggtctgactgattccttacagggtttatcaagcagtgaggtaaacagcattgttgattggaggaaattttacttcgaaagatatatatttgctggtaaacttattggacgttactacgacagtcaaggaaatcctacgaaatatctgaagggtgtagaaatgaaggcaaagagaggtgcacagcttcttgaaaagcagaagagtgacgaagctaaaatacctggctgcaattcaaaatggagccaacaagaaggcggagaagtttggtgcgacacgggctatccaagattggtgaggaggccaggcgacatagctctgaccggacaagttagccaaaggtgcgcttgtttccaggaaaacgagctcgacaaagctgggctagtggtgtacgaagggtgtgattacttgtccaagtcttgcaaagtaaactag

SEQ ID NO: 12302 - protein, 237 aa, Sorghum bicolor
  misc_feature: Ceres ANNOT ID no. 6075474
  misc_feature (32)..(129): Pfam Id: Cyt-b5 Pfam Desc: Cytochrome b5-like Heme/Steroid binding domain
  misc_feature (1)..(237): NCBI GI: 115451427 NCBI Desc: os03g0205500 [oryza sativa (japonica cultivar-group)]
  misc_feature (8)..(164): NCBI GI: 38016533 NCBI Desc: fiber protein fb38 [gossypium barbadense]
  misc_feature (4)..(210): NCBI GI: 56206447 NCBI Desc: novel protein [mus musculus]
  misc_feature (34)..(218): NCBI GI: 54643063 NCBI Desc: ga11364-pa [drosophila pseudoobscura]
  misc_feature (32)..(234): NCBI GI: 116131910 NCBI Desc: ensangp00000024835 [anopheles gambiae str. pest]
MARGARFLLVLALLAALLAVVLQLYRLRKPRLWTVEELSPYNGTNEGLPILLAILGSVFDVTKGRSHYGPGGGYHHFTGRDASRAFVSGNFTGNGLTDSLQGLSSSEVNSIVDWRKFYFERYIFAGKLIGRYYDSQGNPTKYLKGVEMKAKRGAQLLEKQKSDEAKIPGCNSKWSQQEGGEVWCDTGYPRLVRRPGDIALTGQVSQRCACFQENELDKAGLVVYEGCDYLSKSCKVN

SEQ ID NO: 12303 - DNA, 1611 bp, Sorghum bicolor
  misc_feature: Ceres ANNOT ID no. 6075583
  misc_feature: Encodes the peptide sequence at SEQ ID NO 12304
atgtcgacacaggcctctaaccggtcatacagatatccagacaatacccaactactgtaccacaatggcaatccaatgcatgttgggggcaatggtaattactatgtgcaacaaaatcatgatgatgttaactacatttcctctgatgatggatcacagagcagtaattctagagctcaaggttttcaagcacagttttgcaccctagactcgtcttcggccaattgtgtttatcctgcacatagctctacctcttctcagagcataagtggaagccctctgtctcagcaagagagccactctgatcatgcatatggttcctctccaagtgcatcgtgcattactcaggttcccacctggacacttaaggatctagaaaatgtgatgcttggacccgattctgacatatgtagccctgacagttcctttctgcctggcactgccttgcatgaaaataactggagagaacttttgggaattcaaactggggatttgaggcagttaattatagcatgtggtaaggctgttgacgagaatgctttctatatggatgcactgatgtctgagttaaggccgatggtttctgtctctggtgaaccgatgcaacgtctgggagcttacatgttggaaggtctcattgcgaggctttctttcactggacatgccctgtataaatctctgaagtgcaaagagcctgtggctacaagttctgagctcatgtcctatatgcatcttctttatgagatctgtccattcttcaagttcggttacatgtctgccaatggtgccatagctgatgctgttaagggtgaagacattattcacatcatcgatttccaaatcgctcagggtagtcagtggatgactatgatacatgcccttgcttcaaggcctgggaggcgaccatacctaagaataactggcatagatgactcgaattctgctcatgcccgaggtggtggactggatatggttggacagaggttgcacacagtggcccagtcgtgtggtctgcccttcgagttcaatgctgtgccagcagctagtcatgaggttgtgtttgaagatctttgtgtaagacctggtgaggccatcgttgtcaattttgcttatcagctgcatcatactcctgatgagagtgtgggcacagaaaaccatcgtgatagaatcttgagaatggtcaagagcctctctcctagggtggtaactcttgtagagcaggaggcaaacacaaacacggcacctttctttcttagatacatggagactcttgattattacacagcaatgtttgaggcaatagatgttgcttgccccagggatgataagaagcgcattagcacagagcagcactgtgttgcaagggatatcgtcaatttaattgcttgtgaaggtacagaaagaatagagaggcatgagccttttggaaaatggagggcaaggcttgcaatggctgggtttagaccatacccgttaagtccagtggtgaacagaaccatcaaaacactgctcgacagttaccacagctattacaggcttgaggagagagatggcatcctttatcttggctggaagaacagaaagctggtcgtatcttctgcctggtgctga

SEQ ID NO: 12304 - protein, 536 aa, Sorghum bicolor
  misc_feature: Ceres ANNOT ID no. 6075583
  misc_feature (140)..(446): Pfam Id: GRAS Pfam Desc: GRAS family transcription factor
  misc_feature (8)..(535): NCBI GI: 73620052 NCBI Desc: chitin-inducible gibberellin-responsive protein 2
  misc_feature (112)..(535): NCBI GI: 8777405 NCBI Desc: scarecrow gene regulator-like [arabidopsis thaliana]
  misc_feature (70)..(535): NCBI GI: 14517552 NCBI Desc: f17j6.12/f17j6.12 [arabidopsis thaliana]
  misc_feature (33)..(535): NCBI GI: 92872928 NCBI Desc: gras transcription factor [medicago truncatula]
  misc_feature (171)..(535): NCBI GI: 89474472 NCBI Desc: gras7 [solanum lycopersicum]
  misc_feature: The sequence is a functional homolog of SEQ ID NO 1327 in the 10/374,780US patent application
  misc_feature: The sequence is a functional homolog of SEQ ID NO 135 in the 11/479,226US patent application
  misc_feature: The sequence is a functional homolog of SEQ ID NO 212 in the 10/225,068US patent application
  misc_feature: The sequence is a functional homolog of SEQ ID NO 22 in the 10/412,699US patent application
  misc_feature: The sequence is a functional homolog of SEQ ID NO 220 in the 10/412,699US patent application
  misc_feature: The sequence is a functional homolog of SEQ ID NO 4 in the 10/374,780US patent application
  misc_feature: The sequence is a functional homolog of SEQ ID NO 443 in the 11/479,226US patent application
  misc_feature: The sequence is a functional homolog of SEQ ID NO 474 in the 10/666,642US patent application
  misc_feature: Useful for making plants with modulated growth and phenotype characteristics
  misc_feature: The sequence is a functional homolog of SEQ ID NO 22 in the 20040045049 US patent application
  misc_feature: The sequence is a functional homolog of SEQ ID NO 220 in the 20040045049 US patent application
  misc_feature: The sequence is a functional homolog of SEQ ID NO 1327 in the 20060162006 US patent application
  misc_feature: The sequence is a functional homolog of SEQ ID NO 474 in the 20070033671 US patent application
  misc_feature: Useful for making plants with modulated low light sensitivity
  misc_feature: Functional homolog of the protein sequence given in SEQ ID NO 13378
  misc_feature: The sequence is a functional homolog of SEQ ID NO 474 in the 10/666,642 US patent application
  misc_feature: Useful for making plants with modulated light quality sensitivity
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
  misc_feature: The sequence is a functional homolog of SEQ ID NO 220 in the 10/412,699 US patent application
  misc_feature: The sequence is a functional homolog of SEQ ID NO 443 in the 11/479,226 US patent application
MSTQASNRSYRYPDNTQLLYHNGNPMHVGGNGNYYVQQNHDDVNYISSDDGSQSSNSRAQGFQAQFCTLDSSSANCVYPAHSSTSSQSISGSPLSQQESHSDHAYGSSPSASCITQVPTWTLKDLENVMLGPDSDICSPDSSFLPGTALHENNWRELLGIQTGDLRQLIIACGKAVDENAFYMDALMSELRPMVSVSGEPMQRLGAYMLEGLIARLSFTGHALYKSLKCKEPVATSSELMSYMHLLYEICPFFKFGYMSANGAIADAVKGEDIIHIIDFQIAQGSQWMTMIHALASRPGRRPYLRITGIDDSNSAHARGGGLDMVGQRLHTVAQSCGLPFEFNAVPAASHEVVFEDLCVRPGEAIVVNFAYQLHHTPDESVGTENHRDRILRMVKSLSPRVVTLVEQEANTNTAPFFLRYMETLDYYTAMFEAIDVACPRDDKKRISTEQHCVARDIVNLIACEGTERIERHEPFGKWRARLAMAGFRPYPLSPVVNRTIKTLLDSYHSYYRLEERDGILYLGWKNRKLVVSSAWC

SEQ ID NO: 12305 - DNA, 744 bp, Sorghum bicolor
  misc_feature: Ceres ANNOT ID no. 6075636
  misc_feature: Encodes the peptide sequence at SEQ ID NO 12306
atggtcatggacaagtcacaaccgccgccgccgcctcctccctcctcctcgctcaagtccctcaacaaggcctcctacaagatctccaaaccgtcgtcctccacctccgtctcctccgctcccgctcccgctcccaccatgagagcgccttccccgccgccggcggctcctcggccacccgcaccgctcccgccgccgcaggcctcctccgtccctgccgaccacccgccaccccagccgccggtgtacaacatcgacaagtccaacttccgcgacgtcgtgcagaagctcacaggctcgccgtcccacctcctgccgccgcagccggcggccgccccggccaccgcccgcgcccctctcatggcgccaccacccccgcctcccctcatggcaccgcctcagccgccgccgcctcctcctccgcctcacatcatggcgccgccgccgccgacggcgataccctcccgcctccaccgcatccgcccgccgccgctggccccgccgcgcccgccgcccatccttccgccggcgccgccggcgctctccccgctcccgccgctcccggccgtctgcatgaccgcggagtcgcccatctccgcctacatgcgccgcctccgcgggatgccctcgccgatccacgtgcccacgtcgccgctcggcttcggctgcttgccctcgccgcggacgccgccgtcgcctggcgtgcccatgccggccaccagtccccgcgtccgcgacccgtga

SEQ ID NO: 12306 - protein, 247 aa, Sorghum bicolor
  misc_feature: Ceres ANNOT ID no. 6075636
  misc_feature (76)..(106): Pfam Id: VQ Pfam Desc: VQ motif
  misc_feature (1)..(222): NCBI GI: 115451247 NCBI Desc: os03g0190000 [oryza sativa (japonica cultivar-group)]
  misc_feature (6)..(242): NCBI GI: 119627579 NCBI Desc: hcg1793893 [homo sapiens]
  misc_feature (6)..(242): NCBI GI: 117606933 NCBI Desc: vegetative cell wall protein [chlamydomonas incerta]
  misc_feature (6)..(244): NCBI GI: 76262498 NCBI Desc: pherophorin-c1 protein precursor [chlamydomonas reinhardtii]
  misc_feature (8)..(247): NCBI GI: 6523547 NCBI Desc: hydroxyproline-rich glycoprotein dz-hrgp [volvox carteri f. nagariensis]
MVMDKSQPPPPPPPSSSLKSLNKASYKISKPSSSTSVSSAPAPAPTMRAPSPPPAAPRPPAPLPPPQASSVPADHPPPQPPVYNIDKSNFRDVVQKLTGSPSHLLPPQPAAAPATARAPLMAPPPPPPLMAPPQPPPPPPPPHIMAPPPPTAIPSRLHRIRPPPLAPPRPPPILPPAPPALSPLPPLPAVCMTAESPISAYMRRLRGMPSPIHVPTSPLGFGCLPSPRTPPSPGVPMPATSPRVRDP

SEQ ID NO: 12307 - DNA, 699 bp, Sorghum bicolor
  misc_feature: Ceres ANNOT ID no. 6075678
  misc_feature: Encodes the peptide sequence at SEQ ID NO 12308
atgagctggagatttcctcttttcggctctcagcagcagcaaacagatccaaatttccaggacatccctacgcagtcttggtaccctccctctgtggtaggttcatcttcacgcccatccacccctacctcttctagtggtagtccacatcaacgagcttcagataatccacagtcttcatcccgtgggcaaccatctcctgctgaggctgcagggataattgcccgtttgaaggataagagtattgaggagttacagaggatattgaaagacaaagaggcatataatgcattctttaactcacttgatcaagtgaaaacccagaacaatgtgcgagatgagcttagaaaggagacattgcaacttgcaagggaaaatttagaaaaggagcagcggattttggagcttaggaatcagtgcacaataattagaaccacagaactggctgctgctcaagaccagctaactgatttggagaggcaaaaggatgatattatgcggtcctattcccctgccgcactgctcgacaagctccaaacatcaatggcaaagctggacgaggagtctgaggagttgcaccagaagttcctggagaaagacatcgaccttgcaacctttgtgcagaagtacaagaagctccgcacggcttaccacaagcaggcgttgctccatctagctggccagacatcactacgctga

SEQ ID NO: 12308 - protein, 232 aa, Sorghum bicolor
  misc_feature: Ceres ANNOT ID no. 6075678
  misc_feature (77)..(222): Pfam Id: Mod_r Pfam Desc: Modifier of rudimentary (Mod(r)) protein
  misc_feature (1)..(232): NCBI GI: 115451207 NCBI Desc: os03g0186800 [oryza sativa (japonica cultivar-group)]
  misc_feature (1)..(232): NCBI GI: 115453845 NCBI Desc: os03g0572300 [oryza sativa (japonica cultivar-group)]
  misc_feature (65)..(231): NCBI GI: 42565507 NCBI Desc: autophagy protein agp6 [hyacinthus orientalis]
  misc_feature (77)..(218): NCBI GI: 119594333 NCBI Desc: vacuolar protein sorting 37c (yeast), isoform cra_c [homo sapiens]
  misc_feature (77)..(218): NCBI GI: 57863314 NCBI Desc: vacuolar protein sorting 37c [homo sapiens]
MSWRFPLFGSQQQQTDPNFQDIPTQSWYPPSVVGSSSRPSTPTSSSGSPHQRASDNPQSSSRGQPSPAEAAGIIARLKDKSIEELQRILKDKEAYNAFFNSLDQVKTQNNVRDELRKETLQLARENLEKEQRILELRNQCTIIRTTELAAAQDQLTDLERQKDDIMRSYSPAALLDKLQTSMAKLDEESEELHQKFLEKDIDLATFVQKYKKLRTAYHKQALLHLAGQTSLR

SEQ ID NO: 12309 - DNA, 999 bp, Sorghum bicolor
  misc_feature: Ceres ANNOT ID no. 6075692
  misc_feature: Encodes the peptide sequence at SEQ ID NO 12310
atgagggtggtggtgacgggcgcgacggggtacctgggcggccgcctgtgcgcggcgctggtcggcgcgggccacgccgtgcgcgcgctcgcccgcccctccagcaacgtctccggcctgccccgcgacgtcgagctggcctacggcgacgtcaccgacgccgagtccctcgccgcggccttccacggttgcgacgtcgtgttccacgtcgccgcggccgtcgagccctggttgcccgacccctccgttttcctcaaggttaatgtaggtggacttgagaatgtgttgaaggctgccaagagaacaccaactgtgaagaagataatctacacatcatctttctttgcaattggtccaactgatggttacgttgcagatgagacacaaatgcatccagagaaggaattttgtactgaatatgagaaatcaaaggttcttgcagatagaatcgcacttcaggcagcagcggataaagtgccgatcaccattgtctacccaggcgttctctatggccctggaaaacttacgactggaaatcttgtctcccgcattttaatagagaggtttaatgggcgcttgcctggttacataggagatgggtatgatagagaatcgttctgccatgttgatgatgttgttagtgggcacatagcagctatggagaagggcagagtgggccaacggtatctcctcactggtgaaaatatgtcattcgtgcaaatttttaatatggttgctaatatcacaaacacaaaggctcccatgttccacgtacctctctggttgattgaagcatatgggtggatttcagtttttgtttctcacatcactggaaaactcccacttatcagttaccctactgtgcgtgttctgagacatcaatgggcatactcatgtgacaaagcaaagacggagctgggctatagcccaagaaacttgactgaaggtttatcggagatgctcctgtggcttaaggaagaaaaactaatcaagttttag

SEQ ID NO: 12310 - protein, 332 aa, Sorghum bicolor
  misc_feature: Ceres ANNOT ID no. 6075692
  misc_feature (3)..(232): Pfam Id: Epimerase Pfam Desc: NAD dependent epimerase/dehydratase family
  misc_feature (5)..(216): Pfam Id: NAD_binding_4 Pfam Desc: Male sterility protein
  misc_feature (4)..(282): Pfam Id: 3Beta_HSD Pfam Desc: 3-beta hydroxysteroid dehydrogenase/isomerase family
  misc_feature (3)..(251): Pfam Id: NmrA Pfam Desc: NmrA-like family
  misc_feature (185)..(332): NCBI GI: 115451181 NCBI Desc: os03g0184600 [oryza sativa (japonica cultivar-group)]
  misc_feature (3)..(325): NCBI GI: 82945304 NCBI Desc: nucleoside-diphosphate-sugar epimerase [magnetospirillum magneticum amb-1]
  misc_feature (3)..(331): NCBI GI: 94313097 NCBI Desc: nad-dependent epimerase/dehydratase [ralstonia metallidurans ch34]
  misc_feature (3)..(327): NCBI GI: 113530603 NCBI Desc: flavonol reductase/cinnamoyl-coa reductase [ralstonia eutropha h16]
  misc_feature (4)..(326): NCBI GI: 73538722 NCBI Desc: nad-dependent epimerase/dehydratase:short-chain dehydrogenase/reductase sdr:3-beta hydroxysteroid dehydrogenase/isomerase:polysaccharide biosynthesis protein
  misc_feature (4)..(326): NCBI GI: 73538722 (continued) capd:dtdp-4-dehydrorhamnose reductase:nmra-like [ralstonia eutropha jmp134]
MRVVVTGATGYLGGRLCAALVGAGHAVRALARPSSNVSGLPRDVELAYGDVTDAESLAAAFHGCDVVFHVAAAVEPWLPDPSVFLKVNVGGLENVLKAAKRTPTVKKIIYTSSFFAIGPTDGYVADETQMHPEKEFCTEYEKSKVLADRIALQAAADKVPITIVYPGVLYGPGKLTTGNLVSRILIERFNGRLPGYIGDGYDRESFCHVDDVVSGHIAAMEKGRVGQRYLLTGENMSFVQIFNMVANITNTKAPMFHVPLWLIEAYGWISVFVSHITGKLPLISYPTVRVLRHQWAYSCDKAKTELGYSPRNLTEGLSEMLLWLKEEKLIKF

SEQ ID NO: 12311 - DNA, 714 bp, Sorghum bicolor
  misc_feature: Ceres ANNOT ID no. 6075958
  misc_feature: Encodes the peptide sequence at SEQ ID NO 12312
atggtgctttatatgagcccggcaaagggtgggaaggctgagaagactaattgggtgatgcaccagtaccacctaggcattggagaggatgagagagatggtgaatatgtcgtctctaaattattttttcagcaacagtttaaacctggggacaagaatgtaaccacatcggatgatctggaatcaatggctgcggaagcagatctccctgattttactacattgcccgctgacaaacatgttggtacaatccaagaagtccagaatcctgagcataatctttaccaggttaacagaaactgtgaaataaacattgaagagactgttgtcctcccaccctctgaaaaaacagaggatggagataatccccaatctcaagatccgaagttgtgggaaggtgattcccagtttgaactgctagactctcagcagctggcggaaggactcgctctctgtgacgagttcctcctgagtcagtctcagacctcctgtggcggtggagatgaacctagagtgacaaagccttgcctagctgcttatgcccacctgtcaacagaggacttcaagaaggatttagaagagtgccagcggttggagcccacagataacacaaaccttgagcttgacagcactaatgagtttcgactgagccaaattgaattttcacaggatagctttacaacatgggcagttggcaagatgactgacgactga

SEQ ID NO: 12312 - protein, 237 aa, Sorghum bicolor
  misc_feature: Ceres ANNOT ID no. 6075958
  misc_feature (34)..(217): NCBI GI: 46367698 NCBI Desc: nam1 protein [oryza sativa (japonica cultivar-group)]
  misc_feature (1)..(229): NCBI GI: 46805288 NCBI Desc: no apical meristem (nam)-like protein [oryza sativa (japonica cultivar-group)]
  misc_feature (1)..(46): NCBI GI: 124360744 NCBI Desc: no apical meristem (nam) protein [medicago truncatula]
  misc_feature (1)..(46): NCBI GI: 12751304 NCBI Desc: cuc2-like protein [brassica napus]
  misc_feature (1)..(60): NCBI GI: 115439093 NCBI Desc: os01g0672100 [oryza sativa (japonica cultivar-group)]
  misc_feature: The sequence is a functional homolog of SEQ ID NO. 335 in the 11/188,298 US application
MVLYMSPAKGGKAEKTNWVMHQYHLGIGEDERDGEYVVSKLFFQQQFKPGDKNVTTSDDLESMAAEADLPDFTTLPADKHVGTIQEVQNPEHNLYQVNRNCEINIEETVVLPPSEKTEDGDNPQSQDPKLWEGDSQFELLDSQQLAEGLALCDEFLLSQSQTSCGGGDEPRVTKPCLAAYAHLSTEDFKKDLEECQRLEPTDNTNLELDSTNEFRLSQIEFSQDSFTTWAVGKMTDD

SEQ ID NO: 12313 - DNA, 1407 bp, Sorghum bicolor
  misc_feature: Ceres ANNOT ID no. 6076028
  misc_feature: Encodes the peptide sequence at SEQ ID NO 12314
atgtctcgacgcggggcaatgtcatcgaccgccgccccgcgcgcgcggctgtcgccgccggcgcccgcctcccacccgccgccgcggaaacgtggccgctctccatcatcggctcctggaagcacggcgtcatcgtggcgcgcgtccgccgagaacgccgtgcccctcgaccaccaccgccgccgctggcacaacccggagcgtgcccctggtcgtgtctggcagcggttccgcgcgccccagcttgccttgccctcctccaggctttgggtttgctcggaggacgcttcgacctccccctccggagatgcctgcactatcatgtcatacaacatcttggctgattacaatgctcagaatcatcctgacctttatttggatgtcccctgggatgcactgaggtgggattcaaggaggcgacttattatccgtgaaattaggcactgggatcctgacttagtgtgtcttcaagaagtggataggtttcaggatattgctacaggaatgaagagccgagggtacgaaggtatatatcagaggcgaactggagatactagagatggatgtgccatgttttggaagtcaaaacggttacatctgcttgaggaagatagtattgactttagtgaattcaacctgcgaaataatgttgctcaaatatgtgtttttgagcttaacggaacacacaaatttgtactcgggaatattcatgttttgtttaatccaaagcggggtgatataaaactgggccagattcgcatgctacttgagaaggcaaatgctcttgctgaaaaatgggataaaattcctatcgtgcttgctggtgatttcaacagcacacctgatagcgccatctacaagttcttgtcgacaatgaagctgaacatttctttgcatgatagaaggcagttatctggacttgatagctctgattttggcctgtatgagctttgtagtctgctcaagtatcaatggactgatgaagaagtgagaaatgcaacagggtgttcaaatgtcgtggtggctgaacatccattgaagctcagtagttcatatgccatgttaaagggaaattcagacaataggggtcttcatggtgaaccctcggcgacttcctaccacaagaagtttcttggaactgttgattatctgtggcacactcgtggaattgaatgctccagagttttggacacgttacctataggtgttttgaggagaacgaggggtcttccaaccagggaaattggcagtgatcatttgcccattgttgctgaattctctttcccagaatcagttgatgattctggtgaagaagatgaatctgaacaagatgagtctgagaaagaaatgagcaaagcgcaacacttatttttctcctcagatagttctgctgaagtggcggagtga

SEQ ID NO: 12314 - protein, 468 aa, Sorghum bicolor
  misc_feature: Ceres ANNOT ID no. 6076028
  misc_feature (105)..(426): Pfam Id: Exo_endo_phos Pfam Desc: Endonuclease/Exonuclease/phosphatase family
  misc_feature (9)..(179): NCBI GI: 115467480 NCBI Desc: os06g0264900 [oryza sativa (japonica cultivar-group)]
  misc_feature (88)..(428): NCBI GI: 92893098 NCBI Desc: endonuclease/exonuclease/phosphatase [medicago truncatula]
  misc_feature (16)..(224): NCBI GI: 23506113 NCBI Desc: at5g11350/f2i11_240 [arabidopsis thaliana]
  misc_feature (16)..(224): NCBI GI: 22326729 NCBI Desc: endonuclease/exonuclease/phosphatase family protein [arabidopsis thaliana]
  misc_feature (30)..(306): NCBI GI: 42570103 NCBI Desc: endonuclease/exonuclease/phosphatase family protein [arabidopsis thaliana]
MSRRGAMSSTAAPRARLSPPAPASHPPPRKRGRSPSSAPGSTASSWRASAENAVPLDHHRRRWHNPERAPGRVWQRFRAPQLALPSSRLWVCSEDASTSPSGDACTIMSYNILADYNAQNHPDLYLDVPWDALRWDSRRRLIIREIRHWDPDLVCLQEVDRFQDIATGMKSRGYEGIYQRRTGDTRDGCAMFWKSKRLHLLEEDSIDFSEFNLRNNVAQICVFELNGTHKFVLGNIHVLFNPKRGDIKLGQIRMLLEKANALAEKWDKIPIVLAGDFNSTPDSAIYKFLSTMKLNISLHDRRQLSGLDSSDFGLYELCSLLKYQWTDEEVRNATGCSNVVVAEHPLKLSSSYAMLKGNSDNRGLHGEPSATSYHKKFLGTVDYLWHTRGIECSRVLDTLPIGVLRRTRGLPTREIGSDHLPIVAEFSFPESVDDSGEEDESEQDESEKEMSKAQHLFFSSDSSAEVAE

SEQ ID NO: 12315 - DNA, 1362 bp, Sorghum bicolor
  misc_feature: Ceres ANNOT ID no. 6076048
  misc_feature: Encodes the peptide sequence at SEQ ID NO 12316
atgatcctcgaggtcacacagcagctttgccaagacaggctactcacgttgtccactaacaacctaccacccatccatcacctcctggttttcttactcataaccgtcgtaactgtcaagtatcttatccgacatccacgcagagtgtaccttgttgagtacacttgcttcggtcctgactcaaagtaccgagttgccccagcctccatgatcgagtattttcacctagcaaatttgcttgacgatgataacatttccttcctaagcaatatttatagacgctctggccttggtgacgagacatgcctcccctcttcatatcattacatccctttcattcctagtttgagcatggctcgtatggaggcagagctggtcatcttcacggtcattgatgacctatttgctaaggcatcaatcgaacctagtaaaattgacatactgattgtcaattgcagcgccatgacgatggtaccatccatgactgacatgatcataaacagatacaagctgcgtcgcgatatacaaaacatgcaattgtctgggatggggtgcagtgctggattgatcgccgttgggctcgcaagcaacctcttgcaaatcatgccctacggtgcaaacgcgctggtggtatctacggagaacgtgacttgcaactactatgtagggaagaagagatcgatgcaactgaccaacatcctgtttcgcatgggaggcgccgctgttttactctcgaattctagtgccaatgctcggtttcagcttctgcacactgtccggaaatcaactgctgcccaggataacgcgtaccactgtgttttccatgaggaagacgacgaggggaacctaggtcttaatttgtctaagaatcttgtggccgtcgctggtgaggcgctcaaggccaacatcagcacaagtgcccgtcttctgcttccagtctctgagcaattatcgtttttgctctcttccatcgcgcaaaaggtgttcttgaagaaaagttcatggcagtatgttccaaagttcggcttggccgtcgagcatttctgcatacatgctggtgggcgagcagtgatcgacgcagtgcagcgtagcctggatctatcggatgagcaggttgagccgtcgaggatgacactgcatcgattcggaaacacatcgagcagctcggtgtggtatgaaatggcatattgtgaggccaagcagttgatgcggaagggggatcgagtttggatgattgggtttgggtctgggtataagtgcaacagcgccgtgtggaagtgcattctaccagcccgtagtgccgactcagcatgggcaaactgtattcatcgttatccaatggaagtcccaaaacaagtgtaa

SEQ ID NO: 12316 - protein, 453 aa, Sorghum bicolor
  misc_feature: Ceres ANNOT ID no. 6076048
  misc_feature (41)..(328): Pfam Id: FAE1_CUT1_RppA Pfam Desc: FAE1/Type III polyketide synthase-like protein
  misc_feature (343)..(427): Pfam Id: ACP_syn_III_C Pfam Desc: 3-Oxoacyl-[acyl-carrier-protein (ACP)] synthase III C terminal
  misc_feature (285)..(429): Pfam Id: Chal_sti_synt_C Pfam Desc: Chalcone and stilbene synthases, C-terminal domain
  misc_feature (22)..(450): NCBI GI: 115448487 NCBI Desc: os02g0731900 [oryza sativa (japonica cultivar-group)]
  misc_feature (27)..(453): NCBI GI: 74273645 NCBI Desc: 3-ketoacyl-coa synthase [gossypium hirsutum]
  misc_feature (24)..(451): NCBI GI: 115437198 NCBI Desc: os01g0529800 [oryza sativa (japonica cultivar-group)]
  misc_feature (31)..(453): NCBI GI: 20334738 NCBI Desc: at1g68530/t26j14_10 [arabidopsis thaliana]
  misc_feature (31)..(453): NCBI GI: 92896567 NCBI Desc: imp dehydrogenase/gmp reductase [medicago truncatula]
MILEVTQQLCQDRLLTLSTNNLPPIHHLLVFLLITVVTVKYLIRHPRRVYLVEYTCFGPDSKYRVAPASMIEYFHLANLLDDDNISFLSNIYRRSGLGDETCLPSSYHYIPFIPSLSMARMEAELVIFTVIDDLFAKASIEPSKIDILIVNCSAMTMVPSMTDMIINRYKLRRDIQNMQLSGMGCSAGLIAVGLASNLLQIMPYGANALVVSTENVTCNYYVGKKRSMQLTNILFRMGGAAVLLSNSSANARFQLLHTVRKSTAAQDNAYHCVFHEEDDEGNLGLNLSKNLVAVAGEALKANISTSARLLLPVSEQLSFLLSSIAQKVFLKKSSWQYVPKFGLAVEHFCIHAGGRAVIDAVQRSLDLSDEQVEPSRMTLHRFGNTSSSSVWYEMAYCEAKQLMRKGDRVWMIGFGSGYKCNSAVWKCILPARSADSAWANCIHRYPMEVPKQV

SEQ ID NO: 12317 - DNA, 1449 bp, Sorghum bicolor
  misc_feature: Ceres ANNOT ID no. 6076072
  misc_feature: Encodes the peptide sequence at SEQ ID NO 12318
atgagttcatcacatattggcaagtacctgaaaacagtcttcgcaaaaatagtagacaatttcctcttgacagtcgcagtgccattcgccactgcagctgtcatcgtggcagcaacaacaagcaggtctgatgagttcaccactctgcttcattcagtcagcaacacggacgtgctctcaattgggctcctcttgggcacagcagcggtcgtagccatcatgcggcgcccacgggcggtgtatctcatcgactacgcttgcttccgtcccccacataccaaccgtgttcctgccgcagcctttgtggagcatgtccaacatgtcagccagttaactgaacgcagcaaacgtttcttgacacgtctttacgagcgttcaggccttggtgaggaaacatgcgtgcctctagtggggcactacattgacccggccaagtacagcaagtttgaggacggccgtgaggaggcacagatggctgtcttctcggccattgatgaactgttctccaagacaagaattgcacctcaagccatcgatattctcgtcacaaattgcagcgagttcaatcctacgccaactttctctgacatggttataaaccggtacaaaatgcgtagcgacatccaccatgtccacctgtccagcatgggttgcagcgcagggctaatctcagtagagcttgtgaaaaacctgctgcaagctgcgccatttggtgcaaatgctttagttgtttcgacggagacactcagtggcaatccctacctgggaaacgagcgacctatgctgcttccgtattgcctgtttcgcatgggcggagctgcagtgctgctgtcaacttccccaaccatggccagattccgccttaggtgtatcatgcgcacactcaccgccgcaagtgaccagtcataccaatgcatctacaaggaagaagatgacaagggatttactggtgttaatctctccactgacctggtggccgtcgctgcgagaactgtgaaagccaacatcacgtccattgcgcctcttgtgctcccgccctctgaaaagcttttgttcgcagcatccttcgccgcacggaaactgctcaatgggcgggtcaagctatatatccctgacttcctctctgtgttccagcacttgtgcattcatgcaggcgggcgtgcagtaattgatggtgtccaacgtaacttcggcctgtcggacgagaaggttgagccatcaaggatgacgctacatcgatttggtaacacatctagcagctcactttggtatgaactggcgtatgtggaggctaagggccgcatgtacaagggcaatcaagtgtggatgattgggtttggctctgggtttaagtgcaacagtgcagtatgggagtgcattcgacctgtccacgatgcacatggaccatgggctaactgcatcgatcgttatccagtgcatattccctga

SEQ ID NO: 12318 - protein, 482 aa, Sorghum bicolor
  misc_feature: Ceres ANNOT ID no. 6076072
  misc_feature (72)..(361): Pfam Id: FAE1_CUT1_RppA Pfam Desc: FAE1/Type III polyketide synthase-like protein
  misc_feature (374)..(459): Pfam Id: ACP_syn_III_C Pfam Desc: 3-Oxoacyl-[acyl-carrier-protein (ACP)] synthase III C terminal
  misc_feature (335)..(461): Pfam Id: Chal_sti_synt_C Pfam Desc: Chalcone and stilbene synthases, C-terminal domain
  misc_feature (2)..(482): NCBI GI: 115448487 NCBI Desc: os02g0731900 [oryza sativa (japonica cultivar-group)]
  misc_feature (2)..(482): NCBI GI: 115437198 NCBI Desc: os01g0529800 [oryza sativa (japonica cultivar-group)]
  misc_feature (8)..(481): NCBI GI: 115467464 NCBI Desc: os06g0263400 [oryza sativa (japonica cultivar-group)]
  misc_feature (2)..(482): NCBI GI: 20334738 NCBI Desc: at1g68530/t26j14_10 [arabidopsis thaliana]
  misc_feature (2)..(482): NCBI GI: 21593111 NCBI Desc: very-long-chain fatty acid condensing enzyme cut1 [arabidopsis thaliana]
MSSSHIGKYLKTVFAKIVDNFLLTVAVPFATAAVIVAATTSRSDEFTTLLHSVSNTDVLSIGLLLGTAAVVAIMRRPRAVYLIDYACFRPPHTNRVPAAAFVEHVQHVSQLTERSKRFLTRLYERSGLGEETCVPLVGHYIDPAKYSKFEDGREEAQMAVFSAIDELFSKTRIAPQAIDILVTNCSEFNPTPTFSDMVINRYKMRSDIHHVHLSSMGCSAGLISVELVKNLLQAAPFGANALVVSTETLSGNPYLGNERPMLLPYCLFRMGGAAVLLSTSPTMARFRLRCIMRTLTAASDQSYQCIYKEEDDKGFTGVNLSTDLVAVAARTVKANITSIAPLVLPPSEKLLFAASFAARKLLNGRVKLYIPDFLSVFQHLCIHAGGRAVIDGVQRNFGLSDEKVEPSRMTLHRFGNTSSSSLWYELAYVEAKGRMYKGNQVWMIGFGSGFKCNSAVWECIRPVHDAHGPWANCIDRYPVHIP

SEQ ID NO: 12319 - DNA, 1482 bp, Sorghum bicolor
  misc_feature: Ceres ANNOT ID no. 6076073
  misc_feature: Encodes the peptide sequence at SEQ ID NO 12320
atggccttgtcacctagtcagaggctcctcagatctctgtaccaaattgttgtcaacaatgtcctggttaccattgccgtttcactcactactgctgtcatccttgtggctgcacagtttggtttcagtgagcacattttccctctccatgcccttcgacccatctacttgttgctaactgccttgctaccagcagctgcatttaccttgtaccttgtgaaccgctcccacgatgtatatctagtcgactatgcctgcttcaagccaaatattaactgccgtgttcccctggctgcattcaaagagcacatgatgcacctcaggccattccttgatgaccgcagcgtccacttcctaacacgtatgattgatcgctctggcctcggcgacgagacttcctttccgccttgcctcttttacatacctccgagctttggttttagtcaagcccatgctgaagctgagttaatcctgttttcaacaattgatgacctgttccgtaagacatgcatcaacccatcttccatcgatgtactggttgttaactgcaccttatttaccccaacaccatcctacagtgacatgatcataaacagatacaagcttcgcagcggtatccgcagtgtgcacctctctggtatggggtgcagtgcgagtctcatttccgtggggctggccaagaacctgctgcagatcactccacatgcctcgtatgcattagttgtctctgcggagtcgacgtcgacccacatatatcaagggaggaaacgagaaatgcatctgcccaccgtcctattccgcatgggtggcgccgctgcattgttatcaaattcaaggaagaataataaggcgcgattccggctcaaacaccttcagcggatgattaccaccagcgaaagtgcttatcggtgtgtcatgatggacgaagatgacgagggaaacttgggagcccacctttccaaggaccttatcactgtttctggtgaggcgttgagaaccagtatcacttccattgcgccccttattctcccactatcagagaagctacggtttttgctttcctgcatatcgaggaaggttgtcaacggcaaggaggtgccactgtatgtcccaaacttctgcgtggcgatagagcacttctgcattcatcccggtggaccagcggtgattgatgctgtccaagatagcctccgtctatctggtagccatgccgagccgtcacgaatgacgcttcatcgtttcgggaacacatcaagcagctctttgtggtacgagctagcatacattgaggccaaaggtaggatgcataagtgtgatcgagtattgatgattgccttcggttcagggtacaagtgcaacatcgctgtgtgggagtgtatccaaccatcccacagtgctgatgagtcatgggccaagtgcatccaccggtatccagtgaaagcatgctcaaacaaaataactactaagccccacgttggctga

SEQ ID NO: 12320 - protein, 493 aa, Sorghum bicolor
  misc_feature: Ceres ANNOT ID no. 6076073
  misc_feature (71)..(360): Pfam Id: FAE1_CUT1_RppA Pfam Desc: FAE1/Type III polyketide synthase-like protein
  misc_feature (374)..(459): Pfam Id: ACP_syn_III_C Pfam Desc: 3-Oxoacyl-[acyl-carrier-protein (ACP)] synthase III C terminal
  misc_feature (1)..(479): NCBI GI: 115448487 NCBI Desc: os02g0731900 [oryza sativa (japonica cultivar-group)]
  misc_feature (10)..(479): NCBI GI: 115467464 NCBI Desc: os06g0263400 [oryza sativa (japonica cultivar-group)]
  misc_feature (14)..(478): NCBI GI: 74273645 NCBI Desc: 3-ketoacyl-coa synthase [gossypium hirsutum]
  misc_feature (14)..(479): NCBI GI: 20334738 NCBI Desc: at1g68530/t26j14_10 [arabidopsis thaliana]
  misc_feature (14)..(479): NCBI GI: 21593111 NCBI Desc: very-long-chain fatty acid condensing enzyme cut1 [arabidopsis thaliana]
MALSPSQRLLRSLYQIVVNNVLVTIAVSLTTAVILVAAQFGFSEHIFPLHALRPIYLLLTALLPAAAFTLYLVNRSHDVYLVDYACFKPNINCRVPLAAFKEHMMHLRPFLDDRSVHFLTRMIDRSGLGDETSFPPCLFYIPPSFGFSQAHAEAELILFSTIDDLFRKTCINPSSIDVLVVNCTLFTPTPSYSDMIINRYKLRSGIRSVHLSGMGCSASLISVGLAKNLLQITPHASYALVVSAESTSTHIYQGRKREMHLPTVLFRMGGAAALLSNSRKNNKARFRLKHLQRMITTSESAYRCVMMDEDDEGNLGAHLSKDLITVSGEALRTSITSIAPLILPLSEKLRFLLSCISRKVVNGKEVPLYVPNFCVAIEHFCIHPGGPAVIDAVQDSLRLSGSHAEPSRMTLHRFGNTSSSSLWYELAYIEAKGRMHKCDRVLMIAFGSGYKCNIAVWECIQPSHSADESWAKCIHRYPVKACSNKITTKPHVG

SEQ ID NO: 12321 - DNA, 1317 bp, Sorghum bicolor
  misc_feature: Ceres ANNOT ID no. 6078170
  misc_feature: Encodes the peptide sequence at SEQ ID NO 12322
atggcgttctggggggtggaagtgaagcccgggaagccctacacccacacccaccaggctgaccatggtcgcctccgcatttgtcaggctacactgggcaattgtgatgctgctgcaaggacagtgctgcaatgcaatgttggcaacaagattcccatcaaactttgtagtctcaatccaaaattggctgagacatgccatctagagattgagtttgaggaggtcgatgatgttgtcttttcagtgattggtcaaagttcgattcatctctctggatactatgtccgtgcaagcagcagagaatcttatggggaagatattgggcactccgatactgatgaggagcatgatgccagtgaggacagctatgaatctgactttattgatgatcgtgaagttccaacacctgagaagtatgggtctgattctatagatgatagtgattatgagtgcacccttcgacgacgacgcaaacaaaaagctgttgaaaaaccgactcaaaaggctgaaagacggcggcgcttgaagaagcaccaagtagatagcaccgatgacaattatgatgatactccagtcacgaagcctgttgttaagcgcagtgctaaaatatttgatagcggtgatgatgacactccagtcacgaagcctgttgacaagcgcagtgctccctcaatgtttgatagcagcagtgatgaagatgataatgtacctatatctcttgcattgggtaagaaagacaatgctaaggttgctgaggaaactgaccctcaaaatggacaggcaaatgacatcaccaaaaaaaagattgttgatgtcaagaaaagaaaacattctgccatcagtgaggatcctgcattatcaatggatacaacagatgttaatgcaacatctgtttcaaaacaaggcgatgaaataaaaaagaaatcaaagaaaaagatgaaaaatcaatcaggggagaaggatgagaagcagtccaatataagaacattggaagatgggttgatggtagaagatctatcaataggaaacattgatgcaaaagtggcttctgatggctgcaaggtctacataaaatatgttggcatgttgaagaatgggaaaattgttcagtctaatgctagtgaaaagccttacaagttcaagcttggtgctggaaaagttattcgtggatgggatgttggtattcgtggtatgcgtgttggggagaaaagaaaggttacagtcccaccttccatgctctctggcggtaaatcagtgggagaagtacctgataattcttcagtcatatatgaaatcgagttagtgaaagtgaaatag

SEQ ID NO: 12322 - protein, 438 aa, Sorghum bicolor
  misc_feature: Ceres ANNOT ID no. 6078170
  misc_feature (343)..(435): Pfam Id: FKBP_C Pfam Desc: FKBP-type peptidyl-prolyl cis-trans isomerase
  misc_feature (103)..(437): NCBI GI: 115478396 NCBI Desc: os09g0293900 [oryza sativa (japonica cultivar-group)]
  misc_feature (279)..(438): NCBI GI: 50726164 NCBI Desc: immunophilin-related / fkbp-type peptidyl-prolyl cis-trans isomerase-related-like protein [oryza sativa (japonica cultivar-group)]
  misc_feature (2)..(326): NCBI GI: 116310238 NCBI Desc: osigba0140o07.15 [oryza sativa (indica cultivar-group)]
  misc_feature (2)..(326): NCBI GI: 38344553 NCBI Desc: osjnba0027p08.21 [oryza sativa (japonica cultivar-group)]
  misc_feature (180)..(438): NCBI GI: 23506115 NCBI Desc: at4g25340/t30c3_20 [arabidopsis thaliana]
MAFWGVEVKPGKPYTHTHQADHGRLRICQATLGNCDAAARTVLQCNVGNKIPIKLCSLNPKLAETCHLEIEFEEVDDVVFSVIGQSSIHLSGYYVRASSRESYGEDIGHSDTDEEHDASEDSYESDFIDDREVPTPEKYGSDSIDDSDYECTLRRRRKQKAVEKPTQKAERRRRLKKHQVDSTDDNYDDTPVTKPVVKRSAKIFDSGDDDTPVTKPVDKRSAPSMFDSSSDEDDNVPISLALGKKDNAKVAEETDPQNGQANDITKKKIVDVKKRKHSAISEDPALSMDTTDVNATSVSKQGDEIKKKSKKKMKNQSGEKDEKQSNIRTLEDGLMVEDLSIGNIDAKVASDGCKVYIKYVGMLKNGKIVQSNASEKPYKFKLGAGKVIRGWDVGIRGMRVGEKRKVTVPPSMLSGGKSVGEVPDNSSVIYEIELVKVK

SEQ ID NO: 12323 - DNA, 729 bp, Sorghum bicolor
  misc_feature: Ceres ANNOT ID no. 6078223
  misc_feature: Encodes the peptide sequence at SEQ ID NO 12324
atgagagctccagctccagctcctcttcccgcgctgctctctcgctgctcctcgccgccctcctcggccccgccgcgccgcctcctctcctcctcccgcacgccggccgtctgccgcccgcctccggccgtcgcccgctctgtctccgtctccgtcgatgcgccggcggccgccgcggagcccactgtcttgggcgcgccctccgcgacgccgcgccgtcgcctcatcctcctccgccacggggagagcaccgccaggggccgctccacaagagatcatgacagacctctaagcaaggctgggagagctgacgcaatcagcgtttctaataaactccaacagatgggatggataccggagcttatcctctgcagtgatgcaatgcgtacaaaggaaactcttaagatactgcaagaccatgtccaaggattgtctgaagcagtagtgcactttatcccaagtttctactcaattgcggctatggatggccaaactgcagagcatttgcaaaaggcgatttgtgaatattcgagtgatgagatcttaactgtgatgtgcatggggcataataaaggatgggaagaagctgcctctatgttttctggtgattcagtagtgcttgagacatgtaacgctgcgttgctagaagctgcaggcaaatcatgggttgaggcattttctctggctggtttgggtggatggaagcttcatgggatcgtaaagccatga

SEQ ID NO: 12324 - protein, 242 aa, Sorghum bicolor
  misc_feature: Ceres ANNOT ID no. 6078223
  misc_feature (74)..(196): Pfam Id: PGAM Pfam Desc: Phosphoglycerate mutase family
  misc_feature (115)..(239): NCBI GI: 115478378 NCBI Desc: os09g0287300 [oryza sativa (japonica cultivar-group)]
  misc_feature (73)..(197): NCBI GI: 91976140 NCBI Desc: phosphoglycerate mutase [rhodopseudomonas palustris bisb5]
  misc_feature (73)..(222): NCBI GI: 110638733 NCBI Desc: phosphohistidine phosphatase [cytophaga hutchinsonii atcc 33406]
  misc_feature (73)..(231): NCBI GI: 67940445 NCBI Desc: phosphoglycerate/bisphosphoglycerate mutase [chlorobium phaeobacteroides bs1]
  misc_feature (73)..(203): NCBI GI: 126646682 NCBI Desc: phosphoglycerate mutase family domain protein [algoriphagus sp. pr1]
MRAPAPAPLPALLSRCSSPPSSAPPRRLLSSSRTPAVCRPPPAVARSVSVSVDAPAAAAEPTVLGAPSATPRRRLILLRHGESTARGRSTRDHDRPLSKAGRADAISVSNKLQQMGWIPELILCSDAMRTKETLKILQDHVQGLSEAVVHFIPSFYSIAAMDGQTAEHLQKAICEYSSDEILTVMCMGHNKGWEEAASMFSGDSVVLETCNAALLEAAGKSWVEAFSLAGLGGWKLHGIVKP

SEQ ID NO: 12325 - DNA, 615 bp, Sorghum bicolor
  misc_feature: Ceres ANNOT ID no. 6078901
  misc_feature: Encodes the peptide sequence at SEQ ID NO 12326
atggccagagaaatggagaagccaaggaaggctacttcttcccctaataagagctcaacgaatcataccggtcccaagagcccggtgaggaatggaggagggtctccgcctcataagaagaacactactgagccacgtggacgaaaaaatgagcagcaaaacgttcgaaaaggaggtcatcaagactcgttgtctcatgatgagagcaaacgccgttcttcatcaactgcacaaacctcacccaagtctcagagatcaccgagacacgaacaacccctgagctacaacaggcttcacactgaggagagagcaataaggcgggctggctacaattatcaggttgcaagcaagataaatacccaggaaatcattcgcagatttgaagagaagcttgcacagttgatggaggagcgcgagataaagctgatgaggaaggagatggttcccaaggctcaacttatgccagtatttgacaagccattccacccacaaaggtcgacgaggcctctgacggtgccaaaggagccaagtttcctgaggctgaaatgctgcatcggtggagagttccatcgccatttttgctacaatggagccaataataaggccatcaagtag

SEQ ID NO: 12326 - protein, 204 aa, Sorghum bicolor
  misc_feature: Ceres ANNOT ID no. 6078901
  misc_feature (98)..(154): Pfam Id: TPX2 Pfam Desc: Targeting protein for Xklp2 (TPX2)
  misc_feature (5)..(165): NCBI GI: 115478462 NCBI Desc: os09g0307300 [oryza sativa (japonica cultivar-group)]
  misc_feature (40)..(196): NCBI GI: 92888584 NCBI Desc: egf-like [medicago truncatula]
  misc_feature (43)..(165): NCBI GI: 115489250 NCBI Desc: os12g0577000 [oryza sativa (japonica cultivar-group)]
  misc_feature (19)..(108): NCBI GI: 18482474 NCBI Desc: transformer-2 alpha [macaca mulatta]
  misc_feature (3)..(108): NCBI GI: 119614195 NCBI Desc: transformer-2 alpha, isoform cra_b [homo sapiens]
MAREMEKPRKATSSPNKSSTNHTGPKSPVRNGGGSPPHKKNTTEPRGRKNEQQNVRKGGHQDSLSHDESKRRSSSTAQTSPKSQRSPRHEQPLSYNRLHTEERAIRRAGYNYQVASKINTQEIIRRFEEKLAQLMEEREIKLMRKEMVPKAQLMPVFDKPFHPQRSTRPLTVPKEPSFLRLKCCIGGEFHRHFCYNGANNKAIK

SEQ ID NO: 12327 - DNA, 684 bp, Sorghum bicolor
  misc_feature: Ceres ANNOT ID no. 6079038
  misc_feature: Encodes the peptide sequence at SEQ ID NO 12328
atggccgccgccgccgccgccgccgccatcgtcctgtgcgaggacgaccgggggattcctcgatctctcaccctcctcgcggcgctcgtagaggaggattctcgcctcaacgccgccgccgcctcccaaccagccgggagcgatctcgtccgcgccttccgcgggcgatcggttcccaagcttccgattcgcgaattcctcgagcgcatctatcttctggttcggtcggaggccgccaccgggcacgtgatccgcgtcgacgggacgtgtttcgtgctcgctggcgtttatctgacgcgattcatcggcagccacgcggcgcgggtggccgggatcgtggtgcagccgtccaccgcgcaccggctggtggccgtcgcgctgttactcggcggccactcccccaagaactggcccgccatgttcgaggcggcctcagaccgtgcgatcggcaccggcgagatcgcgggcctagaggagcggttcttgcgcgcgatcagctcccgcttgttcgtggacagccacgagtttaagtgcttctgcggggtcctggagaaggtgcccctgctgccgcgcgggagctgcgctagcaagaagaggcgggcggacgccgtggccggagacgaggaggaggagcaccgccgcgtccgcgcttgcctgccaccacccgccgtgatgtccaattag

SEQ ID NO: 12328 - protein, 227 aa, Sorghum bicolor
  misc_feature: Ceres ANNOT ID no. 6079038
  misc_feature (23)..(169): Pfam Id: Cyclin Pfam Desc: Cyclin
  misc_feature (1)..(227): NCBI GI: 115463217 NCBI Desc: os05g0327000 [oryza sativa (japonica cultivar-group)]
  misc_feature (20)..(184): NCBI GI: 41053064 NCBI Desc: preg-like protein [oryza sativa (japonica cultivar-group)]
MAAAAAAAAIVLCEDDRGIPRSLTLLAALVEEDSRLNAAAASQPAGSDLVRAFRGRSVPKLPIREFLERIYLLVRSEAATGHVIRVDGTCFVLAGVYLTRFIGSHAARVAGIVVQPSTAHRLVAVALLLGGHSPKNWPAMFEAASDRAIGTGEIAGLEERFLRAISSRLFVDSHEFKCFCGVLEKVPLLPRGSCASKKRRADAVAGDEEEEHRRVRACLPPPAVMSN

SEQ ID NO: 12329 - DNA, 963 bp, Sorghum bicolor
  misc_feature: Ceres ANNOT ID no. 6079196
  misc_feature: Encodes the peptide sequence at SEQ ID NO 12330
atgtgctcgggatccgacgcccgagcctccgtgaccgtgattttgctacctcgcggaatgctcctcctacctgcgtcagccgctgcttcctatccgcttctcctccccgccagaaccggaggccaaggaggagcccgtatccacgccgccaaactccaagctctcaacgggcgactgttgcgctcgtccttctctactctcagctgctcctgctctccctctccatctcccggcgacggtggggaagacagcgcccgcagcctgttcgatgagctttcagttctttctccagtcgttccatgggaggttgatgatatatggagaatatatgctggttatttcttcatcttgcatatccccttgagctttggagggcttggtgtggttgccaaagtgctacagtgctcctcacttgactcaatgacaacattagcagagcttgttttgaccttagtgctactccagtacactgcaaagccagggcaaactattcaacctttcttttctgggaagatttttacagaacggaattgggtcaaagagactgtattaggctttgtagttttgatggccctggtattgaccacatccatcttagctgataaattggtagggtctgaggatgcatatgatccgatattaaaggagatcctttctgacaatccagcctctgctctattgtgtttctttctctactgtgttattgctccgctatcagaagaaaccatctaccgtgggttccttttaacatctttgtcatcttcaatgaaatggcgagacgctgtcgtggtcagttcacttgcgttcactgtatctcacctctccagtaatggttccattcaactgttcgttgttggatgtattacagggttggcttattgtcgaactggaactttggctgcttctttcaccatccattctctgtataatgcagtattattgtatatggcttttgtatcatga

SEQ ID NO: 12330 - protein, 320 aa, Sorghum bicolor
  misc_feature: Ceres ANNOT ID no. 6079196
  misc_feature (227)..(317): Pfam Id: Abi Pfam Desc: CAAX amino terminal protease family
  misc_feature (100)..(319): NCBI GI: 67923040 NCBI Desc: abortive infection protein [crocosphaera watsonii wh 8501]
  misc_feature (87)..(319): NCBI GI: 75907768 NCBI Desc: abortive infection protein [anabaena variabilis atcc 29413]
  misc_feature (100)..(319): NCBI GI: 126659583 NCBI Desc: abortive infection protein [cyanothece sp. ccy0110]
  misc_feature (138)..(319): NCBI GI: 42571465 NCBI Desc: caax amino terminal protease family protein [arabidopsis thaliana]
  misc_feature (99)..(319): NCBI GI: 113475825 NCBI Desc: abortive infection protein [trichodesmium erythraeum ims101]
MCSGSDARASVTVILLPRGMLLLPASAAASYPLLLPARTGGQGGARIHAAKLQALNGRLLRSSFSTLSCSCSPSPSPGDGGEDSARSLFDELSVLSPVVPWEVDDIWRIYAGYFFILHIPLSFGGLGVVAKVLQCSSLDSMTTLAELVLTLVLLQYTAKPGQTIQPFFSGKIFTERNWVKETVLGFVVLMALVLTTSILADKLVGSEDAYDPILKEILSDNPASALLCFFLYCVIAPLSEETIYRGFLLTSLSSSMKWRDAVVVSSLAFTVSHLSSNGSIQLFVVGCITGLAYCRTGTLAASFTIHSLYNAVLLYMAFVS

SEQ ID NO: 12331 - DNA, 1032 bp, Sorghum bicolor
  misc_feature: Ceres ANNOT ID no. 6079587
  misc_feature: Encodes the peptide sequence at SEQ ID NO 12332
atgctgcagcagcagccgccgccgccgcaccggcacgccaagacggactcggaggtgacgtcgagcatggcggcgtcgtcgccgccgcgggcggcctactacgtgcagtcgccgagccacgacgacggggacaacaagacggccgcctcctccttccactcctccccggccgcgtccccgccgcggtcgctggggcgagcgtccagggactcctcctcctcctcccgcttctccgccagcgccaagagcgccggtgccgccggaccgggaggcgtcgcggccgtccccggcggccggcgacgcagcagcccgtggatgaaggaggcggccatcgaggaggaaggtctcctcggcatggacgacgacgacggcgacggctccggaggccacggcagcgggatcccgaagcgggtgcggtacgcgctcggcttcgtgggggccttcttcgggctcttcttcttcttcgcgctcatcctgtggggcgccagccgcaaccagcggcccgtcgtcaccctccgcgccgtcacgttccaccgcttcgtggtgcaggccgggaccgacgcgtcgctcgtccccaccgagatggcctcgctcaacgccaccgtcgccctcgtcttccgcaacaccggcaccttcttcggcgtccacgtctccgccgaccccgtcacgctctactacacacagctccagctcgcgtccggcaatataaagtacttctaccagtctcggaagagccagcggagcctgaaggtggcggtggtcggcgacaaggtgcccctgtacggcggcgggtcggggctgagcagcacggcgacgacgcttccgccgcccaagaagcgggcgccgccggtggtggtgccgccgccgcccgtgccgctgcagctgacggtgcggctgcggtcgcgcgccttcgtgctggggaggctggtgaagcccaagttctacagcgaggcacgctgcagcgtcaccatggaccagaccaagctcggcaagcccgtctccctcaacaaggcctgcacctacacccactag

SEQ ID NO: 12332 - protein, 343 aa, Sorghum bicolor
  misc_feature: Ceres ANNOT ID no. 6079587
  misc_feature (160)..(320): Pfam Id: Hin1 Pfam Desc: Harpin-induced protein 1 (Hin1)
  misc_feature (10)..(340): NCBI GI: 32488073 NCBI Desc: osjnba0084a10.1 [oryza sativa (japonica cultivar-group)]
  misc_feature (10)..(340): NCBI GI: 115458438 NCBI Desc: os04g0430600 [oryza sativa (japonica cultivar-group)]
  misc_feature (10)..(340): NCBI GI: 116309975 NCBI Desc: osigba0160i14.1 [oryza sativa (indica cultivar-group)]
  misc_feature (12)..(341): NCBI GI: 5777621 NCBI Desc: caa30379.1 protein [oryza sativa]
  misc_feature (12)..(341): NCBI GI: 38345517 NCBI Desc: osjnba0039k24.20 [oryza sativa (japonica cultivar-group)]
  misc_feature: Useful for making plants with altered cell wall content and/or composition
  misc_feature: Functional homolog of the protein sequence encoded by LOCUS at1g45688
MLQQQPPPPHRHAKTDSEVTSSMAASSPPRAAYYVQSPSHDDGDNKTAASSFHSSPAASPPRSLGRASRDSSSSSRFSASAKSAGAAGPGGVAAVPGGRRRSSPWMKEAAIEEEGLLGMDDDDGDGSGGHGSGIPKRVRYALGFVGAFFGLFFFFALILWGASRNQRPVVTLRAVTFHRFVVQAGTDASLVPTEMASLNATVALVFRNTGTFFGVHVSADPVTLYYTQLQLASGNIKYFYQSRKSQRSLKVAVVGDKVPLYGGGSGLSSTATTLPPPKKRAPPVVVPPPPVPLQLTVRLRSRAFVLGRLVKPKFYSEARCSVTMDQTKLGKPVSLNKACTYTH

SEQ ID NO: 12333 - DNA, 2334 bp, Sorghum bicolor
  misc_feature: Ceres ANNOT ID no. 6079607
  misc_feature: Encodes the peptide sequence at SEQ ID NO 12334
atggcgagcgccaagacgaagctgcggctgcaggagagggtcccgctcccacgcaccgcgtggaagctggctgaccttgccgttctcttcctgctcctggccctcctcgctcgccgtgcgtcctcgctggtggcggctggcggtgccggcgcggcgccggcgtgcacctggtgctgggtcgccgcgctcatctgcgaggcatggttcacggtggtgtggctcctcaacatgaacgccaagtggaacccggtccgcttcgacacgcaccctgaacgcctcgccgaacggaccgacgagctgccggcggtggacatgttcgtgacgacggcggacccgaagctggagccgccgctggtgacggtgaacacggtgctgtcgctgctggcgctggactaccccgcgggcaagctgtcgtgctacgtctccgacgacgggtgctcggcggtgacctgctacgcgctgcgcgaggccgccgagttcgccaagctctgggtgcccttctgcaagaagcacggcgtcaaggtcagggcccccttcgtctacttctccgagcgtggcggggccgcagccgacgacgacgacgacgttgttgagttcttgcgcgcttggacgtccatgaagaacgagtacgaggagttggtacgccggatcgagaacgccgaagagtactctttagtccggcgtgccgacggcgagttcgccgagttcgtgggtgctgaccgcaggaatcacccgaccataatcaaggtgctctgggacagcagcaatcaggatgctgcaggcgatgggatcccaagcctcgtatacgtctccagggagaagagccccacacagaaccaccacttcaaggccggagccatgaacgtcctgacgagggtgtccggcgtggtgaccaacgctcccatcatgctgaacgtggactgcgacatgtttgcaaacaacccgcaggtggctctccacgccatgtgccttctcctgggcttcgatgacgacgtccacagcggcttcgtccaggcgccgcagaagttctacggcgccctcaaggacgaccctttcgggaaccagctgcaggtcatattcgagaaagttgtatccggagttgccggaattcaaggcatatattactgtgggacgggttgctttcaccgtaggaaagtcatgtacggcgtgccaccagacaacgccgccgccaccaccaccagcatgaaagattcaccgtcttacaaggagctacagaacaggtttggcagatcgaatgaactgatcgagtcagcgaggagcatcatttcaggggacatgttcagaatcagaacaccaactgtggtggtgccagacctaacgagtcgcatcgaagcagccaaacaagtctctgcctgcagctacgagaccggcacgagctggggtcaggaggttggctgggtctacgggtccatgaccgaggacgttctgaccgggcagcgcatccatgccgctggctggaggtcggcgatcctcaaccctgacccgccggcgttcctcggcggtgcgcccaccggcgggccggcaagcctcacccagtacaagagatgggcgacgggcctgctggagatactcctcagccgccataaccctatcctcctctccgcgttcaagcgcctcgatttccggcagtgcgtcgcctacctagtcattgacgtgtggcccgtcagggcaccttttgaggtgtgctacgcattgctcggaccttactgcatcatcgcaaaccactccttcctgccaaaggttacggcgtcagaaccgggtttcctcatcctgctggtcctgttcctaggttacaacgtgtacaacttgggtgagtacaaggactgccggctctcggtgcgcgcctggtggaacaaccacaggatgcagcggatcgtgtcgtcctccgcctggctgctcgcgttcctcaccgtcgtcctcaagacgctcggcctctcggagacggtgttcgaggtgacgcgcaaggagcagaagagctcgtctgatggtggtgcggacgccgacgacgccgacccggggcggttcacctttgactcgtcgccggtgttcgtcccgccgacagcgctcacgatgctgagcatcgtcgccgtcgccgttggagcgtggaggctggtcgccggtgcgggggaagaaggcgtgtccggcggctcgggcgtcggggagctcgtgtgctgcggctggctggtgctctgcttctggccgttcgtgagggggctggtcggcggcagggggagctacagcatcccctggagcgtaaggctgaaggctgccctgctcgtggccgcgttcgtgcacttgtccacacggaagtaa

SEQ ID NO: 12334 - protein, 777 aa, Sorghum bicolor
  misc_feature: Ceres ANNOT ID no. 6079607
  misc_feature (9)..(778): Pfam Id: Cellulose_synt Pfam Desc: Cellulose synthase
  misc_feature (10)..(776): NCBI GI: 116309324 NCBI Desc: osigba0093l02.6 [oryza sativa (indica cultivar-group)]
  misc_feature (61)..(771): NCBI GI: 34419212 NCBI Desc: tpa: cellulose synthase-like h1 [oryza sativa]
  misc_feature (61)..(771): NCBI GI: 17385973 NCBI Desc: cslh1 [oryza sativa]
  misc_feature (289)..(776): NCBI GI: 34419214 NCBI Desc: tpa: cellulose synthase-like h2 [oryza sativa (indica cultivar-group)]
  misc_feature (289)..(776): NCBI GI: 68611262 NCBI Desc: osjnba0042l16.13 [oryza sativa (japonica cultivar-group)]
  misc_feature: Useful for making plants with altered cell wall content and/or composition
  misc_feature: GREAT-hit functional homolog of the protein sequence encoded by LOCUS at2g32530
  misc_feature: GREAT-hit functional homolog of the protein sequence encoded by LOCUS at2g32540
  misc_feature: Functional homolog of the protein sequence encoded by LOCUS at2g32610
  misc_feature: Functional homolog of the protein sequence encoded by LOCUS at4g15290
  misc_feature: Functional homolog of the protein sequence encoded by LOCUS at4g15320
MASAKTKLRLQERVPLPRTAWKLADLAVLFLLLALLARRASSLVAAGGAGAAPACTWCWVAALICEAWFTVVWLLNMNAKWNPVRFDTHPERLAERTDELPAVDMFVTTADPKLEPPLVTVNTVLSLLALDYPAGKLSCYVSDDGCSAVTCYALREAAEFAKLWVPFCKKHGVKVRAPFVYFSERGGAAADDDDDVVEFLRAWTSMKNEYEELVRRIENAEEYSLVRRADGEFAEFVGADRRNHPTIIKVLWDSSNQDAAGDGIPSLVYVSREKSPTQNHHFKAGAMNVLTRVSGVVTNAPIMLNVDCDMFANNPQVALHAMCLLLGFDDDVHSGFVQAPQKFYGALKDDPFGNQLQVIFEKVVSGVAGIQGIYYCGTGCFHRRKVMYGVPPDNAAATTTSMKDSPSYKELQNRFGRSNELIESARSIISGDMFRIRTPTVVVPDLTSRIEAAKQVSACSYETGTSWGQEVGWVYGSMTEDVLTGQRIHAAGWRSAILNPDPPAFLGGAPTGGPASLTQYKRWATGLLEILLSRHNPILLSAFKRLDFRQCVAYLVIDVWPVRAPFEVCYALLGPYCIIANHSFLPKVTASEPGFLILLVLFLGYNVYNLGEYKDCRLSVRAWWNNHRMQRIVSSSAWLLAFLTVVLKTLGLSETVFEVTRKEQKSSSDGGADADDADPGRFTFDSSPVFVPPTALTMLSIVAVAVGAWRLVAGAGEEGVSGGSGVGELVCCGWLVLCFWPFVRGLVGGRGSYSIPWSVRLKAALLVAAFVHLSTRK

SEQ ID NO: 12335 - DNA, 882 bp, Sorghum bicolor
  misc_feature: Ceres ANNOT ID no. 6079626
  misc_feature: Encodes the peptide sequence at SEQ ID NO 12336
atggccggcatcaacaagcgccgcacctcgccggcctccacctcctcttcctccggcggcgacgtcttgccgcagcgggtcacccggaagcgtaggtccgtccgccgcggggcccggaccgccgcccggaggccgtcgtcggcgcctcgacctataaatgaactggacttgaatacagctgctcttgatccggatcattatgctacaggattgagagttcttcttcagaaggagctccgaaatagcgatgtaagccagcttgggagaattgttctcccaaagaaggaggcggagtcttacctccctattctgatggcaaaggatggaaagagtttatgtatgcatgacttgctaaatgcacaactttggaccttcaagtatagatattggttcaacaacaaaagcaggatgtatgtgcttgaaaatactggagattatgtaaaagctcatgaccttcagcaaggagacttcattgtgatatacaaagacgacgagaacaaccgctttgtcataggagcaaagaaggcaggagatgaacagactgccactgtgccccaagtccatgagcatatacacatctctgccgcactgccagctccacaagcgttccatgactatgcaggccccgttgcggcagaagctgatatgctcgcgatcgtgccacaagctgatgagatattcgacggcatactgaactccctgccagaaataccagtagcgaacgtcaggtactccgacttcttcgacccgttcggtgactccatggacatggcaaatcccctgagctccaataacccctcggtcaacctggccacacatttccatgacgagaagatcgggagctgttcgttcccctacccaaaatccgggcctctgatgtga

SEQ ID NO: 12336 - protein, 293 aa, Sorghum bicolor
  misc_feature: Ceres ANNOT ID no. 6079626
  misc_feature (74)..(179): Pfam Id: B3 Pfam Desc: B3 DNA binding domain
  misc_feature (1)..(293): NCBI GI: 56785317 NCBI Desc: regulatory protein viviparous-1-like [oryza sativa (japonica cultivar-group)]
  misc_feature (1)..(293): NCBI GI: 134244196 NCBI Desc: lfl1 [oryza sativa (japonica cultivar-group)]
  misc_feature (29)..(189): NCBI GI: 3582518 NCBI Desc: fusca3 [arabidopsis thaliana]
  misc_feature (25)..(189): NCBI GI: 18405094 NCBI Desc: transcriptional regulator (fusca3) [arabidopsis thaliana]
  misc_feature (25)..(189): NCBI GI: 3582520 NCBI Desc: fusca3 [arabidopsis thaliana]
  misc_feature: Abnormal phyllotaxy, leaf number higher than wild-type
  misc_feature: The plant flowers significantly late compared to wild-type.
  misc_feature: The plant is abnormally small.
  misc_feature: The sequence is a functional homolog of SEQ ID NO 24 in the 10/225,066US patent application
  misc_feature: The sequence is a functional homolog of SEQ ID NO 246 in the 10/225,066US patent application
  misc_feature: The sequence is a functional homolog of SEQ ID NO 2502 in the 10/374,780US patent application
  misc_feature: The sequence is a functional homolog of SEQ ID NO 36 in the 11/375,241US patent application
  misc_feature: The sequence is a functional homolog of SEQ ID NO 44 in the 10/838,616US patent application
  misc_feature: The sequence is a functional homolog of SEQ ID NO 440 in the 10/374,780US patent application
  misc_feature: The sequence is a functional homolog of SEQ ID NO 46 in the 10/838,616US patent application
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12891
  misc_feature: Functional homolog of the protein sequence given in SEQ ID NO 13512
  misc_feature: The sequence is a functional homolog of SEQ ID NO 24 in the 20050160493 US patent application
  misc_feature: The sequence is a functional homolog of SEQ ID NO 246 in the 20050160493 US patent application
  misc_feature: The sequence is a functional homolog of SEQ ID NO 44 in the 20060008874 US patent application
  misc_feature: The sequence is a functional homolog of SEQ ID NO 46 in the 20060008874 US patent application
MAGINKRRTSPASTSSSSGGDVLPQRVTRKRRSVRRGARTAARRPSSAPRPINELDLNTAALDPDHYATGLRVLLQKELRNSDVSQLGRIVLPKKEAESYLPILMAKDGKSLCMHDLLNAQLWTFKYRYWFNNKSRMYVLENTGDYVKAHDLQQGDFIVIYKDDENNRFVIGAKKAGDEQTATVPQVHEHIHISAALPAPQAFHDYAGPVAAEADMLAIVPQADEIFDGILNSLPEIPVANVRYSDFFDPFGDSMDMANPLSSNNPSVNLATHFHDEKIGSCSFPYPKSGPLM

SEQ ID NO: 12337 - DNA, 279 bp, Sorghum bicolor
  misc_feature: Ceres ANNOT ID no. 6079731
  misc_feature: Encodes the peptide sequence at SEQ ID NO 12338
atgtcgcagaacgcggcggcggcgtgggcgcaggccgccgagcgggagcgccgggcgccgttcacggaccccatcgagatcccggccacctcggggccgcggcgggaggagggtcagggagacgatgacggcgaggcggcggtgccgccgcacgtgctgctggcgcggcgcagggcggcgtcctcggtgtgctccgggcagggccgcacgctcaagggccgggacctgcgccgcgtgcgcgactccgtcctgcggatgaccggcttcatcgagagctag

SEQ ID NO: 12338 - protein, 92 aa, Sorghum bicolor
  misc_feature: Ceres ANNOT ID no. 6079731
  misc_feature (19)..(91): NCBI GI: 21741306 NCBI Desc: osjnbb0103i08.8 [oryza sativa (japonica cultivar-group)]
  misc_feature (41)..(91): NCBI GI: 56785008 NCBI Desc: prolyl 4-hydroxylase alpha subunit-like [oryza sativa (japonica cultivar-group)]
  misc_feature (37)..(89): NCBI GI: 116310726 NCBI Desc: osigba0131l05.3 [oryza sativa (indica cultivar-group)]
  misc_feature (36)..(91): NCBI GI: 15983450 NCBI Desc: at3g15040/k15m2_18 [arabidopsis thaliana]
  misc_feature (48)..(91): NCBI GI: 94982649 NCBI Desc: prolyl 4-hydroxylase alpha subunit-like [musa acuminata]
MSQNAAAAWAQAAERERRAPFTDPIEIPATSGPRREEGQGDDDGEAAVPPHVLLARRRAASSVCSGQGRTLKGRDLRRVRDSVLRMTGFIES

SEQ ID NO: 12339 - DNA, 915 bp, Sorghum bicolor
  misc_feature: Ceres ANNOT ID no. 6079935
  misc_feature: Encodes the peptide sequence at SEQ ID NO 12340
atgtcgtcggccgaggacggctactgcagctcggattcgccgcgggcggaatcccccgacgagccgctgctgcctgcggcggtggcggacgcggacgcggagtcccctcgcgccgccgggtccgggatgaacaagcgcgagcgcgacctcagcgacctccccgcctcgccgtcgtcgccgctgccgccagctaagcgcagccggagatcggtggagaagcgggtcgtgtcggtgccgctggccgagtgcggggaccggcccagaggggccaccggggaggggccgccgccgtcggactcgtgggcgtggcgcaagtatgggcagaagcccatcaagggctccccctacccacgcagctccaaggggtgcccggcgaggaagcaggtggagcgcagccgcgcggaccccaccgtgctgctcgtcacctacaccttcgaccacaaccacgaggcgccgcagccgaagagcagcagctgccaccagcaaggcaagccgtccacgcggccgccggcgccgaagcctgagcccgtggtcgagcaggatgagcttggtccggagcatgagctggcagaaacagaagtgccagagcagcaggagccggtggaagaggagcaggagcagaaggtcgtcccaggtctggccgggccggaagcggaagcggaagcggaaccaaccgcaacggtggcgccggcggcagccgaggaggacgaaagcttcgactttgggtggttcgaccagtacccgacgtggcaccgttcggcgctgtacgcgccgctgctgccgccggaggagtgggagcgggagctgcagggggaagacgccctgttcgcggggctcggcgagctgcccgagtgcgccgtcgtgttcgggcgacgccgcgagctcagcctggccaccaccgcgccgtgctcctga

SEQ ID NO: 12340 - protein, 304 aa, Sorghum bicolor
  misc_feature: Ceres ANNOT ID no. 6079935
  misc_feature (97)..(151): Pfam Id: WRKY Pfam Desc: WRKY DNA -binding domain
  misc_feature (2)..(304): NCBI GI: 14209559 NCBI Desc: p0481e12.40 [oryza sativa (japonica cultivar-group)]
  misc_feature (31)..(304): NCBI GI: 126508734 NCBI Desc: wrky13 transcription factor [triticum aestivum]
  misc_feature (2)..(146): NCBI GI: 57899517 NCBI Desc: wrky transcription factor-like [oryza sativa (japonica cultivar-group)]
  misc_feature (51)..(292): NCBI GI: 15289829 NCBI Desc: p0435h01.23 [oryza sativa (japonica cultivar-group)]
  misc_feature (25)..(188): NCBI GI: 92871862 NCBI Desc: dna-binding wrky [medicago truncatula]
  misc_feature: The plants are small.
  misc_feature: The sequence is a functional homolog of SEQ ID NO 10 in the 10/412,699US patent application
  misc_feature: The sequence is a functional homolog of SEQ ID NO 1020 in the 10/412,699US patent application
  misc_feature: The sequence is a functional homolog of SEQ ID NO 1021 in the 10/412,699US patent application
  misc_feature: The sequence is a functional homolog of SEQ ID NO 1024 in the 10/412,699US patent application
  misc_feature: The sequence is a functional homolog of SEQ ID NO 1026 in the 10/412,699US patent application
  misc_feature: The sequence is a functional homolog of SEQ ID NO 124 in the 11/479,226US patent application
  misc_feature: The sequence is a functional homolog of SEQ ID NO 525 in the 10/374,780US patent application
  misc_feature: The sequence is a functional homolog of SEQ ID NO 526 in the 10/374,780US patent application
  misc_feature: The sequence is a functional homolog of SEQ ID NO 528 in the 10/374,780US patent application
  misc_feature: The sequence is a functional homolog of SEQ ID NO 530 in the 10/374,780US patent application
  misc_feature: The sequence is a functional homolog of SEQ ID NO 534 in the 10/374,780US patent application
  misc_feature: Useful for making plants with modulated biomass
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1020 in the 20040045049 US patent application
  misc_feature: The sequence is a functional homolog of SEQ ID NO 1021 in the 20040045049 US patent application
  misc_feature: The sequence is a functional homolog of SEQ ID NO 1024 in the 20040045049 US patent application
  misc_feature: The sequence is a functional homolog of SEQ ID NO 1026 in the 20040045049 US patent application
  misc_feature: The sequence is a functional homolog of SEQ ID NO 528 in the 20060162006 US patent application
  misc_feature: Functional homolog of the protein sequence given in SEQ ID NO 13583
MSSAEDGYCSSDSPRAESPDEPLLPAAVADADAESPRAAGSGMNKRERDLSDLPASPSSPLPPAKRSRRSVEKRVVSVPLAECGDRPRGATGEGPPPSDSWAWRKYGQKPIKGSPYPRSSKGCPARKQVERSRADPTVLLVTYTFDHNHEAPQPKSSSCHQQGKPSTRPPAPKPEPVVEQDELGPEHELAETEVPEQQEPVEEEQEQKVVPGLAGPEAEAEAEPTATVAPAAAEEDESFDFGWFDQYPTWHRSALYAPLLPPEEWERELQGEDALFAGLGELPECAVVFGRRRELSLATTAPCS

SEQ ID NO: 12341 - DNA, 1149 bp, Sorghum bicolor
  misc_feature: Ceres ANNOT ID no. 6080294
  misc_feature: Encodes the peptide sequence at SEQ ID NO 12342
atgaaccatctccagcaccaccagcacccggccaccgccgccgccgccgccgcataccagcaggaaggtggcgctggtgttggtgcccgcatcagcggcggcgccggagatcaggagattcaggacgccgccgccgccttcccgtcgctccaggtgctccgcgcctcccagccacagacggccgtgcccgccagcgtccgagtccgggacctgacggtgcaggtgggtgactacggcggcctgaccaacagcagcagctccggcgacagccccggcgcgggcgcgggcgccgccatggaccacgacgcggtggccgccgcgtggtccccccacaccgcgcgctccaggaccacgggccttggcggcggcagcaacagcaggccggtcagctggaacttcagcgccgcgtcggcgctgccagcggacgaccgcggcgccgtcgcggtcgccctgccggacgccacggcggcggtcgcgagggtgcaacaacgtgctgcgtctgcgtctgcggggaggagagggggcagcgccggcccatccgctgcggcaacgtcgccggggcctgtgcaggaccacatcatcgccgagcggcggcggagggagaagatcaaccagcggttcatcgagctctccactgtcatccccggcctcaagaagatggacaaggcgaccattcttggggacgcggtgaagtacgtgagggagctgcaggagaaggtgaagggcctcgaggaggatggagccgccggtggcagcggcagcattcagtcggcagtgctcgtcacgaagcagcaatgccatatgtccgaggacgaggccatggcgagcagccatggcggtagcggtggcgccgacggcggtatgcagctaccggagatcgaggcacggctgtcggagaggagcgtgctgctgcggatccactgctacagcgcgagggggctgctggtgagggtgatctcggaggtggagcagatgcagctctccatcacccataccaatgtcatgcccttcccagcctccactgccatcatcaccatcacagccaaggtggaggagggattcaatgccacggtagatgagatcgtgagaaggattaactccgcgctgcgccaacattatagcagcagttctgaagaaacaagaggataa

SEQ ID NO: 12342 - protein, 382 aa, Sorghum bicolor
  misc_feature: Ceres ANNOT ID no. 6080294
  misc_feature (188)..(237): Pfam Id: HLH Pfam Desc: Helix-loop-helix DNA-binding domain
  misc_feature (190)..(368): NCBI GI: 3399777 NCBI Desc: symbiotic ammonium transporter; nodulin [glycine max]
  misc_feature (191)..(368): NCBI GI: 92883256 NCBI Desc: basic helix-loop-helix dimerisation region bhlh [medicago truncatula]
  misc_feature (162)..(367): NCBI GI: 144922982 NCBI Desc: helix-loop-helix dna-binding [medicago truncatula]
  misc_feature (159)..(369): NCBI GI: 30691602 NCBI Desc: basic helix-loop-helix (bhlh) family protein [arabidopsis thaliana]
  misc_feature (175)..(369): NCBI GI: 91806240 NCBI Desc: basic helix-loop-helix family protein [arabidopsis thaliana]
  misc_feature: The sequence is a functional homolog of SEQ ID NO 1272 in the 10/666,642US patent application
  misc_feature: The sequence is a functional homolog of SEQ ID NO 1273 in the 10/666,642US patent application
  misc_feature: The sequence is a functional homolog of SEQ ID NO 1274 in the 10/666,642US patent application
  misc_feature: The sequence is a functional homolog of SEQ ID NO 1275 in the 10/666,642US patent application
  misc_feature: The sequence is a functional homolog of SEQ ID NO 1276 in the 10/666,642US patent application
  misc_feature: The sequence is a functional homolog of SEQ ID NO 1701 in the 10/374,780US patent application
  misc_feature: The sequence is a functional homolog of SEQ ID NO 1702 in the 10/374,780US patent application
  misc_feature: The sequence is a functional homolog of SEQ ID NO 1703 in the 10/374,780US patent application
  misc_feature: The sequence is a functional homolog of SEQ ID NO 1704 in the 10/374,780US patent application
  misc_feature: The sequence is a functional homolog of SEQ ID NO 1705 in the 10/374,780US patent application
  misc_feature: The sequence is a functional homolog of SEQ ID NO 2194 in the 10/374,780US patent application
  misc_feature: The sequence is a functional homolog of SEQ ID NO 42 in the 11/375,241US patent application
  misc_feature: The sequence is a functional homolog of SEQ ID NO 530 in the 10/666,642US patent application
  misc_feature: The sequence is a functional homolog of SEQ ID NO 955 in the 10/374,780US patent application
  misc_feature: The sequence is a functional homolog of SEQ ID NO 96 in the 10/374,780US patent application
  misc_feature: The sequence is a functional homolog of SEQ ID NO 960 in the 10/374,780US patent application
  misc_feature: Useful for making plants with modulated growth and phenotype characteristics
  misc_feature: The sequence is a functional homolog of SEQ ID NO 1701 in the 20060162006 US patent application
  misc_feature: The sequence is a functional homolog of SEQ ID NO 1702 in the 20060162006 US patent application
  misc_feature: The sequence is a functional homolog of SEQ ID NO 1703 in the 20060162006 US patent application
  misc_feature: The sequence is a functional homolog of SEQ ID NO 1704 in the 20060162006 US patent application
  misc_feature: The sequence is a functional homolog of SEQ ID NO 1705 in the 20060162006 US patent application
  misc_feature: The sequence is a functional homolog of SEQ ID NO 2194 in the 20060162006 US patent application
  misc_feature: The sequence is a functional homolog of SEQ ID NO 955 in the 20060162006 US patent application
  misc_feature: The sequence is a functional homolog of SEQ ID NO 96 in the 20060162006 US patent application
  misc_feature: The sequence is a functional homolog of SEQ ID NO 960 in the 20060162006 US patent application
  misc_feature: The sequence is a functional homolog of SEQ ID NO. 483 in the 11/188,298 US application
  misc_feature: The sequence is a functional homolog of SEQ ID NO. 414 in the 11/188,298 US application
MNHLQHHQHPATAAAAAAYQQEGGAGVGARISGGAGDQEIQDAAAAFPSLQVLRASQPQTAVPASVRVRDLTVQVGDYGGLTNSSSSGDSPGAGAGAAMDHDAVAAAWSPHTARSRTTGLGGGSNSRPVSWNFSAASALPADDRGAVAVALPDATAAVARVQQRAASASAGRRGGSAGPSAAATSPGPVQDHIIAERRRREKINQRFIELSTVIPGLKKMDKATILGDAVKYVRELQEKVKGLEEDGAAGGSGSIQSAVLVTKQQCHMSEDEAMASSHGGSGGADGGMQLPEIEARLSERSVLLRIHCYSARGLLVRVISEVEQMQLSITHTNVMPFPASTAIITITAKVEEGFNATVDEIVRRINSALRQHYSSSSEETRG

SEQ ID NO: 12343 - DNA, 1146 bp, Sorghum bicolor
  misc_feature: Ceres ANNOT ID no. 6080524
  misc_feature: Encodes the peptide sequence at SEQ ID NO 12344
atgtctgccgccactgcttgcatgcccctggtccctccgtctcctctccatggatcatcggcggcaatggcggcggccgttgagaggcggcagcagcccggtgccatggagaccaccaagaccgccggttccgagggaacggtcgtcgtcaagagccatggcaacgatcaggactgtgccggggacgacgacggcgacgtgacgatgagcaggccgcgggcggtggtccagacactgacctgcgagcgcaagcccttctctgagggcttcgcgctctggcggagcatcggcaggcctgagcttccggaactggatcctatcttgtccttcgacgagttcgagttttctgcgccagctggctttcctgaccatcctcacagaggatttgagaatgttacctatatgctcgagggaggcatcagttaccatgacttttcaggccacaagggaacaatcaacacaggagacgttcagtggctgacggcggggcgcggcgtggtgcacgcggagatgcccgccggcgagggcgtgcagcggggcatcaacatctggatcaacctttccgccgccgacaagatgtatgcgttggtggagccgaggtaccaggacctggcgagccacgacatccccaccgccgtcaccgccgacggcgtctccgtcaaggtcatcgcgggcgagtgcctcggaacgcgatccctgctccggccacgcaccccggcgctgtgtctcgacgtcgcactacggcccagggcgcgcctgcgccagcccatcccgcgcgggtggagcgcatgcgcgtacgtcatccacggcgaggccgccttcttcggcggcagtgccagtgacggcggcgccactaccgtcaccaccgccgccgcacgcacgctcgtcgtgttcggcaacgaaggtgacggcgactgcgtggaggtgcggggggctgatgcatcagcggggcagcaggacggcgcgagggtcatgctggtggcggcgcggccgcacaacgaagcggtggtaagggacgggcccttcgtcatgaacacccgggaggaggtggaacaggcacgggaggactaccgccgccgccgcaatggcttcgagatggctgatggctggacctccgaccacgcatccactgttgcaacacattga

SEQ ID NO: 12344 - protein, 381 aa, Sorghum bicolor
  misc_feature: Ceres ANNOT ID no. 6080524
  misc_feature (89)..(185): Pfam Id: Pirin Pfam Desc: Pirin
  misc_feature (242)..(363): Pfam Id: Pirin_C Pfam Desc: Pirin C-terminal cupin domain
  misc_feature (1)..(318): NCBI GI: 115476096 NCBI Desc: os08g0364900 [oryza sativa (japonica cultivar-group)]
  misc_feature (70)..(302): NCBI GI: 6651245 NCBI Desc: pirin [lycopersicon esculentum]
  misc_feature (68)..(309): NCBI GI: 115479843 NCBI Desc: os09g0484800 [oryza sativa (japonica cultivar-group)]
  misc_feature (69)..(373): NCBI GI: 28881146 NCBI Desc: related to pirin [neurospora crassa]
  misc_feature (69)..(373): NCBI GI: 119484194 NCBI Desc: pirin [neosartorya fischeri nrrl 181]
MSAATACMPLVPPSPLHGSSAAMAAAVERRQQPGAMETTKTAGSEGTVVVKSHGNDQDCAGDDDGDVTMSRPRAVVQTLTCERKPFSEGFALWRSIGRPELPELDPILSFDEFEFSAPAGFPDHPHRGFENVTYMLEGGISYHDFSGHKGTINTGDVQWLTAGRGVVHAEMPAGEGVQRGINIWINLSAADKMYALVEPRYQDLASHDIPTAVTADGVSVKVIAGECLGTRSLLRPRTPALCLDVALRPRARLRQPIPRGWSACAYVIHGEAAFFGGSASDGGATTVTTAAARTLVVFGNEGDGDCVEVRGADASAGQQDGARVMLVAARPHNEAVVRDGPFVMNTREEVEQAREDYRRRRNGFEMADGWTSDHASTVATH

SEQ ID NO: 12345 - DNA, 2673 bp, Sorghum bicolor
  misc_feature: Ceres ANNOT ID no. 6080688
  misc_feature: Encodes the peptide sequence at SEQ ID NO 12346
atggcggggtcatcacgggaagcggccgagaaggtggagaagtggatggcgttcccgtctggctccgacgccggcggcttcacgttcccgcagccacggtcagtgtcgggcgggggcaaggagatcgtggaggaggaggcgtcgtcgtcctccacggtgggcggcgccggcaacggcaacggcaacaggcaggcctcgttccagcgcgacagcggcgtggcgggcagcaccaagtcgtcgcgtgggtcgggggactcgctgccgcgggtgtcgcgggagctcaaggacgcgctgtccagcctgcagcagacgttcgtggtctccgacgccacgcgcccggactgccccatcatctacgccagcgccggcttctacaccatgaccggctacgccgccaaggacgtggtcggccgcaactgccgcttcctgcagggccccgacacggacatggacgaggtcgccaagatccgggacgccgtcaagaccggccgcagcttctgcggccgcttgctcaactaccgcaaggacggcacgcccttctggaacatgctcaccgtcacccccatccgcgacgacaacggcaaggtcatcaagttcatcgggatgcaagtcgaggtgagcaagtacacggaggggctcagcgagaagcgcatgcggccaaacgagatgccagtctccctcatccactacgacgaccggcagaaggagacggcgatgtcatcgatcacggaggtggtgcagacggtgaagcacccgcgcgctcgctccgagggtgaacaggagcccgtggagcctgcaccgctcgtcacggcgccgccgttggtggcccctggcacgccgctctgggacgtgaagaaggaggactcgcggctgagccggaagatgagccgccgccgctcctccctcatggggttcaagatggggaagaggagctcgataggaagcaaggaggccgttccagctgaggtggaggccacgtcgccggcgccggcgccggcgacaccggagtcagcgacggagaaggagcgcaagaacagctgggagaaagagggaagggagagggacataaggcaagggatcgatctagccaccacgctagagcgcatcgagaagaacttcgtcatcacggatcccaggctccccgacaaccccatcatcttcgcgtcggatagcttcttggagctgacggagtacacgcgggaagagatcctcgggaggaattgcagatttcttcaaggggcagagaccgacatgtccacagttgataagatccgggaggctatccgggaacagaaagaaatcactgtccagctaatcaactacaccaagagtgggaagaagttctggaacttgttccacctgcagccaatgcgagaccagaagggagagcttcagtacttcattggtgttcaattggatggaagcgaccatgttgaaccccttaggaatcgtctctctgagaacactgaactacagagtgctaaactggtcaaagctacggcagagaatgtggatgaagcagtcagagagcttcctgatcccaacctgagaccagaggacctatgggacatttactcaaaatatgtttccccaaagcctcatagacgttacaactcttcttggattgcgatagaaaagattacaaaatctggggagaagattggcttgaagcacttcaagcctataaaacctttgggttgtggtgacactggcagtgtacatttggtggagttgcaaggcagtggtgaattatttgcaatgaaggcaatggacaaatcggtgatgttgaaccgcaacaaggttcatcgagtttgtatcgaaagagaaatatactcactattggatcatccttttctcccgacattatatacttcgttccagacaccaacacatgtttgtctcataacagacttttgtcctgggggtgaattatttgcactacttgatatgcaaccgatgaaacttttcagagaagaatctgcaaggttttatgctgcggaggttgtaattggtcttgagtatctccatttccttggaataatataccgtgacctaaaaccagaaaatattttgctccaagaggatggccacatcgttctgactgattttgacctctcgtttttgacttcttcaaaacctcatgtcataaagcattctacatcaagacgaagaagatctaaggagtatcttcccccaagttttgtttcagaacctgccactccgtcgaattcttttgttggaactgaagagtacatagctccagagatcatcacaggtgcaccacatacaagtgcaattgattggtgggctcttggaattctcttgtatgaaatgttgtatggacgtacaccttttcgaggaaagaacaggaaaaggacatttcataatatcctgcacaaagatcttacatttccaagtagcattccggttagtcttgcggctaagcaattaatccatgggttgcttcagagagatccctcttctcgacttggttcaagtgccggtgcaaatgatatcaagcaacatcccttttttaaagatatatactggccactcatccgttgcatggagcccccagagcttgatgttccactgaaactaactcggaaggaacctgaactaacagtgaagcctgaggaggatactcatgctcagattcttgacacattttaa

SEQ ID NO: 12346 - protein, 890 aa, Sorghum bicolor
  misc_feature: Ceres ANNOT ID no. 6080688
  misc_feature (559)..(845): Pfam Id: Pkinase Pfam Desc: Protein kinase domain
  misc_feature (559)..(852): Pfam Id: Pkinase_Tyr Pfam Desc: Protein tyrosine kinase
  misc_feature (117)..(209): Pfam Id: PAS_3 Pfam Desc: PAS fold
  misc_feature (41)..(871): NCBI GI: 113911589 NCBI Desc: phototropin-2 [lycopersicon esculentum]
  misc_feature (35)..(881): NCBI GI: 60099458 NCBI Desc: phototropin [phaseolus vulgaris]
  misc_feature (76)..(854): NCBI GI: 145362057 NCBI Desc: phot2 (non phototropic hypocotyl 1-like); kinase [arabidopsis thaliana]
  misc_feature (53)..(873): NCBI GI: 46518268 NCBI Desc: phototropin 2 [adiantum capillus-veneris]
  misc_feature (237)..(890): NCBI GI: 38344593 NCBI Desc: osjnba0079m09.13 [oryza sativa (japonica cultivar-group)]
  misc_feature (76)..(881): SWISSPROT Homolog: EC 2.7.11.1 Phototropin-2
  misc_feature: Useful for making plants with modulated light quality sensitivity
  misc_feature: Functional homolog of the protein sequence given in SEQ ID NO 13712
  misc_feature: The sequence is a functional homolog of SEQ ID NO. 441 in the 11/188,298 US application
  misc_feature: The sequence is a functional homolog of SEQ ID NO. 340 in the 11/188,298 US application
  misc_feature: The sequence is a functional homolog of SEQ ID NO. 498 in the 11/188,298 US application
  misc_feature: The sequence is a functional homolog of SEQ ID NO. 520 in the 11/188,298 US application
  misc_feature: The sequence is a functional homolog of SEQ ID NO. 311 in the 11/188,298 US application
  misc_feature: The sequence is a functional homolog of SEQ ID NO. 310 in the 11/188,298 US application
  misc_feature: The sequence is a functional homolog of SEQ ID NO. 358 in the 11/188,298 US application
  misc_feature: The sequence is a functional homolog of SEQ ID NO. 464 in the 11/188,298 US application
  misc_feature: The sequence is a functional homolog of SEQ ID NO. 332 in the 11/188,298 US application
  misc_feature: The sequence is a functional homolog of SEQ ID NO. 399 in the 11/188,298 US application
  misc_feature: The sequence is a functional homolog of SEQ ID NO. 495 in the 11/188,298 US application
  misc_feature: The sequence is a functional homolog of SEQ ID NO. 366 in the 11/188,298 US application
  misc_feature: The sequence is a functional homolog of SEQ ID NO. 323 in the 11/188,298 US application
MAGSSREAAEKVEKWMAFPSGSDAGGFTFPQPRSVSGGGKEIVEEEASSSSTVGGAGNGNGNRQASFQRDSGVAGSTKSSRGSGDSLPRVSRELKDALSSLQQTFVVSDATRPDCPIIYASAGFYTMTGYAAKDVVGRNCRFLQGPDTDMDEVAKIRDAVKTGRSFCGRLLNYRKDGTPFWNMLTVTPIRDDNGKVIKFIGMQVEVSKYTEGLSEKRMRPNEMPVSLIHYDDRQKETAMSSITEVVQTVKHPRARSEGEQEPVEPAPLVTAPPLVAPGTPLWDVKKEDSRLSRKMSRRRSSLMGFKMGKRSSIGSKEAVPAEVEATSPAPAPATPESATEKERKNSWEKEGRERDIRQGIDLATTLERIEKNFVITDPRLPDNPIIFASDSFLELTEYTREEILGRNCRFLQGAETDMSTVDKIREAIREQKEITVQLINYTKSGKKFWNLFHLQPMRDQKGELQYFIGVQLDGSDHVEPLRNRLSENTELQSAKLVKATAENVDEAVRELPDPNLRPEDLWDIYSKYVSPKPHRRYNSSWIAIEKITKSGEKIGLKHFKPIKPLGCGDTGSVHLVELQGSGELFAMKAMDKSVMLNRNKVHRVCIEREIYSLLDHPFLPTLYTSFQTPTHVCLITDFCPGGELFALLDMQPMKLFREESARFYAAEVVIGLEYLHFLGIIYRDLKPENILLQEDGHIVLTDFDLSFLTSSKPHVIKHSTSRRRRSKEYLPPSFVSEPATPSNSFVGTEEYIAPEIITGAPHTSAIDWWALGILLYEMLYGRTPFRGKNRKRTFHNILHKDLTFPSSIPVSLAAKQLIHGLLQRDPSSRLGSSAGANDIKQHPFFKDIYWPLIRCMEPPELDVPLKLTRKEPELTVKPEEDTHAQILDTF

SEQ ID NO: 12347 - DNA, 1704 bp, Sorghum bicolor
  misc_feature: Ceres ANNOT ID no. 6081200
  misc_feature: Encodes the peptide sequence at SEQ ID NO 12348
atgctcgggcaccgcatccccgccacgctccgcctcccgcgcggcggtctgctgctgctgctggagaggaagggcatcaccgctcgccgcggcgtgtccgtgatggccggaggcggcgaggcggaggagggcccgctggggggtttcctcgagtacatggagcggctgcggaactacgagcgctcgggcgtgccgcgcggcgccggcaccgactccgacgacgggttcgacctcgggcgcatgcgcaggctcctccgccggctcggcgaccctcacacccacttcccggctgtgcatatcgctggcaccaaggggaaaggttctactgctgcgttcctgtccaatatcatgagggcgcaaggctacaatgtgggctgttattcaagcccacatcttctaacaatacgtgaacggatttctgttggaaatgatggaggccctgttccagtaggactgttgagtgatctttttgatgaggctaaggaagctattgatgaagcaatagagtcagaaaatggatccctgacacattttgaggttttcactgctctctcatttcttctattctcacaagaaaatgttgacattgccatcattgaagcaggtcttggtggagctagggatgcaacaaatgttattcgaagtactgaattagcagcatctgtcataacaacagtagggagggaacatctggctgcattgggtggctccctgcaaagcatagcaatagcaaagtctggaatcatcaaacaaggacgaccagttgtgattggtggaccatttgcagcagatattgagcaaattattcgtgacagggcattcttgacacaatctcccgtgatatctgcttgtgatcctggcgtgaagagctttacaaaatgcatagattgggataatggtaagccgtatcaacgctgttacatcaacataaagatttcaaatgatgtgcccttgtccattgaaatgcaagacataaacctccaactactgggagatcatcagcgtcagaatgctgtcacagctgcttgcgcagctctttgtctccgtagtgaaggatgggatatctctgatgcttctatccaagcgggcctagaagagacccaacttcctgggaggagccagtttctcacagcagaggaagcctcagtacttgggctcaatggtgcatctactgtactaatcgatggagcgcatactgaggaatctgcaaaggccttatcaggcgtgataaaaactgtcagaccagaagggcctctagcgcttgttgtcggaatggctactgacaaggagcatctcgcgtttgctgagcagcttctctcaggtcaaacgcctgacgtcgttctactgacagaggcgagcatcgccggaggaacctcccgcgcgatgccagcctcgtccctgaaagaagtgtggatagccgcagcacgtgatcatggcattgagtgtgtggacatcggtggcgtcagtggcgctgaagccccagagcacattggtgatctgttgggcagtccatcgtcgagctccggaagaaagccgcccatggtgatcgggtgccaagacgaggggccgttctcctcgaacctgatcattgctgcctcccggctcctggagaagagcagaggcagggctcatccaggcctcatctgcgtgaccggctccctgcatctcgtcggggccgtactgcaacagctgggacggcattag

SEQ ID NO: 12348 - protein, 567 aa, Sorghum bicolor
  misc_feature: Ceres ANNOT ID no. 6081200
  misc_feature (98)..(345): Pfam Id: Mur_ligase_M Pfam Desc: Mur ligase middle domain
  misc_feature (26)..(479): NCBI GI: 30693806 NCBI Desc: dihydrofolate synthetase/folylpolyglutamate synthetase (dhfs/fpgs1) [arabidopsis thaliana]
  misc_feature (26)..(479): NCBI GI: 17976703 NCBI Desc: dihydrofolate synthetase /folylpolyglutamate synthetase [arabidopsis thaliana]
  misc_feature (200)..(564): NCBI GI: 134254534 NCBI Desc: folylpolyglutamate synthase , related [medicago truncatula]
  misc_feature (26)..(249): NCBI GI: 9758056 NCBI Desc: folylpolyglutamate synthase-like protein [arabidopsis thaliana]
  misc_feature (58)..(257): NCBI GI: 125973899 NCBI Desc: folc bifunctional protein [clostridium thermocellum atcc 27405]
MLGHRIPATLRLPRGGLLLLLERKGITARRGVSVMAGGGEAEEGPLGGFLEYMERLRNYERSGVPRGAGTDSDDGFDLGRMRRLLRRLGDPHTHFPAVHIAGTKGKGSTAAFLSNIMRAQGYNVGCYSSPHLLTIRERISVGNDGGPVPVGLLSDLFDEAKEAIDEAIESENGSLTHFEVFTALSFLLFSQENVDIAIIEAGLGGARDATNVIRSTELAASVITTVGREHLAALGGSLQSIAIAKSGIIKQGRPVVIGGPFAADIEQIIRDRAFLTQSPVISACDPGVKSFTKCIDWDNGKPYQRCYINIKISNDVPLSIEMQDINLQLLGDHQRQNAVTAACAALCLRSEGWDISDASIQAGLEETQLPGRSQFLTAEEASVLGLNGASTVLIDGAHTEESAKALSGVIKTVRPEGPLALVVGMATDKEHLAFAEQLLSGQTPDVVLLTEASIAGGTSRAMPASSLKEVWIAAARDHGIECVDIGGVSGAEAPEHIGDLLGSPSSSSGRKPPMVIGCQDEGPFSSNLIIAASRLLEKSRGRAHPGLICVTGSLHLVGAVLQQLGRH

SEQ ID NO: 12349 - DNA, 606 bp, Sorghum bicolor
  misc_feature: Ceres ANNOT ID no. 6081767
  misc_feature: Encodes the peptide sequence at SEQ ID NO 12350
atgaatggattacttcctccagagattcgagtcagggaaattagcgcagcacgtcctgaattccatgctcgcacatccacaaagagcaaagtctatcgctacaagatctataatgaagcaatcatggatccctttcataatcgctatgcttatcatagtgcttataaacttaatccccatgccatgcaggaggctgcaaattattttgttggaacccatgacttcacatcctttgctaatgctgcacataatgatcgtgagcgcagatccacaaagaagataacacgttttgatgttactgaaatgggtgctgtcctacagcttgaggttgaaggcaccggttttctgtacagacaagtgaggaacatggttgctttgctgcttcaagtcggaaaggaagcactgcctcctgatatcgttccagcgatcattgcggtcagggaccgcaaagaactggcgaaggtggccttgtcagcgccaccacatggattgtgtctcatgtcggttaactatgacgaggaaatcctcaagcctcctgaaggttctcctccagtttcctttggcagaactcaccatcttagtaaatgcaaacttccgttttattaa

SEQ ID NO: 12350 - protein, 201 aa, Sorghum bicolor
  misc_feature: Ceres ANNOT ID no. 6081767
  misc_feature (65)..(172): Pfam Id: PseudoU_synth_1 Pfam Desc: tRNA pseudouridine synthase
  misc_feature (1)..(201): NCBI GI: 115462967 NCBI Desc: os05g0279300 [oryza sativa (japonica cultivar-group)]
  misc_feature (1)..(200): NCBI GI: 140071865 NCBI Desc: trna pseudouridine synthase [medicago truncatula]
  misc_feature (1)..(201): NCBI GI: 30680075 NCBI Desc: trna pseudouridine synthase family protein [arabidopsis thaliana]
  misc_feature (2)..(188): NCBI GI: 89953446 NCBI Desc: fgenesh protein 88 [beta vulgaris]
  misc_feature (1)..(172): NCBI GI: 16077216 NCBI Desc: pseudouridylate synthase i [bacillus subtilis subsp. subtilis str. 168]
MNGLLPPEIRVREISAARPEFHARTSTKSKVYRYKIYNEAIMDPFHNRYAYHSAYKLNPHAMQEAANYFVGTHDFTSFANAAHNDRERRSTKKITRFDVTEMGAVLQLEVEGTGFLYRQVRNMVALLLQVGKEALPPDIVPAIIAVRDRKELAKVALSAPPHGLCLMSVNYDEEILKPPEGSPPVSFGRTHHLSKCKLPFY

SEQ ID NO: 12351 - DNA, 759 bp, Sorghum bicolor
  misc_feature: Ceres ANNOT ID no. 6081974
  misc_feature: Encodes the peptide sequence at SEQ ID NO 12352
atgagcacttcattagccatgtctaatgttcgtgatgagaaaccacatccagatgtttccgctgatcctatatgttcaaggaactgcatttatggggatgacgatgactgggtaatagtcaagaaacagcgtatcaccatattaattcctccacaatcacctattacttcaaatcctcaatcaaatgtgcccacaataagttctaagcagtcttgcataactaggagcaagagagactgcgatgctgccagaaagaagcaccccgagaaggtggcagccaagaaatgtcaggactcccctccagtgcatggcagtatagtccacgaggatgttccaattatgacaggtgataaattaccacacagttctgtccctgttgcaaaaacagaatgtactaaggatcatgctgttcgagaattgtttcatcaagaatctgggaaggcgacaagtttctttggaagcatggggaaaccgaggatgccacttatatcttcacctgttgcgaataagataattcgagcccggcttcttgagagacaggttgctgggtttggcgggctgaagaattggcttttcggttgtggtcttggatggtttgtcaacatattggacactgaaaagctggggatgtatcagcttgcctctcttactatgaaacagctgaaagatatgggccttgttgctgtaggtccacggaggaaactgatccacgccattcacagtttgtgccacccacaccatgttgagatgctttcttga

SEQ ID NO: 12352 - protein, 252 aa, Sorghum bicolor
  misc_feature: Ceres ANNOT ID no. 6081974
  misc_feature (183)..(242): NCBI GI: 115456609 NCBI Desc: os03g0850300 [oryza sativa (japonica cultivar-group)]
MSTSLAMSNVRDEKPHPDVSADPICSRNCIYGDDDDWVIVKKQRITILIPPQSPITSNPQSNVPTISSKQSCITRSKRDCDAARKKHPEKVAAKKCQDSPPVHGSIVHEDVPIMTGDKLPHSSVPVAKTECTKDHAVRELFHQESGKATSFFGSMGKPRMPLISSPVANKIIRARLLERQVAGFGGLKNWLFGCGLGWFVNILDTEKLGMYQLASLTMKQLKDMGLVAVGPRRKLIHAIHSLCHPHHVEMLS

SEQ ID NO: 12353 - DNA, 897 bp, Sorghum bicolor
  misc_feature: Ceres ANNOT ID no. 6082154
  misc_feature: Encodes the peptide sequence at SEQ ID NO 12354
atggcggccgccgcgaccgcagccaccgccgagatcgggaccgccgtgaccgcaaccagctccgagatggaggccaccgcgaccgccatcaccaccgcagccgccgccggaccgcctccggccatccccgataaatatatgcataaaaaccgcttgcaatcatttgctgaacgaacgtacaagaaaccaccagtctacaaggttgagtctgaaggcgcgtctcatcagcctaagttcagatgcacagtggaagtgggtggtcaacagttctcatcagctggtagttttgatcgcaagaaggaagcagagcaggatgctgctagaattgcttatgagatcttgtcagcagttggagaggatgacattaaagaggcatttgggcttattgatcaggacgcggttttctgcaaatcaattctcaatgaatttgctgtcaagacaaaaaccacttggccctcttactctctagtttatatagagaagcctttgacgctgtttgctgcaattgtggtgtttgatgggaatagctatactggtgaatctgcacgcaacaagaaggatgcagagcagaatgcagctcgtgctgtgatcaagtcgattttagctaagcataacacttgtatggtgggaattgttagatcgaagaaacaacttataactgccgtcaaatcttctggaagcagcccagctacttttactcctatacagtttacacgccctgtttcacacgcagcattcggcggaccagatcatgtagcacctatgttgcaaaatgcatcttcctcgttagctgttcaaggaggcaccaatgctgtacctgcagttgggacatctgccaacccatcatcagcaaatgtaggccactcaaagtcaaagaagcgcaagggcagagtttaa

SEQ ID NO: 12354 - protein, 298 aa, Sorghum bicolor
  misc_feature: Ceres ANNOT ID no. 6082154
  misc_feature (48)..(114): Pfam Id: dsrm Pfam Desc: Double-stranded RNA binding motif
  misc_feature (136)..(200): Pfam Id: dsrm Pfam Desc: Double-stranded RNA binding motif
  misc_feature (28)..(248): NCBI GI: 115463113 NCBI Desc: os05g0307400 [oryza sativa (japonica cultivar-group)]
  misc_feature (28)..(241): NCBI GI: 62912408 NCBI Desc: dsrna binding protein rbp [oryza sativa (japonica cultivar-group)]
  misc_feature (46)..(246): NCBI GI: 27262829 NCBI Desc: dsrna-binding protein [brassica rapa subsp. rapa]
  misc_feature (46)..(238): NCBI GI: 27262839 NCBI Desc: dsrna-binding protein [brassica oleracea var. gemmifera]
  misc_feature (46)..(238): NCBI GI: 27262837 NCBI Desc: dsrna-binding protein [brassica oleracea var. italica]
  misc_feature: Useful for making plants with altered alkaloid content
  misc_feature: Functional homolog of the protein sequence given in SEQ ID NO 13313
MAAAATAATAEIGTAVTATSSEMEATATAITTAAAAGPPPAIPDKYMHKNRLQSFAERTYKKPPVYKVESEGASHQPKFRCTVEVGGQQFSSAGSFDRKKEAEQDAARIAYEILSAVGEDDIKEAFGLIDQDAVFCKSILNEFAVKTKTTWPSYSLVYIEKPLTLFAAIVVFDGNSYTGESARNKKDAEQNAARAVIKSILAKHNTCMVGIVRSKKQLITAVKSSGSSPATFTPIQFTRPVSHAAFGGPDHVAPMLQNASSSLAVQGGTNAVPAVGTSANPSSANVGHSKSKKRKGRV

SEQ ID NO: 12355 - DNA, 1059 bp, Sorghum bicolor
  misc_feature: Ceres ANNOT ID no. 6082434
  misc_feature: Encodes the peptide sequence at SEQ ID NO 12356
atgttcagcagagccttgcaggtgattctcagcgctagagctagagctagagctagagctagagctactctaacaaaagttttgcttcagggagaagaagagcaggacgattggtccagccttggtccatgccttcaactcggcttccagctctcaaactcagagctcacggagaaattgatttgtaggctggctggaaaggtcgccgtcatcaccgggggcgcgagcggcatcggcaaggcgaccgcagccgagttcgtgagaaacggggcgagggtcgtcatcgccgacatccaggacgacctcggccgtgccgttgccgccgagctcggacccgacaacgcgtgctgctacacccactgcgacgtcgccgacgaggcgcaggtcgccgccgccgtggacctcgcagtggcccgccacggccagctcgacgtcatgttcaacaacgccggcatcacgggctcccccgggtgcgggtggccaccgctcggcgccgtggacctcgccgacttcgaccgcgtcatggccgtcaacgcccgcggagtgctggcggggctcaagcacgccgcgcgcgtcatggtgccgcgccgccgcggcagcatcatctgcaccgccagcgtcgccggcctgtgcggcggcatggttgccgtcgcgtacagcgcctccaaggcgacggtgatcggcctggtgcgcgctgtggcggcggagatggcgtcctccggggtgcgcgtcaacgccatctctccctacgccgtcccgacgcctctggcgctggcagcggtcgcctcgaggcaatcgatgaggggattgagcgccgaggagattaagcggagggtggagatagactcgaacgtgatgtacgggacgaagttggaggaggacgacatcgcgagggcggcactctacctggcgtccgacgacgctaagtatgtcaacggccacaacctcgtcgtcgacggcggcttcacggtgagcagagaagtaccaaaaatcctggcacaagcacgcccaaggagtgatgaacggtccgcatggattttacttcgtgggcgctgctga

SEQ ID NO: 12356 - protein, 352 aa, Sorghum bicolor
  misc_feature: Ceres ANNOT ID no. 6082434
  misc_feature (67)..(238): Pfam Id: adh_short Pfam Desc: short chain dehydrogenase
  misc_feature (68)..(233): Pfam Id: KR Pfam Desc: KR domain
  misc_feature (64)..(333): NCBI GI: 115473903 NCBI Desc: os07g0663500 [oryza sativa (japonica cultivar-group)]
  misc_feature (63)..(331): NCBI GI: 115473905 NCBI Desc: os07g0663600 [oryza sativa (japonica cultivar-group)]
  misc_feature (63)..(328): NCBI GI: 115473921 NCBI Desc: os07g0664400 [oryza sativa (japonica cultivar-group)]
  misc_feature (63)..(328): NCBI GI: 115473927 NCBI Desc: os07g0665000 [oryza sativa (japonica cultivar-group)]
  misc_feature (63)..(330): NCBI GI: 115473917 NCBI Desc: os07g0664200 [oryza sativa (japonica cultivar-group)]
  misc_feature: The sequence is a functional homolog of SEQ ID NO. 389 in the 11/188,298 US application
MFSRALQVILSARARARARARATLTKVLLQGEEEQDDWSSLGPCLQLGFQLSNSELTEKLICRLAGKVAVITGGASGIGKATAAEFVRNGARVVIADIQDDLGRAVAAELGPDNACCYTHCDVADEAQVAAAVDLAVARHGQLDVMFNNAGITGSPGCGWPPLGAVDLADFDRVMAVNARGVLAGLKHAARVMVPRRRGSIICTASVAGLCGGMVAVAYSASKATVIGLVRAVAAEMASSGVRVNAISPYAVPTPLALAAVASRQSMRGLSAEEIKRRVEIDSNVMYGTKLEEDDIARAALYLASDDAKYVNGHNLVVDGGFTVSREVPKILAQARPRSDERSAWILLRGRC

SEQ ID NO: 12357 - DNA, 1419 bp, Sorghum bicolor
  misc_feature: Ceres ANNOT ID no. 6082560
  misc_feature: Encodes the peptide sequence at SEQ ID NO 12358
atgccgatcgacgggatgaggtccgtggtcgcgacggtgagcggctaccacggcgaggagcggcacaggctcgtgaacctcatcgcggagaccggcgccagctacgtaggatccatgagcaggtccatcacccacctggtgtgctggaggctcgaggggaagaagtacgacatcgcaaggaagctggggactcgcgtcgtcagccaccggtggttcatggagtgtctcagcgaggggaggcgcctcccagaggacccctacttgatgtttggtgaagaagcagggccagtcccagagctgcctgctcgttcccgtacacaacgcaagaaaaatgccataatggaggacaggattttccaagagttacctgatgatttctgggacactcctccagccagagccagctataaagttaagcttgatgattctgattctgattttgagtctgccctgctaaaagaagcaagacagtgccttcatgtgtcaagtcatacaatgtcccagagcacatcgaagcagaagggaaacttgtcacgctttcttcacaatgaaattcctatcaggatgggagaaaggaatgatcttactgaaaactttgaaaatgatagtttgtctgacagcttcagtgaacctcaaacttcagatattctgtgtatagaagctcaaagaaaattcaccaagacaagtgcaccatcatcatcacttcgacaaagtgctctggattctctatatgaatttggtgaaactagtagggatgtaccagcaggaagaaaagaaccagacaacgttgaattaagggagagttcaagaagcttacttccatttgatttgtcaggacaggaaccagctttctgcactcaggagcaagtagataaatgtagccttggcactctagctggtgatgaaatgggatatgataaaaaacccatggaaaaatcatctaatttagaaaggcaacctgaattatcatgtgtcatatgctggacagatttttcttctacaaggggcatcttaccatgtggacacagattctgctattcatgcattcaaggatgggcagattgtctggcttctagtggtaaagtctcaacatgtccactttgcaaagccagtttcatatatatcagtaaggtggacgaggcaggcacctcagatcagaagatatactctcagaccattccttgtgaagcttctactgatgtttttgtgctcggcaatgaaggctatgatttctctcgatcaacggctgggcaaggagcatgctaccagtgccacttccgtgagcctgaggagcttcttcaaagctgtgatgtctgcagattacagtgggtacatgcatactgcctcgatcctccgcagacccgttggacatgcatgcactgcagagatccgcggatgctgtttcaccggtatcgttag

SEQ ID NO: 12358 - protein, 472 aa, Sorghum bicolor
  misc_feature: Ceres ANNOT ID no. 6082560
  misc_feature (1)..(76): Pfam Id: BRCT Pfam Desc: BRCA1 C Terminus (BRCT) domain
  misc_feature (324)..(368): Pfam Id: zf-C3HC4 Pfam Desc: Zinc finger, C3HC4 type (RING finger)
  misc_feature (423)..(464): Pfam Id: PHD Pfam Desc: PHD-finger
  misc_feature (306)..(461): NCBI GI: 55297405 NCBI Desc: 2x phd domain containing protein-like [oryza sativa (japonica cultivar-group)]
  misc_feature (6)..(91): NCBI GI: 109157464 NCBI Desc: chain a, solution structure of the first brct domain of dna-repair protein xrcc1
  misc_feature (323)..(472): NCBI GI: 75858843 NCBI Desc: ubiquitin ligase 1 [symbiodinium sp. c3]
  misc_feature (336)..(461): NCBI GI: 46226407 NCBI Desc: 2x phd domain containing protein [cryptosporidium parvum]
  misc_feature (309)..(385): NCBI GI: 21593210 NCBI Desc: ring-h2 finger protein rha1b [arabidopsis thaliana]
  misc_feature: The sequence is a functional homolog of SEQ ID NO 1850 in the 11/479,226US patent application
  misc_feature: Useful for making plants with modulated growth and phenotype characteristics
  misc_feature: The sequence is a functional homolog of SEQ ID NO 1850 in the 20070022495 US patent application
  misc_feature: The sequence is a functional homolog of SEQ ID NO. 329 in the 11/188,298 US application
MPIDGMRSVVATVSGYHGEERHRLVNLIAETGASYVGSMSRSITHLVCWRLEGKKYDIARKLGTRVVSHRWFMECLSEGRRLPEDPYLMFGEEAGPVPELPARSRTQRKKNAIMEDRIFQELPDDFWDTPPARASYKVKLDDSDSDFESALLKEARQCLHVSSHTMSQSTSKQKGNLSRFLHNEIPIRMGERNDLTENFENDSLSDSFSEPQTSDILCIEAQRKFTKTSAPSSSLRQSALDSLYEFGETSRDVPAGRKEPDNVELRESSRSLLPFDLSGQEPAFCTQEQVDKCSLGTLAGDEMGYDKKPMEKSSNLERQPELSCVICWTDFSSTRGILPCGHRFCYSCIQGWADCLASSGKVSTCPLCKASFIYISKVDEAGTSDQKIYSQTIPCEASTDVFVLGNEGYDFSRSTAGQGACYQCHFREPEELLQSCDVCRLQWVHAYCLDPPQTRWTCMHCRDPRMLFHRYR

SEQ ID NO: 12359 - DNA, 1251 bp, Sorghum bicolor
  misc_feature: Ceres ANNOT ID no. 6082603
  misc_feature: Encodes the peptide sequence at SEQ ID NO 12360
atggcctcctctccccgccacctcttcctcctccttcccctgcgcctcctcttgctcatcccgctgctcgccgcggccaaacccgtcctcgaggatggttacacggtgaccactttcgccaacttcaacccgctcccggcctctgggccgcacccctacgcgatcctcccgcggccccgcgccggggacctcctcctcctcgactccgccggatccgcgctctacaccctctccctctcctcctcccccggcgagccgcgcaggctagcgggtggcaagcggcgctccgggttcgacgacggcgacgccgccttcgaccgcccgcgcagcgtcgccgtcgatgccgccgacaacgtctacgtcgccgaccaacgccacggcgccgttcgcaaggtcgcgccctccggttatactactacagttgccggaggtctctcatcaggacctggtcacagggatggactggcacagaatgctactttctcggcagattttgagcttgtttatgtccccaaaatttgtgccctgttagtagctgacagaggaaatcgaatggttagacaaatcaatctaaagccagaagattgtgcacatgaaaaacagtcaggcttgggaactacatcagtgtcggtcattgcaatattgtgtgcattgctcggtttaattatcgggttcttagttcgtcatttttatcctgtcaatgaagtctccatcaaccactttttcatcaggatacagaagcaattcctgaggacacagaggaaggcaactctgatcagcttctgcgacataaaaagcgcagttgctagctccgcggcctacactctcctgcttagactgatcagatttggttgtggctatataactgtggtgttccctagtgttaggttacagcaagaagttccccttaggccttgtcgtcgtcgtcctgtgttacgcaagactagcactgctcctaacattggtcttaacaacaaagctccccttcctcctactgggctactggaggatctgataagctttgctggagatgctggtgataacgagggtagtggtaatgccaatagtcaggagggtaaggtgtcatcctatgagggtgacttgatggggcttctctacaccccacctgacagcgttaagaaaattgatcacatgatcgagaccaacctatctggcttttcgagccatgtgaatcgttgtagattaactgttagtggttgtagtgtaagcaggagggtgcatggagactag

SEQ ID NO: 12360 - protein, 416 aa, Sorghum bicolor
  misc_feature: Ceres ANNOT ID no. 6082603
  misc_feature (105)..(132): Pfam Id: NHL Pfam Desc: NHL repeat
  misc_feature (17)..(357): NCBI GI: 42571623 NCBI Desc: nhl repeat-containing protein [arabidopsis thaliana]
  misc_feature (17)..(204): NCBI GI: 9369410 NCBI Desc: t23e23.6 [arabidopsis thaliana]
  misc_feature (31)..(228): NCBI GI: 30698020 NCBI Desc: nhl repeat-containing protein [arabidopsis thaliana]
  misc_feature (31)..(330): NCBI GI: 42572439 NCBI Desc: nhl repeat-containing protein [arabidopsis thaliana]
  misc_feature (31)..(225): NCBI GI: 3176691 NCBI Desc: contains homology to serine/threonine protein kinase gbx99618 from mycobacterium tuberculosis. ests gbf14403, gbf14404, and gbn96730 come from this gene. [arabidopsis
  misc_feature (31)..(225): NCBI GI: 3176691 (continued) thaliana]
  misc_feature: Useful for making plants with altered alkaloid content
  misc_feature: GREAT-hit functional homolog of the protein sequence given in SEQ ID NO 13010
  misc_feature: Useful for making plants with altered alkaloid content
  misc_feature: Functional homolog of the protein sequence given in SEQ ID NO 13010
MASSPRHLFLLLPLRLLLLIPLLAAAKPVLEDGYTVTTFANFNPLPASGPHPYAILPRPRAGDLLLLDSAGSALYTLSLSSSPGEPRRLAGGKRRSGFDDGDAAFDRPRSVAVDAADNVYVADQRHGAVRKVAPSGYTTTVAGGLSSGPGHRDGLAQNATFSADFELVYVPKICALLVADRGNRMVRQINLKPEDCAHEKQSGLGTTSVSVIAILCALLGLIIGFLVRHFYPVNEVSINHFFIRIQKQFLRTQRKATLISFCDIKSAVASSAAYTLLLRLIRFGCGYITVVFPSVRLQQEVPLRPCRRRPVLRKTSTAPNIGLNNKAPLPPTGLLEDLISFAGDAGDNEGSGNANSQEGKVSSYEGDLMGLLYTPPDSVKKIDHMIETNLSGFSSHVNRCRLTVSGCSVSRRVHGD

SEQ ID NO: 12361 - DNA, 180 bp, Sorghum bicolor
  misc_feature: Ceres ANNOT ID no. 6083192
  misc_feature: Encodes the peptide sequence at SEQ ID NO 12362
atggagatgaagaaggtcgcctgcgccgtccttgtcgctgccgcctcggccaccgtggctctcgccgctgaggccccggcgcccgcccctaccagcgcctcctcggccgccgccttcccggccgtcggcgccgtgctgggcgcctccgtgctctccttcttcgcctactacctgcagtag

SEQ ID NO: 12362 - protein, 59 aa, Sorghum bicolor
  misc_feature: Ceres ANNOT ID no. 6083192
  misc_feature (1)..(58): NCBI GI: 20279095 NCBI Desc: arabinogalactan-peptide agp23 [arabidopsis thaliana]
  misc_feature (1)..(58): NCBI GI: 60265753 NCBI Desc: pollen-specific arabinogalacta protein ban102 [brassica rapa]
  misc_feature (1)..(58): NCBI GI: 33308670 NCBI Desc: anther-specific protein asg1 [malus x domestica]
  misc_feature (1)..(58): NCBI GI: 33308676 NCBI Desc: anther-specific protein asg3 [malus x domestica]
  misc_feature: Useful for making plants with altered cell wall content and/or composition
  misc_feature: Functional homolog of the protein sequence encoded by LOCUS at3g20865
  misc_feature: GREAT-hit functional homolog of the protein sequence encoded by LOCUS at3g57690
MEMKKVACAVLVAAASATVALAAEAPAPAPTSASSAAAFPAVGAVLGASVLSFFAYYLQ

SEQ ID NO: 12363 - DNA, 1548 bp, Sorghum bicolor
  misc_feature: Ceres ANNOT ID no. 6083210
  misc_feature: Encodes the peptide sequence at SEQ ID NO 12364
atggaaatggtggagtgctccctcgtcgctacacttgctccgcgcccgctgccgggacgagtccggaaggccttgccgcggccggcggttcttggtgggagagcgagactccgggtgctgtccgcgggcctgggccgagagcagcctccgccgccgcagcaggcgggagtccgggcttccgggccggatcacggcggccggacgctgggacacgctgcggtggggctcgccgccgcggccgtggtgtcactgaccgggttctccggggatgtgtccccgctgccggcgccgcctgcccgggccgagtcgctcaccgtcgcgttccccgtctccaaggcgcgcgaggtgaacagagtgcagaagacgctggttgagacgtgggggctgatccgtgagacctttgttgatcctaccttcaaccaccaagattgggatcaaaaactgcagcaaaccatggtagagatatttccactgaaatcagcggatgctgcctacagtaagatcagtgggatgctatccacactcggcgatccatttacgaggatcatcagccccatggagtaccagagttttaggataggaagtgatgggaatgtgcaaggggttggggtgttcataaacaaggagccaagctctggacggttgggaggcccagcagatcgagcaggcatccatgaaggcgatgaactagttgagatagatggcaaaagtgtttctggtttggatggagaggctgcggctcagaggcttagaggccgtgtaggaacaacagtgaaagtgaagttgttagatggaactgacagtgaaaggggtgggagtttaaggcaaaaggaggtccagctgtctcgtgaaattatcaacctttcacctgtgtcaactgcaattatctctcataggtctgatgatggccatgagtgcaagactggttatgttagattagcttccttttctcagactgcagcagctgaaatggaaaatgccgtgaaaaggatggaggatgtgggtgtccagtcttatattctagatctacggaataacccaggaggtctagtaaaagctggtcttgatgtggctcaaatttggttggatggagatgaaactcttgtcaacactattgatcgtgatgggaatgtgctaccaataaatatgatccaagggcattcgttaacgcatgaccctcttgttgtgcttgtcaatgaaggaagtgcaagtgcaagtgaaatcttggcaggggcattacatgacaatggacgagctattctggttggccatagaacctttggtaaaggaaaaattcagagtgtgactgagctggatgatggctctgctctgtttatcacagttgcaaagtatctatctccagcgctgcatgaaattgatcaagtaggaatccaacctgacatacaatgcagccctgatgtcctatctttgccaagagcgccttcgctaaaagaaaacagcgaggccacaagtttggagatggattcatgtatcatggttgccgaacaagcgttggaaattgagcaaacaaagggttctgcttcttag

SEQ ID NO: 12364 - protein, 515 aa, Sorghum bicolor
  misc_feature: Ceres ANNOT ID no. 6083210
  misc_feature (307)..(470): Pfam Id: Peptidase_S41 Pfam Desc: Peptidase family S41
  misc_feature (181)..(263): Pfam Id: PDZ Pfam Desc: PDZ domain (Also known as DHR or GLGF)
  misc_feature (68)..(515): NCBI GI: 42566012 NCBI Desc: peptidase s41 family protein [arabidopsis thaliana]
  misc_feature (68)..(515): NCBI GI: 4678279 NCBI Desc: carboxyl terminal protease-like protein [arabidopsis thaliana]
  misc_feature (101)..(476): NCBI GI: 75909646 NCBI Desc: peptidase s41a [anabaena variabilis atcc 29413]
  misc_feature (108)..(504): NCBI GI: 22299150 NCBI Desc: carboxyl-terminal processing protease [thermosynechococcus elongatus bp-1]
  misc_feature (101)..(476): NCBI GI: 17230912 NCBI Desc: carboxyl-terminal processing protease [nostoc sp. pcc 7120]
MEMVECSLVATLAPRPLPGRVRKALPRPAVLGGRARLRVLSAGLGREQPPPPQQAGVRASGPDHGGRTLGHAAVGLAAAAVVSLTGFSGDVSPLPAPPARAESLTVAFPVSKAREVNRVQKTLVETWGLIRETFVDPTFNHQDWDQKLQQTMVEIFPLKSADAAYSKISGMLSTLGDPFTRIISPMEYQSFRIGSDGNVQGVGVFINKEPSSGRLGGPADRAGIHEGDELVEIDGKSVSGLDGEAAAQRLRGRVGTTVKVKLLDGTDSERGGSLRQKEVQLSREIINLSPVSTAIISHRSDDGHECKTGYVRLASFSQTAAAEMENAVKRMEDVGVQSYILDLRNNPGGLVKAGLDVAQIWLDGDETLVNTIDRDGNVLPINMIQGHSLTHDPLVVLVNEGSASASEILAGALHDNGRAILVGHRTFGKGKIQSVTELDDGSALFITVAKYLSPALHEIDQVGIQPDIQCSPDVLSLPRAPSLKENSEATSLEMDSCIMVAEQALEIEQTKGSAS

SEQ ID NO: 12365 - DNA, 468 bp, Sorghum bicolor
  misc_feature: Ceres ANNOT ID no. 6083735
  misc_feature: Encodes the peptide sequence at SEQ ID NO 12366
atgcagggcggcaggagcgcgagcgcggtggaggccgccaaggaggcggcggcgaacgtgggcgcatcggcgtgggccggcaaggagaagaccaaggccgtcgtgcaggagaaggcggccaaggcgagggcgcacgaccccgcggagaaggcggcggccgacgccaggatgcaggagcgcgtgcgcgaggtggaggccgtcaagcaggacgccatgcgccacaacgccgccgccaaggagcgtgccacggccgcacagcaccacccgacgccaatcggcgttggggccgcctccgcgacggcgcctgctgctggtgccggtgccagtgccggtgcgccgcttggtaccaccgagacgggcgtagcagcgaagccgaccggcggcggcgtccaacgtgacgcagctggcttccacgggaccgacggtgtcccaccgccgaccggcatggccggtgcccactacacctga

SEQ ID NO: 12366 - protein, 155 aa, Sorghum bicolor
  misc_feature: Ceres ANNOT ID no. 6083735
  misc_feature (10)..(82): Pfam Id: LEA_1 Pfam Desc: Late embryogenesis abundant (LEA) group 1
  misc_feature (1)..(148): NCBI GI: 115478316 NCBI Desc: os09g0278000 [oryza sativa (japonica cultivar-group)]
  misc_feature (1)..(155): NCBI GI: 11612173 NCBI Desc: seed maturation protein lea 4 [glycine canescens]
  misc_feature (1)..(155): NCBI GI: 11612189 NCBI Desc: seed maturation protein lea 4 [glycine tomentella]
  misc_feature (1)..(155): NCBI GI: 15667233 NCBI Desc: seed maturation protein lea 4 [glycine canescens]
  misc_feature (1)..(155): NCBI GI: 11612193 NCBI Desc: seed maturation protein lea 4 [glycine tomentella]
MQGGRSASAVEAAKEAAANVGASAWAGKEKTKAVVQEKAAKARAHDPAEKAAADARMQERVREVEAVKQDAMRHNAAAKERATAAQHHPTPIGVGAASATAPAAGAGASAGAPLGTTETGVAAKPTGGGVQRDAAGFHGTDGVPPPTGMAGAHYT

SEQ ID NO: 12367 - DNA, 429 bp, Sorghum bicolor
  misc_feature: Ceres ANNOT ID no. 6085080
  misc_feature: Encodes the peptide sequence at SEQ ID NO 12368
atggacagcaagaacgtcggcgtcaaggtgacgtacatcgagacgcagttcgtcacctccgacgaagccggcttcaaggacctcgtgcagcgcctcacggggaggtccgccgctccggcgccggcgccggcgccacacaggcagctgccgtgccgaccagacgacgacgacgacggccggcggcggggctggagcaggaggaccaccgctgccgccgccggagctgggccgcaacaaggcgcttatcagtacccggtactggcggatgtgcgtccggccgccgtcaccgtcagcagccgcacgccgccgtacgtggaggagatgggcctgctgcacggcttcgtcgacagggccgacttctccgacctgttccatgtcgtcggtgccagcgaacggagtgacggttgttacggcagtttcccatattga

SEQ ID NO: 12368 - protein, 142 aa, Sorghum bicolor
  misc_feature: Ceres ANNOT ID no. 6085080
  misc_feature (11)..(41): Pfam Id: VQ Pfam Desc: VQ motif
MDSKNVGVKVTYIETQFVTSDEAGFKDLVQRLTGRSAAPAPAPAPHRQLPCRPDDDDDGRRRGWSRRTTAAAAGAGPQQGAYQYPVLADVRPAAVTVSSRTPPYVEEMGLLHGFVDRADFSDLFHVVGASERSDGCYGSFPY

SEQ ID NO: 12369 - DNA, 1617 bp, Sorghum bicolor
  misc_feature: Ceres ANNOT ID no. 6085296
  misc_feature: Encodes the peptide sequence at SEQ ID NO 12370
atggacccggacttctcgcccgggggcggggggcccagcttcgagttcgccttcaacgaggtcaacttctccgaccgggaattgcggatcgaggtcgtcgccggggatgacgacgcgccgggctcaagcggcggcggcgccggaggaggtggcctcgccgactgggcgcgccaccgcaagcgccgccgcgaggagctcctcaaggagaaagaatctacaactcacatgtcagaccaaacaagttgcaatggagtcgaagcagaagagtgtgatgcatatgaagaaaatcaagaggaacctgtagcaatgatagaagaatctccacccgatgttggccaagatggtgatgatgggcaaggtattgattcatcttggactgtggtgggtacgccagttttacgagtcaagacaatttatatcagttcagcgattcttgctgcgaagagtcctttctttttcaagcttttctcaaacggcatgaaagaatcggatcagagacatgcaacccttagaattactgactcagaggaaactgccctcatggagcttttaagctttatgtatagtggaaagttgacaactactgagcccactcttctgctggatatcttgatggctgccgacaaatttgaggttgtttcatgcatgaggtactgcagccagttgctcacaaacttgccgatgaccacagaatctgcacttctctacctagatcttccctgctcaatttcaatggcagctgcagttcaaccactgacagatgcagctaaggatttccttgctgtaaaatacaaggatttgactaagttccaagatgaagtgatgaacatccctcttgctggaattgaagccatcttgtcaagtaatgacctccaggtggcatctgaagataccatctacgacttcttgctcagatgggcccgtgcacaatacccgaaatcagaagagagacgtgagatccttagttctcggctgctccctcttgtgcgattcagtcacatgacatgtaggaagctgcggaaggtcctaacatgcacggatatagaccacgagcaagcaaccaagtgtgtcaccgaggctcttctgtacaaagctgatgcaccacaccggcaacgagctcttgcagcggacacagtaacctgtcggaaattcgctgagcgggcttacaagtacagaccactcaaagttgttgagtttgatcgaccctacccacagtgcatagcgtacttggacctcaagcgtgaggagtgctctcgactctttcctgcaggccgtatatactcgcaagcattccacctcgcagggcagggcttcttcctctcagctcactgtaacatggagcagcaaagcacgttctactgcttcggtctctttctggggatgcaagagaagggctcaatgagcgttacagtggactatgagtttgctgcaaggacaagaccatctggcgagtttgtgagcaagtacaagggtaactacacgttcaccggtgggaaggcagttgggtacaggaatctctttgcaatcccatggcagacgttcatggccgatgacagcctcttcttcatcgacgggatgctgcatctgagagccgagcttacgataaagcagccctag

SEQ ID NO: 12370 - protein, 538 aa, Sorghum bicolor
  misc_feature: Ceres ANNOT ID no. 6085296
  misc_feature (121)..(223): Pfam Id: BTB Pfam Desc: BTB/POZ domain
  misc_feature (236)..(344): Pfam Id: BACK Pfam Desc: BTB And C-terminal Kelch
  misc_feature (1)..(538): NCBI GI: 115468254 NCBI Desc: os06g0507400 [oryza sativa (japonica cultivar-group)]
  misc_feature (1)..(537): NCBI GI: 48093487 NCBI Desc: gamyb-binding protein [hordeum vulgare subsp. vulgare]
  misc_feature (1)..(537): NCBI GI: 30695452 NCBI Desc: btb/poz domain-containing protein [arabidopsis thaliana]
  misc_feature (1)..(537): NCBI GI: 12006855 NCBI Desc: poz/btb containing-protein atpob1 [arabidopsis thaliana]
  misc_feature (101)..(536): NCBI GI: 42566222 NCBI Desc: btb/poz domain-containing protein [arabidopsis thaliana]
MDPDFSPGGGGPSFEFAFNEVNFSDRELRIEVVAGDDDAPGSSGGGAGGGGLADWARHRKRRREELLKEKESTTHMSDQTSCNGVEAEECDAYEENQEEPVAMIEESPPDVGQDGDDGQGIDSSWTVVGTPVLRVKTIYISSAILAAKSPFFFKLFSNGMKESDQRHATLRITDSEETALMELLSFMYSGKLTTTEPTLLLDILMAADKFEVVSCMRYCSQLLTNLPMTTESALLYLDLPCSISMAAAVQPLTDAAKDFLAVKYKDLTKFQDEVMNIPLAGIEAILSSNDLQVASEDTIYDFLLRWARAQYPKSEERREILSSRLLPLVRFSHMTCRKLRKVLTCTDIDHEQATKCVTEALLYKADAPHRQRALAADTVTCRKFAERAYKYRPLKVVEFDRPYPQCIAYLDLKREECSRLFPAGRIYSQAFHLAGQGFFLSAHCNMEQQSTFYCFGLFLGMQEKGSMSVTVDYEFAARTRPSGEFVSKYKGNYTFTGGKAVGYRNLFAIPWQTFMADDSLFFIDGMLHLRAELTIKQP

SEQ ID NO: 12371 - DNA, 957 bp, Sorghum bicolor
  misc_feature: Ceres ANNOT ID no. 6085297
  misc_feature: Encodes the peptide sequence at SEQ ID NO 12372
atggccgagaagccgcctctgccgcccaagcccaagcctcccctgccgtccaagccgaggcccaaggcggcacccgcgggggcaaggccgacaccaccgccgccgacaggtcccggcagcaggccggcggccgcgccgcctttcaagaagccgacgctcgcgccgccgccgcaggttctcccgctcaaaccaccgccggcgcaccagtaccggcagcagcagcagtaccctccgggcggcggcgcgcggaagcagccgtaccgccagcaacacccgcaccaccgccaccgccgcggcggcgggtgctcgtgccgccgcgtgtgctgcctggccacggggctcgccctgctcgcgctctgcctggcgctcgccgccgcgtgcctcgcctacctctactaccgcccgcgcgcgccgtcgttccacctgcagcctctctcccccgtccgcctccgcctcgggaacaactcctcctcggccgccgtgtccgccatggacgccaccgtgggcgcccgcgtcgtgtcgtggaacccgaacgagcgtgtggcgttccggtacggcgacggcgagggccgcgtcgccctgcgcgacgccgacgacggcgacgtggcgctggggtgggcgcccgtgcgcgggttcgcgcacgcgccgcgcaccgtggccaccgtcgcgttcgtggccaccgccaggggcgtggtgctggacgaggccgtggcggcgcgcgtccgcgacaggtaccggcggcggcagcaggggttcagggtggtcgtggacgcccacgtcggcgtccgcgtcggggcgctgcgcacgggcatggtgccggtcaggctgctctgtgacgacggcgcgatggcgccccgcgccgccgacgcgggggcatcggacggcgggaccgtggttgggcccatgagcaagtgccaggtgctcctgtttagagtaagatggtttagcctgaactga

SEQ ID NO: 12372 - protein, 318 aa, Sorghum bicolor
  misc_feature: Ceres ANNOT ID no. 6085297
  misc_feature (130)..(278): Pfam Id: Hin1 Pfam Desc: Harpin-induced protein 1 (Hin1)
  misc_feature (13)..(314): NCBI GI: 115445411 NCBI Desc: os02g0261000 [oryza sativa (japonica cultivar-group)]
  misc_feature (32)..(290): NCBI GI: 18844773 NCBI Desc: harpin-induced protein-related-like [oryza sativa (japonica cultivar-group)]
  misc_feature (38)..(310): NCBI GI: 11762174 NCBI Desc: at1g17620 [arabidopsis thaliana]
  misc_feature (49)..(278): NCBI GI: 8920583 NCBI Desc: contains similarity to a photoreceptor from ceratodon purpureus gby10901 and contains an eukaryotic protein kinase pf00069 domain. ests gbn96753, gbai993724 come from this gene.
  misc_feature (49)..(278): NCBI GI: 8920583 (continued) [arabidopsis thaliana]
  misc_feature (34)..(279): NCBI GI: 140044063 NCBI Desc: harpin-induced 1 [medicago truncatula]
MAEKPPLPPKPKPPLPSKPRPKAAPAGARPTPPPPTGPGSRPAAAPPFKKPTLAPPPQVLPLKPPPAHQYRQQQQYPPGGGARKQPYRQQHPHHRHRRGGGCSCRRVCCLATGLALLALCLALAAACLAYLYYRPRAPSFHLQPLSPVRLRLGNNSSSAAVSAMDATVGARVVSWNPNERVAFRYGDGEGRVALRDADDGDVALGWAPVRGFAHAPRTVATVAFVATARGVVLDEAVAARVRDRYRRRQQGFRVVVDAHVGVRVGALRTGMVPVRLLCDDGAMAPRAADAGASDGGTVVGPMSKCQVLLFRVRWFSLN

SEQ ID NO: 12373 - DNA, 807 bp, Sorghum bicolor
  misc_feature: Ceres ANNOT ID no. 6085336
  misc_feature: Encodes the peptide sequence at SEQ ID NO 12374
atggtgttgccagtctcaacaagacgctatcagcaatttcctttagtacgaaacaatggatttcctagaatttctagagtaaaaatgacatgcttgggaacaaaccaaagtaaccatcattctaataccgtcgtatctttatcgcctagccatggagataccagaaagatccaccctgtagtcaaaatgtgtggcatcacatcagctagagatgcagaaatggctgtaaaggcaggagctgagcttataggcatgatactgtggcccaactctaaacgctctgtctcgttattggaggcaaaagaaatatcaagagttgcacaatcttatggtgctgaatcagttggtgtctttgtggatgataatgaagagacaattctacgtatgtctgattcatgcgaccttaacattgtccagctccatggtgatgaatctcgtgcattggttcatactctttcaaagaataatcgtatcatttatgtactaaatgctgatgacaatggaaaactaatcaacactcctgatatagaatatgaacttgattggtacttagtggacagtgcaaaaggcggaagtggaaagggattcaattggcagaagttccaaatgccatctgtcaaaagcaagaatggatggctattagctggagggcttcatgcagataatgtttgtgaagccttttctgctctgaaaccaaatggtgttgatgttagcagcggcatatgtgctcctgatggtatccaaaaagatgcagacaggattaattccttcataagtaatgtaaaatccatgaatttcttatcataa

SEQ ID NO: 12374 - protein, 268 aa, Sorghum bicolor
  misc_feature: Ceres ANNOT ID no. 6085336
  misc_feature (61)..(260): Pfam Id: PRAI Pfam Desc: N-(5'phosphoribosyl)anthranilate (PRA) isomerase
  misc_feature (26)..(266): NCBI GI: 619749 NCBI Desc: phosphoribosylanthranilate isomerase
  misc_feature (17)..(266): NCBI GI: 5031259 NCBI Desc: phosphoribosylanthranilate isomerase [arabidopsis thaliana]
  misc_feature (41)..(266): NCBI GI: 1403670 NCBI Desc: phosphoribosylanthranilate isomerase [arabidopsis thaliana]
  misc_feature (44)..(266): NCBI GI: 92898016 NCBI Desc: n-(5phosphoribosyl)anthranilate isomerase (prai) [medicago truncatula]
  misc_feature (41)..(266): NCBI GI: 10178136 NCBI Desc: phosphoribosylanthranilate isomerase [arabidopsis thaliana]
MVLPVSTRRYQQFPLVRNNGFPRISRVKMTCLGTNQSNHHSNTVVSLSPSHGDTRKIHPVVKMCGITSARDAEMAVKAGAELIGMILWPNSKRSVSLLEAKEISRVAQSYGAESVGVFVDDNEETILRMSDSCDLNIVQLHGDESRALVHTLSKNNRIIYVLNADDNGKLINTPDIEYELDWYLVDSAKGGSGKGFNWQKFQMPSVKSKNGWLLAGGLHADNVCEAFSALKPNGVDVSSGICAPDGIQKDADRINSFISNVKSMNFLS

SEQ ID NO: 12375 - DNA, 1992 bp, Sorghum bicolor
  misc_feature: Ceres ANNOT ID no. 6085584
  misc_feature: Encodes the peptide sequence at SEQ ID NO 12376
atgtcgtcggcgatggtggagcgggcaacgagcgacatgctcatcggccccgactgggcgatgaacttggagatctgtgacatcgtcaaccgcgaaccagggcaagcaaaagatgtggtgaagtccctcaagaaacgcattgcgcacaagaacccaaaggttcagcttcttgctctcacgttgctggagacgatgataaaaaattgtggggacattgtgcatatgcttgttgctgagagagacatacttcatgagatggtcaagatagtaaagaaaaggcatgattataatgttaaagagaagattctcacgctgatagatagttggcaagaagtttttggtggtgctcgtgcaagatatccgcaatattatgcagcatatgaggagctcttgcgtgctggagtcgtatttcctcaaagatcgaatggttctgtgccaatcatcactcctccacagactcagcctctacaaaactatccctcatctttacgcatttcacagcaggaggaacttgactcgccagcttcagatttccctgcattaagccttacagaaattcagaacgcacgtggcatcatggatgttctttcagaaatgctggatgctttagatccgggtaacagagaggggcttagacaggatgtcattgcagaccttgtggatcaatgccgttcttacaagcaaagagtagttcagcttgtcaacagtacatcgaatgaggagttgctcagccagggtctttctttgaatgatgatatgcagcgtgttctcgcaaaacatgatgctattgatgcaggtgtagcagttcgggtggaaaagccaaagtctctgcagtcccaaattgagagttcttcaacaagaaagccagataccatggaaccaattcaaaggtcttcagcaagcacaagtgccaccaaccagtctccctttgggattttagcccttcctgcgcctccatctagtagttcgaaagcacctttaataccagcttctagtatggacctccttagtggagatgattatatcaaaaccgaacctgcaaactctctagcacttgttcctgtcactgaatattcagctgcagacaagaatgtcttagccttcgccgatatgtttgaacaaaatactgccaacaatagcaaccataaccttccaaattcttttcaatcttcgacttcaaattctactatctctacatcacaaacatatcctgcaccagtgcgacctgtgttgcctcagcattcagctgctgatccaaatggggccagatccaatgccattgtaccttatgatcagcagtcccagttgaactctacaggttcttggaatggacagacagcttatggaacaaatcaccaaaaggaagcactaagttatggcacaggtgatcaaaatggaggcattccaccagcaccgtgggaaattaagcgatccactaatccatttgatgacgatcagcttgttggaacggcactgcaagcacgaggcatgcagcctcaaccagtgcaactcagtcagcatgggaacaaattcatgtcagcacaaccaatgccgaggggacagacaggaagaatgcacttgcaacaggtgcctggtgctcagcttggcgctctacaaccacaggctatgccgaacatgcagtacagggggatgcatccttcaatgcaaatgaatcaaggaatgggcatgtattcccaaccaacctttggaggatattatggaatgaaccaaccacagctttacagtgttcatatgtctggttatggatatggtcagcaatctggaggctactatattccgaatgctgcatatgcgtatgctagtgcaaacgagcttgcccagaggatgaatggcctttcagttcaaaacggtgatccaaatggaataacagcaaataagcagagcagacctgaggattcactctttggcgatcttttgagcatcgccaagatgaagcagaacaaacctgcagctggcaaggttggtggctaa

SEQ ID NO: 12376 - protein, 663 aa, Sorghum bicolor
  misc_feature: Ceres ANNOT ID no. 6085584
  misc_feature (1)..(134): Pfam Id: VHS Pfam Desc: VHS domain
  misc_feature (176)..(274): Pfam Id: GAT Pfam Desc: GAT domain
  misc_feature (1)..(662): NCBI GI: 82791812 NCBI Desc: vhs and gat domain protein [glycine max]
  misc_feature (2)..(580): NCBI GI: 92887452 NCBI Desc: epsin, n-terminal; gat; enth/vhs [medicago truncatula]
  misc_feature (6)..(435): NCBI GI: 42567576 NCBI Desc: vhs domain-containing protein / gat domain-containing protein [arabidopsis thaliana]
  misc_feature (1)..(261): NCBI GI: 140065047 NCBI Desc: gat; enth/vhs [medicago truncatula]
  misc_feature (5)..(264): NCBI GI: 21537352 NCBI Desc: tom (target of myb1)-like protein [arabidopsis thaliana]
MSSAMVERATSDMLIGPDWAMNLEICDIVNREPGQAKDVVKSLKKRIAHKNPKVQLLALTLLETMIKNCGDIVHMLVAERDILHEMVKIVKKRHDYNVKEKILTLIDSWQEVFGGARARYPQYYAAYEELLRAGVVFPQRSNGSVPIITPPQTQPLQNYPSSLRISQQEELDSPASDFPALSLTEIQNARGIMDVLSEMLDALDPGNREGLRQDVIADLVDQCRSYKQRVVQLVNSTSNEELLSQGLSLNDDMQRVLAKHDAIDAGVAVRVEKPKSLQSQIESSSTRKPDTMEPIQRSSASTSATNQSPFGILALPAPPSSSSKAPLIPASSMDLLSGDDYIKTEPANSLALVPVTEYSAADKNVLAFADMFEQNTANNSNHNLPNSFQSSTSNSTISTSQTYPAPVRPVLPQHSAADPNGARSNAIVPYDQQSQLNSTGSWNGQTAYGTNHQKEALSYGTGDQNGGIPPAPWEIKRSTNPFDDDQLVGTALQARGMQPQPVQLSQHGNKFMSAQPMPRGQTGRMHLQQVPGAQLGALQPQAMPNMQYRGMHPSMQMNQGMGMYSQPTFGGYYGMNQPQLYSVHMSGYGYGQQSGGYYIPNAAYAYASANELAQRMNGLSVQNGDPNGITANKQSRPEDSLFGDLLSIAKMKQNKPAAGKVGG

SEQ ID NO: 12377 - DNA, 462 bp, Sorghum bicolor
  misc_feature: Ceres ANNOT ID no. 6085655
  misc_feature: Encodes the peptide sequence at SEQ ID NO 12378
atgtctcaacttggcacatgctcattgccaggagctgcaacctatggcacttcaattaggagatttggaggttcgaaatttcagcagcctaaagctaatcacatctcatttggtcagaaagtatctgctaaagcaacattgagaattatgagatgcaacgctactcaaactcaaacacaaagcgtccaaaagaaatcttcaagtgcaactctgcaacgtgataagaaagggaaagtccaggggccaaaactggatgacgggagcggcgggttccctccattccgcttcggcaaaggtgggggtgggggtggaggcggcggaggtggcagcaactactttggcggattccttctcttctcatgcgtgttgctcttagactacctgaaggaattcgagaagtacttgcttgctcagaggcaccgagctggagatgatggcggcaatgggctgctgcaggcatga

SEQ ID NO: 12378 - protein, 153 aa, Sorghum bicolor
  misc_feature: Ceres ANNOT ID no. 6085655
  misc_feature (50)..(152): NCBI GI: 115445511 NCBI Desc: os02g0274000 [oryza sativa (japonica cultivar-group)]
  misc_feature (1)..(150): NCBI GI: 115444285 NCBI Desc: os02g0152900 [oryza sativa (japonica cultivar-group)]
  misc_feature (50)..(132): NCBI GI: 6634770 NCBI Desc: f26g16.9 [arabidopsis thaliana]
  misc_feature (51)..(132): NCBI GI: 145325445 NCBI Desc: emb1303 (embryo defective 1303) [arabidopsis thaliana]
  misc_feature (66)..(140): NCBI GI: 25152689 NCBI Desc: calpain family member (clp-1) [caenorhabditis elegans]
MSQLGTCSLPGAATYGTSIRRFGGSKFQQPKANHISFGQKVSAKATLRIMRCNATQTQTQSVQKKSSSATLQRDKKGKVQGPKLDDGSGGFPPFRFGKGGGGGGGGGGGSNYFGGFLLFSCVLLLDYLKEFEKYLLAQRHRAGDDGGNGLLQA

SEQ ID NO: 12379 - DNA, 585 bp, Sorghum bicolor
  misc_feature: Ceres ANNOT ID no. 6085769
  misc_feature: Encodes the peptide sequence at SEQ ID NO 12380
atggcggccgccaagtggagcgagacggccatgctcgtcatcgacatgcagaaggacttcgttgacccggcgatgcgcagcccgatgctggtggccggcggcgaggccgtcgtccctgccgttgccgaggccgtcgccgtcgcaagggagcgcggcattttcctcgtctgggttgtcagagagcatgatccttctggaagagatgttgaacttttccgcaggcagcattactctgggggaaagggtccaacagtgaaaggtctgaaaggagcggagctggctgatgggcttgttattaaagaaggggaatacaagttagtgaagactagatttagtgctttctttgcgacgcaccttgattctgtcctgaaaactgcaggaataaagaacttggttattgttggagttcaaacaccaaattgcattcggcagactgtctttgatgctgtagcattggactatgagaaagttacagttcttattgatgcaacagctgctgcaagaccagaaatccatttgtcaaatatcagggatatgaagaacatcggagtggatacgccaaccgtggaagaatggcgccgctag

SEQ ID NO: 12380 - protein, 194 aa, Sorghum bicolor
  misc_feature: Ceres ANNOT ID no. 6085769
  misc_feature (7)..(194): Pfam Id: Isochorismatase Pfam Desc: Isochorismatase family
  misc_feature (4)..(194): NCBI GI: 50252495 NCBI Desc: isochorismatase hydrolase-like [oryza sativa (japonica cultivar-group)]
  misc_feature (4)..(194): NCBI GI: 115445529 NCBI Desc: os02g0276400 [oryza sativa (japonica cultivar-group)]
  misc_feature (5)..(194): NCBI GI: 115445527 NCBI Desc: os02g0276200 [oryza sativa (japonica cultivar-group)]
  misc_feature (5)..(173): NCBI GI: 50252493 NCBI Desc: isochorismatase hydrolase-like [oryza sativa (japonica cultivar-group)]
  misc_feature (11)..(192): NCBI GI: 116750067 NCBI Desc: isochorismatase hydrolase [syntrophobacter fumaroxidans mpob]
MAAAKWSETAMLVIDMQKDFVDPAMRSPMLVAGGEAVVPAVAEAVAVARERGIFLVWVVREHDPSGRDVELFRRQHYSGGKGPTVKGLKGAELADGLVIKEGEYKLVKTRFSAFFATHLDSVLKTAGIKNLVIVGVQTPNCIRQTVFDAVALDYEKVTVLIDATAAARPEIHLSNIRDMKNIGVDTPTVEEWRR

SEQ ID NO: 12381 - DNA, 678 bp, Sorghum bicolor
  misc_feature: Ceres ANNOT ID no. 6085925
  misc_feature: Encodes the peptide sequence at SEQ ID NO 12382
atggccaccgctcccaacgcctcctccctgttcctggtttcctcccccatctccaccgcgccacgagcacgcgccgggtccttccctctctccgcccagccgtcgctgcgcctccggccgaggccgttctcggccgtcgcggccgccgtccaggcggagcaccagcccgcggtggccgcgacgccaaagccgcccgcgctaccgttccgcgtgggccacggcttcgacctccaccgcctggagcccaacctcccgctcatcatcggcggcatcaacatcccccacgaccgcggctgcgaggctcactctgacggcgacgtgctgcttcactgcgtggtggacgcgattctcggcgcgctggggctgccagacatcgggcagattttcccggactccgacccccgttggaagggcgccgattcttcggtgttcatgagggaagctgtgaaattgatgcatgaagcaggctatgagctgggcaaccttgatgctacgctgatcttgcaaaaaccaaaaattagcccattcaaggagacaatccgttcaaatttgtgcgacctacttggggcagatccatctgtggtcaatctcaaggctaagacacacgagaaagttgacagtctaggggaaaacaggagcatagctgctcatactgtagttctcctgatgcggaagtag

SEQ ID NO: 12382 - protein, 225 aa, Sorghum bicolor
  misc_feature: Ceres ANNOT ID no. 6085925
  misc_feature (69)..(225): Pfam Id: YgbB Pfam Desc: YgbB family
  misc_feature (1)..(225): NCBI GI: 115447923 NCBI Desc: os02g0680600 [oryza sativa (japonica cultivar-group)]
  misc_feature (5)..(225): NCBI GI: 110083911 NCBI Desc: 2c-methyl-d-erythritol 2,4-cyclodiphosphate synthase [stevia rebaudiana]
  misc_feature (41)..(225): NCBI GI: 63409898 NCBI Desc: 2c-methyl-d-erythritol 2,4-cyclodiphosphate synthase [ginkgo biloba]
  misc_feature (6)..(225): NCBI GI: 21553693 NCBI Desc: 2c-methyl-d-erythritol 2,4-cyclodiphosphate synthase [arabidopsis thaliana]
  misc_feature (44)..(225): NCBI GI: 7621712 NCBI Desc: 2c-methyl-d-erythritol 2,4-cyclodiphosphate synthase [catharanthus roseus]
  misc_feature (6)..(225): SWISSPROT Homolog: EC 4.6.1.12 2-C-methyl-D-erythritol 2,4-cyclodiphosphate synthase, chloroplastprecursor
MATAPNASSLFLVSSPISTAPRARAGSFPLSAQPSLRLRPRPFSAVAAAVQAEHQPAVAATPKPPALPFRVGHGFDLHRLEPNLPLIIGGINIPHDRGCEAHSDGDVLLHCVVDAILGALGLPDIGQIFPDSDPRWKGADSSVFMREAVKLMHEAGYELGNLDATLILQKPKISPFKETIRSNLCDLLGADPSVVNLKAKTHEKVDSLGENRSIAAHTVVLLMRK

SEQ ID NO: 12383 - DNA, 1179 bp, Sorghum bicolor
  misc_feature: Ceres ANNOT ID no. 6086040
  misc_feature: Encodes the peptide sequence at SEQ ID NO 12384
atgagtgataacctgatggacaaggttagcgcctttggcgagcgcctgaagatcaccgggacggaggtcagcaaaaagatgacggctggaatgagctccatgagtttcaagatgaaggagttgttccaggggcagaccccggctgacaagattgttgaggacgccacctcggagaatctggacgggcctgactggaactcaaacctggagatttgcgacttgatcaacacggagaaggttaacagtgtggagcttatacgtgggatcaagaagaggatcatgctgaaggatgcgagggtccagtacctctccttggtcctgcttgagactattgtgaagaactgtgagaaagccttctcagaggttgcggccgagcgtgttcttgatgagatggtcaggttgattgatgaccctcagactgtggtgaataacaggaacaagacccttatgctgattgaagcatggggggagtctggcgatgaactccgctatctaccagtctatgaggaaacatacaagagcttgaaatcaagaggagtgcggtttcctggacgtgacaatgagagcttggctcccatatttactccaccacggtcagttgctgaagctgatgttgactcaagcttgccccagcaagcattcgaagacatccatgttcatacatatactgctgaagaaacaaaagaagcatttgatgtagctcgtaacagcatagaacttctttcaactgttctttcgtcttcccctgaacaggatgctttgcaggatgacttgacagccactcttgtgcaacaatgctaccaatctcagcacactatccagaggattattgagaccgttggagacaacgaagctgtgctctttgaggccttgagcgtgaacgatgagatccagaaagtgttatcgaagtacgaggagatgaagcagcccagggcctcagagcatgcagaacagagaccagttgtcataccgattgccacagaacatgaagattcgactgctatcggcaatgaagacgcccttgtcagaaaaccagctgccgcgagagcaaggtcaggtggagatgatgatatccttgatgatctcgacgagatgatatttggcaagaagggaggtagcagctcccaggatgggccgaaaaagccagatccgaagaaggatgacctgatcagcttttaa

SEQ ID NO: 12384 - protein, 392 aa, Sorghum bicolor
  misc_feature: Ceres ANNOT ID no. 6086040
  misc_feature (42)..(179): Pfam Id: VHS Pfam Desc: VHS domain
  misc_feature (222)..(317): Pfam Id: GAT Pfam Desc: GAT domain
  misc_feature (1)..(392): NCBI GI: 21537352 NCBI Desc: tom (target of myb1)-like protein [arabidopsis thaliana]
  misc_feature (1)..(282): NCBI GI: 30686081 NCBI Desc: vhs domain-containing protein / gat domain-containing protein [arabidopsis thaliana]
  misc_feature (1)..(192): NCBI GI: 115483652 NCBI Desc: os10g0578000 [oryza sativa (japonica cultivar-group)]
  misc_feature (8)..(357): NCBI GI: 23308355 NCBI Desc: at1g06210/f9p14_4 [arabidopsis thaliana]
  misc_feature (8)..(262): NCBI GI: 42571359 NCBI Desc: vhs domain-containing protein / gat domain-containing protein [arabidopsis thaliana]
MSDNLMDKVSAFGERLKITGTEVSKKMTAGMSSMSFKMKELFQGQTPADKIVEDATSENLDGPDWNSNLEICDLINTEKVNSVELIRGIKKRIMLKDARVQYLSLVLLETIVKNCEKAFSEVAAERVLDEMVRLIDDPQTVVNNRNKTLMLIEAWGESGDELRYLPVYEETYKSLKSRGVRFPGRDNESLAPIFTPPRSVAEADVDSSLPQQAFEDIHVHTYTAEETKEAFDVARNSIELLSTVLSSSPEQDALQDDLTATLVQQCYQSQHTIQRIIETVGDNEAVLFEALSVNDEIQKVLSKYEEMKQPRASEHAEQRPVVIPIATEHEDSTAIGNEDALVRKPAAARARSGGDDDILDDLDEMIFGKKGGSSSQDGPKKPDPKKDDLISF

SEQ ID NO: 12385 - DNA, 744 bp, Sorghum bicolor
  misc_feature: Ceres ANNOT ID no. 6086064
  misc_feature: Encodes the peptide sequence at SEQ ID NO 12386
atgggaactccggcgaagcacccccgtgccgtcccacgccacctacaggccgcagtctccaccgtctccaccgcgcagatactccgctcttccggctactccgccgcggaacctgccgcgctccgcgccctctccgacatcgccggccgctacatcgcgtccttgggccgcaccgcagcagctttcgcagaggcccgcggccgcacggagcccaacgtcgccgacgccgtcctcgcgctcgaggaccacgcgcttggcggcttccccggagcgtccgaccccacgcggccgttgctctgttccggcgctctcgcggagctcgcgcagttcgtcgccgcggtgagggaggtcccgttcgcgaagcccctgccgaggagggatccgggctgcggctccagcgacgggtgggagagcttcgcggcagcggggagggagccgccgctgaggcacgttccacagtggctgccatgcttccccgaggggtgggaggaacgcgttcgctgccaggtggcatcgaatgacgagaaggacgcagggcaagtggtaacggtgatgaacggtaatggcaagagaggcatgccggagaatagggagaagctgtcgttccgcttgggacaaaagcggcagcgtgtgaaaccatccaacaagcatggtggtgccttcgaacgtttgacaaaacaaggagaaaattctctatccatagaatgtatctcttcagcttcaaatttagtcattggtccatag

SEQ ID NO: 12386 - protein, 247 aa, Sorghum bicolor
  misc_feature: Ceres ANNOT ID no. 6086064
  misc_feature (13)..(90): Pfam Id: Bromo_TP Pfam Desc: Bromodomain associated
  misc_feature (18)..(178): NCBI GI: 115489232 NCBI Desc: os12g0574800 [oryza sativa (japonica cultivar-group)]
  misc_feature (18)..(207): NCBI GI: 6692136 NCBI Desc: t19e23.2 [arabidopsis thaliana]
  misc_feature (87)..(179): NCBI GI: 115454053 NCBI Desc: os03g0603300 [oryza sativa (japonica cultivar-group)]
MGTPAKHPRAVPRHLQAAVSTVSTAQILRSSGYSAAEPAALRALSDIAGRYIASLGRTAAAFAEARGRTEPNVADAVLALEDHALGGFPGASDPTRPLLCSGALAELAQFVAAVREVPFAKPLPRRDPGCGSSDGWESFAAAGREPPLRHVPQWLPCFPEGWEERVRCQVASNDEKDAGQVVTVMNGNGKRGMPENREKLSFRLGQKRQRVKPSNKHGGAFERLTKQGENSLSIECISSASNLVIGP

SEQ ID NO: 12387 - DNA, 606 bp, Sorghum bicolor
  misc_feature: Ceres ANNOT ID no. 6086115
  misc_feature: Encodes the peptide sequence at SEQ ID NO 12388
atggctggacctggtgttctcaatgagcgtatcctttcttccatgtcccagaaacatgttgctgctcacccatggcatgatttggagataggaccaggggctcctgaagtgttcaattgtgtggttgagattcctagaggcagcaaggttaagtatgagttggacaaggcatctggtctgatcaaggtggaccgtgtcctttattcctctgttgtttacccacataactatggtttcattccacgcacactctgtgaggatagtgaccccatggacgtcctcatactgatgcaggaacaagttgtccctgggtgtttcctgcgagctcgtgctattgggctcatgcctatgatcgatcagggcgagaaagatgataagattatagcagtctgtgctgatgaccctgaattccgtcactacacggacatcacggacctccccccgcatcgccttcaagagatccgccgcttttttgaagattataagaagaatgaaaacaaagaggttgcagtgaatgagttcctcccagcaaaagatgccatcaacgcaatcaagtactcgatggacctgtatggctcatacatcattgaaagcctgaggaagtga

SEQ ID NO: 12388 - protein, 201 aa, Sorghum bicolor
  misc_feature: Ceres ANNOT ID no. 6086115
  misc_feature (39)..(193): Pfam Id: Pyrophosphatase Pfam Desc: Inorganic pyrophosphatase
  misc_feature (4)..(201): NCBI GI: 97536487 NCBI Desc: soluble inorganic pyrophosphatase (pyrophosphate phospho-hydrolase) (ppase)
  misc_feature (4)..(201): NCBI GI: 3885882 NCBI Desc: inorganic pyrophosphatase [oryza sativa]
  misc_feature (7)..(201): NCBI GI: 84619272 NCBI Desc: soluble inorganic pyrophosphatase [papaver rhoeas]
  misc_feature (7)..(201): NCBI GI: 140048990 NCBI Desc: inorganic pyrophosphatase [medicago truncatula]
  misc_feature (7)..(201): NCBI GI: 45925891 NCBI Desc: soluble inorganic pyrophosphatase [populus tomentosa]
  misc_feature (4)..(201): SWISSPROT Homolog: EC 3.6.1.1 Soluble inorganic pyrophosphatase
  misc_feature: Useful for making plants with modulated nitrogen use efficiency
  misc_feature: Functional homolog of the protein sequence given in SEQ ID NO 13344
  misc_feature: Useful for making plants with modulated nitrogen use efficiency
  misc_feature: Functional homolog of the protein sequence given in SEQ ID NO 13344
MAGPGVLNERILSSMSQKHVAAHPWHDLEIGPGAPEVFNCVVEIPRGSKVKYELDKASGLIKVDRVLYSSVVYPHNYGFIPRTLCEDSDPMDVLILMQEQVVPGCFLRARAIGLMPMIDQGEKDDKIIAVCADDPEFRHYTDITDLPPHRLQEIRRFFEDYKKNENKEVAVNEFLPAKDAINAIKYSMDLYGSYIIESLRK

SEQ ID NO: 12389 - DNA, 1080 bp, Sorghum bicolor
  misc_feature: Ceres ANNOT ID no. 6086122
  misc_feature: Encodes the peptide sequence at SEQ ID NO 12390
atggcgcgatgccaggggaccgtcgagagcctctgccaggggctgctcgacctcgacgacgacaggttcagcgcaatgtgcagcgccttcggctacctccaggagtggccggacctgggcgccatgtgcggcgcgaatctcgccgtgcctgccgtggcggcggcggcggcaccgagcgccggcgacggcaacgactcctcctcttgcagcggcagcggcgggatcaggaagaggagaccggacgcgtacctcgatgccaagggtggtgcaaacgacatgagcaagagacccagagggaagcagctgactggcctctctgagatcgcggcgcccgggaaagggaagcaggagcggccaaaggctggcaccaagaagaaggcggaggctgcgtcgacggcggcggcggcggcggcggcggcggcagcggctgccggccagaagaccgactacatccacgtccgggcccgccgcggccaggccacggatagccacagcctcgccgagcgggtgaggagggagaggatcagcgagcggatgcggtacctgcaggagctggtgcccgggtgcagcaaggtcacgggcaaggccggcatgctcgacgagatcatcaactacgtccagtcccttcagaagcaagtcgagttcctgtccatgaagatcgctgcttccaacccggtggtgagcttcgacatcgtcgaggacctcttcggccggcagctgaagcaggcggcagccctgcccgcgatggctctgccggccgggcagctggagccgtcctgccttcagatgagccccatgcagcaggtgcacccatctgcagccgcaggcggctccactggctttgggcttgagatggtcgtcaacaacctgtacgcgcccgccgccgcgagctgccctgtgtccgctgcgccgtcggtatcggcggctgccggaccgtcgacgatcgagccgtgcctcaacgtgaatggaactgctgctgcctgggatattggcgcccagaatttgttcagcggttttgatgcacaatttcagtcagtagaaagtgactgtttgctagacaacctcaaaatggaaatgtaa

SEQ ID NO: 12390 - protein, 359 aa, Sorghum bicolor
  misc_feature: Ceres ANNOT ID no. 6086122
  misc_feature (160)..(210): Pfam Id: HLH Pfam Desc: Helix-loop-helix DNA-binding domain
  misc_feature (75)..(359): NCBI GI: 92880913 NCBI Desc: helix-loop-helix dna-binding [medicago truncatula]
  misc_feature (123)..(306): NCBI GI: 115485347 NCBI Desc: os11g0442500 [oryza sativa (japonica cultivar-group)]
  misc_feature (63)..(280): NCBI GI: 50726625 NCBI Desc: ta1 protein-like [oryza sativa (japonica cultivar-group)]
  misc_feature (88)..(225): NCBI GI: 102139897 NCBI Desc: basic helix-loop-helix (bhlh) family protein [musa acuminata]
  misc_feature (89)..(267): NCBI GI: 125664136 NCBI Desc: basic helix-loop-helix protein [sesamum indicum]
  misc_feature: The sequence is a functional homolog of SEQ ID NO 1929 in the 10/374,780US patent application
  misc_feature: The sequence is a functional homolog of SEQ ID NO 1930 in the 10/374,780US patent application
  misc_feature: The sequence is a functional homolog of SEQ ID NO 198 in the 10/714,887US patent application
  misc_feature: The sequence is a functional homolog of SEQ ID NO 198 in the 11/435,388US patent application
  misc_feature: The sequence is a functional homolog of SEQ ID NO 864 in the 11/435,388US patent application
  misc_feature: Useful for making plants with modulated growth and phenotype characteristics
  misc_feature: The sequence is a functional homolog of SEQ ID NO 198 in the 20060015972 US patent application
  misc_feature: The sequence is a functional homolog of SEQ ID NO 1929 in the 20060162006 US patent application
  misc_feature: The sequence is a functional homolog of SEQ ID NO 1930 in the 20060162006 US patent application
  misc_feature: The sequence is a functional homolog of SEQ ID NO 864 in the 20060272060 US patent application
MARCQGTVESLCQGLLDLDDDRFSAMCSAFGYLQEWPDLGAMCGANLAVPAVAAAAAPSAGDGNDSSSCSGSGGIRKRRPDAYLDAKGGANDMSKRPRGKQLTGLSEIAAPGKGKQERPKAGTKKKAEAASTAAAAAAAAAAAAGQKTDYIHVRARRGQATDSHSLAERVRRERISERMRYLQELVPGCSKVTGKAGMLDEIINYVQSLQKQVEFLSMKIAASNPVVSFDIVEDLFGRQLKQAAALPAMALPAGQLEPSCLQMSPMQQVHPSAAAGGSTGFGLEMVVNNLYAPAAASCPVSAAPSVSAAAGPSTIEPCLNVNGTAAAWDIGAQNLFSGFDAQFQSVESDCLLDNLKMEM

SEQ ID NO: 12391 - DNA, 2319 bp, Sorghum bicolor
  misc_feature: Ceres ANNOT ID no. 6086124
  misc_feature: Encodes the peptide sequence at SEQ ID NO 12392
atggcgaacggtaacaatgaagcgatgggtatatctcagcgcaaatcttgccccaaggttcacagctcaatgtgtagtgagctgacaatgatgttggataagatctcttctattcttccgtcaatagaggctgctcgaccaggttgtaaagcaggcatacaggaattatgcaacctatacaatattgtcgagaaagggaggctcataatccaacactgcattgactgtagtaagctctacttggctattactggagagacgattgtagcaagatgtgaaaggatcagagactcactgaggcggagtttgttccttattcagaatatggttccaccagcactagctaatcagattgctgacgtccataatgatcttcgggatgtcaaatttgttcttgatccgatggaagaagaggctggcaaagccattttacagatgctccggcagtccgatgcaagtgaagaattagaacttgagacattcctgcatgctgcttcaaagttggacctgacatctcctaaagcagtcttaattgagagacgagcaatcaaaaaactgcttgacaaagttagtggcaatgatcgaaaaaaggagggggtccttaagtttttcctgtacctcatcaagaagtatggaaagagcatcagtcaggactctggtgaacggaacgagaatttacaatctgaaagtcaatctttaactctgagcacaccttcctgtgatgccagcgctcgtggaaaatgttacacaccaacagactttcagatttatgaggatcacagtaatatgtctggatcagctactccacctccagagttctgctgcccaatatcaacaaagctaatgcacgatcctgttataataacatctggacagacttatgaaagagaatatattgagaggtggttcaatgaaggatatgatacttgtcctaggacacagatgaagctagagaacttctccatgatcccaaatacctgcatgagagatctcatttgcaattggtgcaaagagcatggttttacagtttctgattttattcctccaagcgaaaatgcttacggttacttaccagagcaattgcagggttactctatgtcaagtttgcacaatgtttcagtacctctcattgccggaaaggccaacagttttgtgattgaccacagcaatatatctgttgcattatctgatgccagttatgtctctaatgcatcccacgctagggacatggaggattcaaaagatatttctcagttttcttggaacgccgactatcaaaagtatttgtcgttccacaacttcaaccagaagatgtttctgaacttctttcatgagctgtccatgctcccattagagctgcaggacaagtcaattaaagatttgaagaacgttcttgattatgaaagtgaggtttcatatgctatggtatcaaatggatttgttgaagcattccttgaattcttgagaaatgatactggcagctacagtgtgcaagctcaggaagctggatttcggttttttcttgcttttctttccaatagcagggctaaaattgaagctatgaatgaagaactatttcatctgatcacatccttccttgactctgagctaaaaattgaagctttgttgacgctgcatgagttgattaagcacttgagttgtccaagatctcatgtgatggcctctgttgttagtcctccattgttcaaaatactggcaactgaagacactgaagaccttgaattggctctgaagatcatctgcgagctttcatctgacgctgatataagatcttcattagtttcaatgggaataatctcaaagcttgttcccattttcacagaaggaaactttgttgagtgctgtttgaagattttgcggaacttaagcgacatggaagaagctgtagtgcgtattacgagaaccgaccggtgtcttgcttctgtagcagaatatctggacacaggaagccctacagagcgagagcatgccgtggttatacttttagcaatatgttcgtatagtgccgaggattgtctacttgtaatgaaggaaggtgtgatccctgccctggtggacttgtcggtgaacggaaccgaagaggcgaaaaactgctcgacgaagctacttcatcttctctgggacatgaggcgaagcgaccagttcactaactcatgctcacaagaagtggctgccacaggaacggtagaggatgctcccaacaactcagttcacaagcagccggtgtcaaagtcgtccaggtttttccaaagaaagctgaacatcttctcaaaaccccggtcactcacgctgttctga

SEQ ID NO: 12392 - protein, 772 aa, Sorghum bicolor
  misc_feature: Ceres ANNOT ID no. 6086124
  misc_feature (270)..(342): Pfam Id: U-box Pfam Desc: U-box domain
  misc_feature (1)..(772): NCBI GI: 41053097 NCBI Desc: armadillo repeat containing protein-like [oryza sativa (japonica cultivar-group)]
  misc_feature (159)..(770): NCBI GI: 102139900 NCBI Desc: u-box domain-containing protein [musa acuminata]
  misc_feature (16)..(733): NCBI GI: 14149112 NCBI Desc: bg55 [bruguiera gymnorrhiza]
  misc_feature (19)..(740): NCBI GI: 42562301 NCBI Desc: armadillo/beta-catenin repeat family protein / u-box domain-containing family protein [arabidopsis thaliana]
  misc_feature (143)..(720): NCBI GI: 20161603 NCBI Desc: b1065g12.5 [oryza sativa (japonica cultivar-group)]
  misc_feature: The sequence is a functional homolog of SEQ ID NO. 309 in the 11/188,298 US application
  misc_feature: The sequence is a functional homolog of SEQ ID NO. 528 in the 11/188,298 US application
  misc_feature: The sequence is a functional homolog of SEQ ID NO. 308 in the 11/188,298 US application
MANGNNEAMGISQRKSCPKVHSSMCSELTMMLDKISSILPSIEAARPGCKAGIQELCNLYNIVEKGRLIIQHCIDCSKLYLAITGETIVARCERIRDSLRRSLFLIQNMVPPALANQIADVHNDLRDVKFVLDPMEEEAGKAILQMLRQSDASEELELETFLHAASKLDLTSPKAVLIERRAIKKLLDKVSGNDRKKEGVLKFFLYLIKKYGKSISQDSGERNENLQSESQSLTLSTPSCDASARGKCYTPTDFQIYEDHSNMSGSATPPPEFCCPISTKLMHDPVIITSGQTYEREYIERWFNEGYDTCPRTQMKLENFSMIPNTCMRDLICNWCKEHGFTVSDFIPPSENAYGYLPEQLQGYSMSSLHNVSVPLIAGKANSFVIDHSNISVALSDASYVSNASHARDMEDSKDISQFSWNADYQKYLSFHNFNQKMFLNFFHELSMLPLELQDKSIKDLKNVLDYESEVSYAMVSNGFVEAFLEFLRNDTGSYSVQAQEAGFRFFLAFLSNSRAKIEAMNEELFHLITSFLDSELKIEALLTLHELIKHLSCPRSHVMASVVSPPLFKILATEDTEDLELALKIICELSSDADIRSSLVSMGIISKLVPIFTEGNFVECCLKILRNLSDMEEAVVRITRTDRCLASVAEYLDTGSPTEREHAVVILLAICSYSAEDCLLVMKEGVIPALVDLSVNGTEEAKNCSTKLLHLLWDMRRSDQFTNSCSQEVAATGTVEDAPNNSVHKQPVSKSSRFFQRKLNIFSKPRSLTLF

SEQ ID NO: 12393 - DNA, 381 bp, Sorghum bicolor
  misc_feature: Ceres ANNOT ID no. 6086184
  misc_feature: Encodes the peptide sequence at SEQ ID NO 12394
atggacgtcccgggcctgaccaaggagcaggtggccgtcgagctggtggacggccgcatcctccgcgtccgcggcggcaagcacaagcaggaccaggacgacggcgccggcgataagggcgccccggcggcgggccacgagggaaaggaggagggggccaccgacgacgacggcggcgccgtgaggtggcattgcagggagagagccggcgcgcgcgcgttcgagacgcagttccgggtgccggacgacgcggccgcggacgaggtgcgcgcggcctttgcggacggggtgctcacggtgaccgtgcccaagcggaagggcggcggcaagaagcggcaccacggcggcagcaagcccgtgtgctgcaggttctggccgtga

SEQ ID NO: 12394 - protein, 126 aa, Sorghum bicolor
  misc_feature: Ceres ANNOT ID no. 6086184
  misc_feature (1)..(121): Pfam Id: HSP20 Pfam Desc: Hsp20/alpha crystallin family
  misc_feature (1)..(126): NCBI GI: 115448245 NCBI Desc: os02g0711300 [oryza sativa (japonica cultivar-group)]
  misc_feature (47)..(120): NCBI GI: 92872776 NCBI Desc: heat shock protein hsp20 [medicago truncatula]
  misc_feature (62)..(106): NCBI GI: 11990130 NCBI Desc: 17.9 kda heat-shock protein [helianthus annuus]
  misc_feature (63)..(104): NCBI GI: 38639431 NCBI Desc: 17.5 kda class i heat shock protein [carica papaya]
  misc_feature (62)..(106): NCBI GI: 18073562 NCBI Desc: 17.6 kda heat-shock protein [helianthus annuus]
MDVPGLTKEQVAVELVDGRILRVRGGKHKQDQDDGAGDKGAPAAGHEGKEEGATDDDGGAVRWHCRERAGARAFETQFRVPDDAAADEVRAAFADGVLTVTVPKRKGGGKKRHHGGSKPVCCRFWP

SEQ ID NO: 12395 - DNA, 1620 bp, Sorghum bicolor
  misc_feature: Ceres ANNOT ID no. 6086198
  misc_feature: Encodes the peptide sequence at SEQ ID NO 12396
atggacgtgcgccgtctcggaggccgcatcgcggcggcgctgagggcgctcgccgcggggggctcgctgatgcccatcccgtcgtgggtcgccaacggcctggcgatgatctcgctcgtgctctcctcctgcgaccttctccgcctctgcagcgacagggaccgccgtctcctgttcccgctccgctgccgcgagttcgtcaccgtgttctgccagctggcctccatcctgtacctcttcggcctttgcggcactggcatcgcatctgcgaactccgagacccacgcctgccgcgaccagggcggctcccccgaccaaacgcgcgccgccgccgacgcgccggaggcattgcatgacggggtggaggacggggacgaggagatcgtcgccgctgtggtctccggggcgctgccgtcacaccacctcgagtcgcgcctcggagactgccaccgcgcggccaggctgcggcgggaggcgctgcggcggatgacggggcggggcgtcgaggggctcccactcgacgggatggactaccaggccatcctggggcaatgctgcgagatgcccgtcgggtacgtgcagataccggtcggggtcgccggcccgctgctcctggatggggaacagtaccatattcccatggctaccaccgagggatgtctcgtggccagcgtcaaccgcggctgcagagccatcgctgcgtccggaggcgccgtcagctcgctgttccgggatgcaatgtctcgtgcgcctgtcgtcaagttgccatcgatcaagagggcagcggagctcaaggagtttgccgaggcacttaccaattttgagactctagctgctgtcttcaataggtccagcagatttgggaagcttcagggtattaattgtgcattagcaggtaggaacgtttacataaggttcacttgtagtactggagatgctatgggaatgaatatggtgtcaaaaggtgttgagaatgtcttgggctacctgcagactgatttccccgacatggatatcatcagcctatctggtaactattgttcagacaagaagcctgcagccgtaaactggatagaaggttgtgggaaatctgttgcttgtgaggccacagtcaaagggggagttgtgcagagtgttcttaagaccactgtgcaaaaacttgtcgagcttaacattgtaaaaaatctcgttggatcagctgtagccggagctcttggaggtttcaatgcccatgcaagcaatatcgtaactgccctgttcattgctacggggcaggatcctgcccaaaatgttgaaagctcacagtgcctcaccatgatggaggcagtgaatgatggatgcgatcttcacatctctgtgaccatgccttccattgaggtaggcactattgggggtggcacttgtcttacttcacaagccgcatgtctgaacctgcttggtgtcaagggtccgaatcttgattcacctggggaaaatgctaagcttctggctaccatcgtcgctggcagtgtgctcgctggcgagctgtctctcatggcagcccttgcttctggccaacttgtgaagagccacatgaagtacaaccgatcaagcaaagatgtgcaaggtgctgcttcctga

SEQ ID NO: 12396 - protein, 539 aa, Sorghum bicolor
  misc_feature: Ceres ANNOT ID no. 6086198
  misc_feature (136)..(529): Pfam Id: HMG-CoA_red Pfam Desc: Hydroxymethylglutaryl-coenzyme A reductase
  misc_feature (30)..(539): NCBI GI: 1346301 NCBI Desc: 3-hydroxy-3-methylglutaryl-coenzyme a reductase (hmg-coa reductase)
  misc_feature (30)..(539): NCBI GI: 455459 NCBI Desc: 3-hydroxy-3-methylglutaryl coenzyme a reductase
  misc_feature (115)..(539): NCBI GI: 94730390 NCBI Desc: 3-hydroxy-3-methylglutaryl-coenzyme a reductase 3 (hmg-coa reductase 3)
  misc_feature (115)..(539): NCBI GI: 42408805 NCBI Desc: 3-hydroxy-3-methylglutaryl-coenzyme a reductase 3 [oryza sativa (japonica cultivar-group)]
  misc_feature (86)..(539): NCBI GI: 5059025 NCBI Desc: 3-hydroxy-3-methylglutaryl-coenzyme a reductase [oryza sativa]
  misc_feature (30)..(539): SWISSPROT Homolog: EC 1.1.1.34 3-hydroxy-3-methylglutaryl-coenzyme A reductase 1
MDVRRLGGRIAAALRALAAGGSLMPIPSWVANGLAMISLVLSSCDLLRLCSDRDRRLLFPLRCREFVTVFCQLASILYLFGLCGTGIASANSETHACRDQGGSPDQTRAAADAPEALHDGVEDGDEEIVAAVVSGALPSHHLESRLGDCHRAARLRREALRRMTGRGVEGLPLDGMDYQAILGQCCEMPVGYVQIPVGVAGPLLLDGEQYHIPMATTEGCLVASVNRGCRAIAASGGAVSSLFRDAMSRAPVVKLPSIKRAAELKEFAEALTNFETLAAVFNRSSRFGKLQGINCALAGRNVYIRFTCSTGDAMGMNMVSKGVENVLGYLQTDFPDMDIISLSGNYCSDKKPAAVNWIEGCGKSVACEATVKGGVVQSVLKTTVQKLVELNIVKNLVGSAVAGALGGFNAHASNIVTALFIATGQDPAQNVESSQCLTMMEAVNDGCDLHISVTMPSIEVGTIGGGTCLTSQAACLNLLGVKGPNLDSPGENAKLLATIVAGSVLAGELSLMAALASGQLVKSHMKYNRSSKDVQGAAS

SEQ ID NO: 12397 - DNA, 174 bp, Sorghum bicolor
  misc_feature: Ceres ANNOT ID no. 6086238
  misc_feature: Encodes the peptide sequence at SEQ ID NO 12398
atggagatgaagaagatcgcctgcgccgtcctcttcgccgcctcggccaccgtggcgctcgccgcggaggctccggctccggcccccaccagcggctcctccgccgtcgcacccgccgtcggcgccgcactcggggccgccgtggcctccttcttcgcctactacattcagtga

SEQ ID NO: 12398 - protein, 57 aa, Sorghum bicolor
  misc_feature: Ceres ANNOT ID no. 6086238
  misc_feature (1)..(56): NCBI GI: 20279095 NCBI Desc: arabinogalactan-peptide agp23 [arabidopsis thaliana]
  misc_feature (1)..(56): NCBI GI: 60265753 NCBI Desc: pollen-specific arabinogalacta protein ban102 [brassica rapa]
  misc_feature: Useful for making plants with altered cell wall content and/or composition
  misc_feature: GREAT-hit functional homolog of the protein sequence encoded by LOCUS at3g57690
MEMKKIACAVLFAASATVALAAEAPAPAPTSGSSAVAPAVGAALGAAVASFFAYYIQ

SEQ ID NO: 12399 - DNA, 2346 bp, Sorghum bicolor
  misc_feature: Ceres ANNOT ID no. 6086246
  misc_feature: Encodes the peptide sequence at SEQ ID NO 12400
atgggggacgcccccgccgccgtcgcggcgggcggggtagggtctcccgcttgtgcctcacggaagcggcaacgcgtcgatgacggcgcggggctgaggcgggtggcggagatcgtgatggtgctggccgcggccggggaggtgcgcggcggtagggagcccacggcggcggagcgggcgctcgcggccgaggcgcgggaggctctggccgccgccgtcgccgaggggcccgtgcggcccaaggatctgttccctggggaggcggtgcgcgaggtcgtcgaggatctcgggctcaaccgcgccaaggacccagctgccatgggctttcgcccgcctaaggcctccatcgccgataggctcatgcttactaagcgcaagatggaagaagtcaaggaagctccagtgcaatcaacagttagcgcaccgcaaacggtcgtcttaagtggaatgtctgagttccatggtttgaatgggactaccaagtttggtgttggagttcctaggaacccgccagttccatctttagctgctactgccccattaacctctacatccgcagctaccttgaaaccaccaggatcatctcctgtaaaaccagttgccaactcatcagttgttccccaactccatactggtccatcaaaccttaaattggacaaaaatgttagtggtcctcagaatttagcacgcagtggagtaactgttgtccactcaaacaagtcaactctagaaacatctgctaggtccaatgtaaatgctgtacagagttccaatcagatggtgaaaaaccaggacacaaaaccagtggccgttcaagccatgacagttaaccctgttatagggcatcgtgccacaccaggtgtggcatttgttccgccaaaacctactttcgtcaatcacaatgagatagcaaagaatgttcaacagtttttgcaccaacctgcaaaccatcctagctggactccaccatcaactgagtacatgcattcttgcttgagttgtcaaatatgcaaagttgttatcattggtacagacagtgtacttgtttgtgatgcttgtgagaggggagtacacttgaaatgccttcagcagtatggcaataaaggtgtccctaaagctgagtggcattgttctgcatgcctgactcagagtaagggcaaacccttgccaccaaaatatggcaaggttacaagaactgtagttgcatcaaaggttgctccacctggtggtggagcacaactttctttgcagggatcagcagaaaacatggctgcaaaggaaaatcaccaaaagttggctgcaaatgggaatttgatgaagccaatctccattcaaggtggcagcacaacacccaacagtaatgttttggcactgggtgctatcatggctggttcacaatcacaattagtttctaccttaagaccatcaatagttaaagctgaactgtcctctaatggaaaggaaggaactgggcaaccgtgcaatactacaatacaacctgatgtgagatcatcctctcttaacaaaagattgagaagtgattcgtctttgaaccctgcagattcagcaaacgatatcatgcatggtaagcatactgcagaaatttctggtgctgaagcaaaggtcaagtctgaagcaaactctgaggcccctgtgagcagagatgaggaattggttgatagcagtagaacaacaattgaaactgaacaaacccaggttgttgctagtgaagaaaagcccagggcacaatcagcctttgagacagataaaatgaaagatggaaagacaactaccaacacaggaacaacaacagatcaatgcagcaacttcggtactgaacaaaagctccccagtgaagcaacttctgaggcacacacaattattgacatgaagatgactaacagtactggaataccagtacagcaaagcaacatttctcctattgaagagaaaacccagattgatgcagtgtctgattcacatccacatacaatccaagatatggaaatgggcaccaacaatggaccacccatagatcaaagcagcagtcttgttactgaagaaaagccccctgaacaatccttttcaattggtgatgtgtgtgtcactgctaatgctggaatagcaacagatcaaacacaacatccaaatgggtcaactgaaaatgtagtaaagaaatctcccaacagagaactatataaagaggaatcaggctgtaatgcagtctcagatattacccaaaaagtaacttcaaatggcatcttgcaccctgaggacaaaactttatgtgttcatgaagatgaagcagtgggttgtgacacagaagcaaaagaagcagcaaactaa

SEQ ID NO: 12400 - protein, 781 aa, Sorghum bicolor
  misc_feature: Ceres ANNOT ID no. 6086246
  misc_feature (333)..(383): Pfam Id: PHD Pfam Desc: PHD-finger
  misc_feature (50)..(723): NCBI GI: 45735835 NCBI Desc: bactericidal permeability-increasing protein-like [oryza sativa (japonica cultivar-group)]
  misc_feature (19)..(467): NCBI GI: 54290628 NCBI Desc: bactericidal permeability-increasing protein-like [oryza sativa (japonica cultivar-group)]
  misc_feature (180)..(769): NCBI GI: 30685716 NCBI Desc: phd finger family protein [arabidopsis thaliana]
  misc_feature (488)..(781): NCBI GI: 115448337 NCBI Desc: os02g0720000 [oryza sativa (japonica cultivar-group)]
  misc_feature (299)..(769): NCBI GI: 56382027 NCBI Desc: at3g20280 [arabidopsis thaliana]
MGDAPAAVAAGGVGSPACASRKRQRVDDGAGLRRVAEIVMVLAAAGEVRGGREPTAAERALAAEAREALAAAVAEGPVRPKDLFPGEAVREVVEDLGLNRAKDPAAMGFRPPKASIADRLMLTKRKMEEVKEAPVQSTVSAPQTVVLSGMSEFHGLNGTTKFGVGVPRNPPVPSLAATAPLTSTSAATLKPPGSSPVKPVANSSVVPQLHTGPSNLKLDKNVSGPQNLARSGVTVVHSNKSTLETSARSNVNAVQSSNQMVKNQDTKPVAVQAMTVNPVIGHRATPGVAFVPPKPTFVNHNEIAKNVQQFLHQPANHPSWTPPSTEYMHSCLSCQICKVVIIGTDSVLVCDACERGVHLKCLQQYGNKGVPKAEWHCSACLTQSKGKPLPPKYGKVTRTVVASKVAPPGGGAQLSLQGSAENMAAKENHQKLAANGNLMKPISIQGGSTTPNSNVLALGAIMAGSQSQLVSTLRPSIVKAELSSNGKEGTGQPCNTTIQPDVRSSSLNKRLRSDSSLNPADSANDIMHGKHTAEISGAEAKVKSEANSEAPVSRDEELVDSSRTTIETEQTQVVASEEKPRAQSAFETDKMKDGKTTTNTGTTTDQCSNFGTEQKLPSEATSEAHTIIDMKMTNSTGIPVQQSNISPIEEKTQIDAVSDSHPHTIQDMEMGTNNGPPIDQSSSLVTEEKPPEQSFSIGDVCVTANAGIATDQTQHPNGSTENVVKKSPNRELYKEESGCNAVSDITQKVTSNGILHPEDKTLCVHEDEAVGCDTEAKEAAN

SEQ ID NO: 12401 - DNA, 1221 bp, Sorghum bicolor
  misc_feature: Ceres ANNOT ID no. 6086281
  misc_feature: Encodes the peptide sequence at SEQ ID NO 12402
atggcctctctttgtgatttctgtgggaaacaaaggtcaatgatctactgcagatcagatgcggcatcattgtgcttatcatgcgaccgtaatgttcattcagctaatgcgctgtctcggcgtcatacaaggacccttctttgtgatcgctgtggttctcagcctgcatcagtcagatgtcttgaggacaatgcatcactttgccaaaactgtgattggaatgggcatgatgcagcatcaggggcttctgggcataaaaggcaggctataaactgttactcagggtgcccatcatcagcagagctttcaagaatctggtcatttattatggatatcccgactgtacctgctgagcccaactgtgaggatggattaagcatgatgacaattgatgacagtgatgtgactaatcatcatgatgcttcagatgataaaagactgttggaaatagctaacacaacactcatgagcgatccaccttcagcagacaagcctaaacctctgataagctcttcttccggagatgggtttgatgttctgcctctagccacagatcagcctgctggatcagtttcagtgacacctaaggtaccttatgccagagatgacgataatttcaatgatggcatgtatgaagacttatgtgtggatgatgctgacatgacattcgagaactatgaagagctatttggtacctctcacattcgaacagaggaactctttgatgacgctggaattgacagttactttgaaatgaaggaaacacaaccttttgatttcaacgaggagcccaaaactatgcagctagaatgtagcaatgtggtatcagctgattgtgggatgttaaacccaggggcaagggctgattccagcctttgtattcctgttaggcaagtcagatctagtatatcccattccctatctggtttgactggtgagagcagcgctggagatcaccaagattgtggggtgtcaccaatgctcctcatgggtgagcctccctggcattctcctggtcctgaaggctcagttgctggaggcagcagagatagcgctctcacacgatacaaggagaagaagaagagaagaaagtttgacaagaagatcagatatgcctctcgcaaggctagggcagacgtgaggaagagggtcaagggacggtttataaaggccggcgaagcatatgactatgatccactaagccaaactagaagctactga

SEQ ID NO: 12402 - protein, 406 aa, Sorghum bicolor
  misc_feature: Ceres ANNOT ID no. 6086281
  misc_feature (349)..(393): Pfam Id: CCT Pfam Desc: CCT motif
  misc_feature (1)..(47): Pfam Id: zf-B_box Pfam Desc: B-box zinc finger
  misc_feature (48)..(90): Pfam Id: zf-B_box Pfam Desc: B-box zinc finger
  misc_feature (1)..(406): NCBI GI: 45736008 NCBI Desc: zinc-finger protein [oryza sativa (japonica cultivar-group)]
  misc_feature (1)..(406): NCBI GI: 115467684 NCBI Desc: os06g0298200 [oryza sativa (japonica cultivar-group)]
  misc_feature (1)..(113): NCBI GI: 15233186 NCBI Desc: zinc finger (b-box type) family protein [arabidopsis thaliana]
  misc_feature (5)..(126): NCBI GI: 42571031 NCBI Desc: zinc finger (b-box type) family protein [arabidopsis thaliana]
  misc_feature (5)..(113): NCBI GI: 45736091 NCBI Desc: zinc-finger protein c60910-like [oryza sativa (japonica cultivar-group)]
  misc_feature: The plant flowers significantly late compared to wild-type.
  misc_feature: The sequence is a functional homolog of SEQ ID NO 1023 in the 10/666,642US patent application
  misc_feature: The sequence is a functional homolog of SEQ ID NO 1024 in the 10/666,642US patent application
  misc_feature: The sequence is a functional homolog of SEQ ID NO 1522 in the 10/374,780US patent application
  misc_feature: The sequence is a functional homolog of SEQ ID NO 1593 in the 10/412,699US patent application
  misc_feature: The sequence is a functional homolog of SEQ ID NO 16 in the 10/412,699US patent application
  misc_feature: The sequence is a functional homolog of SEQ ID NO 1645 in the 10/374,780US patent application
  misc_feature: The sequence is a functional homolog of SEQ ID NO 1646 in the 10/374,780US patent application
  misc_feature: The sequence is a functional homolog of SEQ ID NO 1671 in the 10/412,699US patent application
  misc_feature: The sequence is a functional homolog of SEQ ID NO 1672 in the 10/412,699US patent application
  misc_feature: The sequence is a functional homolog of SEQ ID NO 18 in the 10/412,699US patent application
  misc_feature: The sequence is a functional homolog of SEQ ID NO 1896 in the 10/412,699US patent application
  misc_feature: The sequence is a functional homolog of SEQ ID NO 2160 in the 10/374,780US patent application
  misc_feature: The sequence is a functional homolog of SEQ ID NO 336 in the 10/666,642US patent application
  misc_feature: Useful for making plants with modulated flowering time
  misc_feature: Useful for making plants with modulated growth and phenotype characteristics
  misc_feature: The sequence is a functional homolog of SEQ ID NO 1593 in the 20040045049 US patent application
  misc_feature: The sequence is a functional homolog of SEQ ID NO 16 in the 20040045049 US patent application
  misc_feature: The sequence is a functional homolog of SEQ ID NO 1671 in the 20040045049 US patent application
  misc_feature: The sequence is a functional homolog of SEQ ID NO 1672 in the 20040045049 US patent application
  misc_feature: The sequence is a functional homolog of SEQ ID NO 18 in the 20040045049 US patent application
  misc_feature: The sequence is a functional homolog of SEQ ID NO 1896 in the 20040045049 US patent application
  misc_feature: Functional homolog of the protein sequence given in SEQ ID NO 13539
  misc_feature: The sequence is a functional homolog of SEQ ID NO. 370 in the 11/188,298 US application
MASLCDFCGKQRSMIYCRSDAASLCLSCDRNVHSANALSRRHTRTLLCDRCGSQPASVRCLEDNASLCQNCDWNGHDAASGASGHKRQAINCYSGCPSSAELSRIWSFIMDIPTVPAEPNCEDGLSMMTIDDSDVTNHHDASDDKRLLEIANTTLMSDPPSADKPKPLISSSSGDGFDVLPLATDQPAGSVSVTPKVPYARDDDNFNDGMYEDLCVDDADMTFENYEELFGTSHIRTEELFDDAGIDSYFEMKETQPFDFNEEPKTMQLECSNVVSADCGMLNPGARADSSLCIPVRQVRSSISHSLSGLTGESSAGDHQDCGVSPMLLMGEPPWHSPGPEGSVAGGSRDSALTRYKEKKKRRKFDKKIRYASRKARADVRKRVKGRFIKAGEAYDYDPLSQTRSY

SEQ ID NO: 12403 - DNA, 1233 bp, Sorghum bicolor
  misc_feature: Ceres ANNOT ID no. 6086283
  misc_feature: Encodes the peptide sequence at SEQ ID NO 12404
atgggcgtctgggaggccgtgctcgccggcggcggcaggagattcatcaagcgcaaggacagcgacgccggcgagacgggttcgcatccccaccaccctccctgtttgttcctcttgttggtgaacatttttcaaaaaaaaaaaaacctttccgccgccggtcgggcactggaggagttgcgaagctccttgtacaatgaaatgcatagttcagaaggtgctaagcgccagcagcagcgattctgtggaccaagtgttgcactgacattcaatttcgctgttgctgttggtattatcatggcaaataaaatggtgatggggagtgttggatttaagttcccaattgcactctcattaattcattacgcagttgcatttgttctaatggccacccttaagacattatccttgttaccagttgcccctccatcgaaatccactcctttctcatctatatttgctttgggtgctgtaatgtccctgtccactgggctagccaacgtgagtttgaaacataacagtgtaggtttctatcaaatggctaagattgctgtaaccccaacaattgttgtagctgaattcatgcttttccagaagaaagtttcctctcaaaaggctatcacactggcagttgtgtcatttggagtcgctgtagcgactgttactgatttggagttcaactttttcggtgcttgtgtcgcattagcatggattgttcctagtgccgttaacaaaatcctttggtcaagtttgcaacagagtggaaactggacagctcttgcgctgatgtggaagactactccaattacgatatttttcttattgacattgatgcctttgctggatccccctggcttgttgctgttcaattggaacatcagaaacagctgcgctattatcatttctgcattgtttggcttccttcttcagtggtctggtgctttggcactcggtgcgacgtcagccttgtctcatgttgtgctgggccaattcaaaaccatcgtcatcatgctctccggctacctgattttcggctccgaccctgggatcaccagcgtctgcggagccgtcgtcgcactcggcggcatgtccttctacacctacctgggtctgaagaaagactcggcgaccagcggcaagaaagcgccgtcgagacagaactccttcatggcgagacctaaggttgctgcagaaagtgatgacgtggattcagagcaagaagataccgtgtag

SEQ ID NO: 12404 - protein, 410 aa, Sorghum bicolor
  misc_feature: Ceres ANNOT ID no. 6086283
  misc_feature (230)..(368): Pfam Id: TPT Pfam Desc: Triose-phosphate Transporter family
  misc_feature (47)..(410): NCBI GI: 45736011 NCBI Desc: glucose-6-phosphate/phosphate-tranlocator-like [oryza sativa (japonica cultivar-group)]
  misc_feature (44)..(173): NCBI GI: 115467676 NCBI Desc: os06g0297600 [oryza sativa (japonica cultivar-group)]
  misc_feature (91)..(384): NCBI GI: 145343050 NCBI Desc: dmt family transporter: phosphate/phosphoenolpyruvate dmt [ostreococcus lucimarinus cce9901]
  misc_feature (87)..(410): NCBI GI: 48717036 NCBI Desc: phosphate translocator-like [oryza sativa (japonica cultivar-group)]
  misc_feature (87)..(368): NCBI GI: 50509221 NCBI Desc: transporter-related-like [oryza sativa (japonica cultivar-group)]
  misc_feature: The sequence is a functional homolog of SEQ ID NO. 484 in the 11/188,298 US application
  misc_feature: The sequence is a functional homolog of SEQ ID NO. 360 in the 11/188,298 US application
MGVWEAVLAGGGRRFIKRKDSDAGETGSHPHHPPCLFLLLVNIFQKKKNLSAAGRALEELRSSLYNEMHSSEGAKRQQQRFCGPSVALTFNFAVAVGIIMANKMVMGSVGFKFPIALSLIHYAVAFVLMATLKTLSLLPVAPPSKSTPFSSIFALGAVMSLSTGLANVSLKHNSVGFYQMAKIAVTPTIVVAEFMLFQKKVSSQKAITLAVVSFGVAVATVTDLEFNFFGACVALAWIVPSAVNKILWSSLQQSGNWTALALMWKTTPITIFFLLTLMPLLDPPGLLLFNWNIRNSCAIIISALFGFLLQWSGALALGATSALSHVVLGQFKTIVIMLSGYLIFGSDPGITSVCGAVVALGGMSFYTYLGLKKDSATSGKKAPSRQNSFMARPKVAAESDDVDSEQEDTV

SEQ ID NO: 12405 - DNA, 786 bp, Sorghum bicolor
  misc_feature: Ceres ANNOT ID no. 6086305
  misc_feature: Encodes the peptide sequence at SEQ ID NO 12406
atgtactgctatgcagtgaatgggagatctgcaaacccagctcacctgtggttgacaggttgcagtggagaaatggcgacccatcttcagagaattcctgggtatgataagtggatcattgaaaaggcggccaagccttatatcgaagcatttgaagatcgtaaagaaaaccttgtgtatcttacagcagatgctgaaacagtgcttgatgatctagacatgtcgaaaatatacatcattggtggcctggtggatcgaaacagatggaagggcataacgctgaaaaagtcagctgagcagggaattcaatctgcaaagcttcctattggaaactacctaaaaatgtcaagttctcaggttcttacagttaaccaagtgtttgagataatgttaaagtttgtggaaacaagggactggaagacggcattcttccatgtgattccacaaaggaagaggggagaagctgaaactggagatgatggggacaaaggtagcttggatgacaatgatgctgcccccaaaggggctgcagatggagaccattctgaagaagacatgaacaagggtttggatgaggaggtgggcgatgatggggatgaagagctggaagaggaagaaatggatgcctccaacaagaggcagtgtgttagacttgaaaacggggaagttggggatcactcctctggcgccgtagcagaggccatacccataccagacggggacgccacgctccaggctgagcaagccaagaatcaaacaacgttggccgggactgatgaacagtga

SEQ ID NO: 12406 - protein, 261 aa, Sorghum bicolor
  misc_feature: Ceres ANNOT ID no. 6086305
  misc_feature (1)..(151): Pfam Id: tRNA_m1G_MT Pfam Desc: tRNA (Guanine-1)-methyltransferase
  misc_feature (1)..(162): NCBI GI: 124359435 NCBI Desc: trna (guanine-n1-)-methyltransferase [medicago truncatula]
  misc_feature (3)..(205): NCBI GI: 22748659 NCBI Desc: rna (guanine-9-) methyltransferase domain containing 2 [homo sapiens]
  misc_feature (3)..(205): NCBI GI: 51703359 NCBI Desc: rg9mtd2-prov protein [xenopus tropicalis]
  misc_feature (3)..(203): NCBI GI: 60334840 NCBI Desc: rna (guanine-9-) methyltransferase domain containing 2 [mus musculus]
  misc_feature (3)..(203): NCBI GI: 18381001 NCBI Desc: rnmtd2 protein [mus musculus]
MYCYAVNGRSANPAHLWLTGCSGEMATHLQRIPGYDKWIIEKAAKPYIEAFEDRKENLVYLTADAETVLDDLDMSKIYIIGGLVDRNRWKGITLKKSAEQGIQSAKLPIGNYLKMSSSQVLTVNQVFEIMLKFVETRDWKTAFFHVIPQRKRGEAETGDDGDKGSLDDNDAAPKGAADGDHSEEDMNKGLDEEVGDDGDEELEEEEMDASNKRQCVRLENGEVGDHSSGAVAEAIPIPDGDATLQAEQAKNQTTLAGTDEQ

SEQ ID NO: 12407 - DNA, 669 bp, Sorghum bicolor
  misc_feature: Ceres ANNOT ID no. 6086409
  misc_feature: Encodes the peptide sequence at SEQ ID NO 12408
atggggatgagcagggctccgcgacgacgggcgtccccatccgcggcggcggctgtgccttggctgcttctcttcgccgttctattcgtgggccgggcgacggcgcaaggccccggcgcgacgccgctgtccaagcacgcgtcgttcttcgaccgcaacggcgacggcgtcgtctccttcgaggagacgtacggcgcgtttcgggctctcgggtttggattcggcatgtccggcgtcagcgctgccttcatcaatggcgctcttggtagcaagtgcagacctcaaaatgcaacgtcatcgaagttggacatctacattgaggacatctataaggggaaacatggaagcgattcaggctcatatgacaccgaaggaaggtttgttcctgataagttcgaagcgatattcgccaatcacgcaaagactgtccctgacgccctgacatcggacgagatcgaccagctgctccaagcaaacagagagcccggggactacaccggatgggccggcgcagaagcggagtggaagatcctgtacagcctcggcaagaaccagaacggcctcctccacaaggacgtcgcaagaagcgtctacgacgggacgctgttccacaggctcgcgcccaactggaaacctctcgacaaggagagcgtgatcagggagaactga

SEQ ID NO: 12408 - protein, 222 aa, Sorghum bicolor
  misc_feature: Ceres ANNOT ID no. 6086409
  misc_feature (35)..(208): Pfam Id: Caleosin Pfam Desc: Caleosin related protein
  misc_feature (39)..(211): NCBI GI: 115451637 NCBI Desc: os03g0222600 [oryza sativa (japonica cultivar-group)]
  misc_feature (41)..(206): NCBI GI: 145336050 NCBI Desc: caleosin-related family protein [arabidopsis thaliana]
  misc_feature (43)..(185): NCBI GI: 37652831 NCBI Desc: calcium binding protein [fagus sylvatica]
  misc_feature (43)..(207): NCBI GI: 6478218 NCBI Desc: caleosin [sesamum indicum]
  misc_feature (41)..(206): NCBI GI: 9295714 NCBI Desc: f26f24.9 [arabidopsis thaliana]
MGMSRAPRRRASPSAAAAVPWLLLFAVLFVGRATAQGPGATPLSKHASFFDRNGDGVVSFEETYGAFRALGFGFGMSGVSAAFINGALGSKCRPQNATSSKLDIYIEDIYKGKHGSDSGSYDTEGRFVPDKFEAIFANHAKTVPDALTSDEIDQLLQANREPGDYTGWAGAEAEWKILYSLGKNQNGLLHKDVARSVYDGTLFHRLAPNWKPLDKESVIREN

SEQ ID NO: 12409 - DNA, 1875 bp, Sorghum bicolor
  misc_feature: Ceres ANNOT ID no. 6086467
  misc_feature: Encodes the peptide sequence at SEQ ID NO 12410
  misc_feature: Down-regulated in shoot tissues in response to salicylic acid treatment
atgggcaccacagcgcggcgcgagccgctgaagcagcgcgtgaaccgctgcctcctcaagctttccgaccgcgacacagaggccatggcggccgccgagctcgaggccatcgcgcgcgcgctcgagcccgacgagctcccggccttcgtctcggccgtctccgacgcgcgccccaccgacaagaccccgctccgccgccacgcgctgcgcgccctggcgctcgtcgcggcgtcccacccgcgcgacgccgtggccccgctcgtcccgcgcatcctcgccgccgcgctccgccgcgtccgggaccaggactcctccgtccgcgccgcgctcgtcgacaccgcgcgcgccgcggcggcggcctccgcctccgcctccgccgcgctccggcccctcacggacgcgctccttcacgagcaggaccagtgcgcgcagctggcggccgcgctcgccacggccgccgccgtcgaggcgtccgccgtcaccgccgacctcgcttcctacctccacaagctccaaccgcgcctcctcaagttacttcgcagcaatgccttcaaggccaagcccgcgctcatcaccctcatcggcgcctccgcggccatggccggcgatgccgaagtcaccgcctccatcccgtgcctccgcgatgcaatcgctagcgatgactgggcagcgagaaaggcggcggcggaggcgcttgctgcattggccctggagcacacggatcttctcacgacctacaaatcctcttgcgttaccttcttcgaggccagaaggtttgacaaggtcaagattgtgcgagagtcgatgaaccggatgattgaggcgtggaaggagatcccgggtgctgaagaggacgagtgctcctccgctccgccaccagcgtcccaatcacaacgaagatcttctcttacagggagtgcaagtgatgggcgatatccagctgcttcgctgggctcaaactctgttccatcatcaacaaggaggagcagattacctgtgagcagatcatctccgcctgatgtgtcacccagtgtcaccaaaacaaatagtccttcgtccatcaggaacaagaagctgtcaccaccttcatatcgcaaagtgcgccaagcaaataattgtgactacaaggttgagattgctgttgctccggatgctaccccaatcaaagtggtgactgaggagaagctactgaaaggaggcaatgtgagagacagactggaggctaggagaacactcttccaaggcagcgaggataggtcagccaagctggctggacacaaagcagggtcacgagttgttccgtacgagggcggtggtaatttggaagagatttcagaagttgaaggtggatcagaaaggtatacagttcataaggatgagagcttgtcagaaataaggacgcagctccttcagattgaaaatcagcaaagcagtttactggatcttctccagaaatttatgggtaagtccgagaatggtatgaattctttggagacaagggtgcatgggctggagatggctttggatgagatctctcgtgatttggccttctcttcaggaaggatgtcaaacagggagcctgatgtaaagacgtgctgcattctgagtccaaaattctggagaaggcacaatggtggtaggtcttcctcaaggttttctgcctcagacccagcaaacagctcagacgagagcagaacttcttacaaatgggagagacagaagtttgggcttcagggtggctttgtcacaaacccattagccgagccaaacatttcttcagtagggaaaacaatggttactcaagaaggcaggaagaaggatacaactttacaaaagtcaagttcagttgcagaagatacggttgttaggacttag

SEQ ID NO: 12410 - protein, 624 aa, Sorghum bicolor
  misc_feature: Ceres ANNOT ID no. 6086467
  misc_feature (1)..(613): NCBI GI: 115467352 NCBI Desc: os06g0244700 [oryza sativa (japonica cultivar-group)]
  misc_feature (11)..(621): NCBI GI: 17978932 NCBI Desc: at5g62580/k19b1_19 [arabidopsis thaliana]
  misc_feature (10)..(582): NCBI GI: 8778871 NCBI Desc: t7n9.27 [arabidopsis thaliana]
  misc_feature (10)..(486): NCBI GI: 9802548 NCBI Desc: f17l21.1 [arabidopsis thaliana]
  misc_feature (49)..(524): NCBI GI: 30102682 NCBI Desc: at4g27060 [arabidopsis thaliana]
  misc_feature: Down-regulated in shoot tissues in response to salicylic acid treatment
MGTTARREPLKQRVNRCLLKLSDRDTEAMAAAELEAIARALEPDELPAFVSAVSDARPTDKTPLRRHALRALALVAASHPRDAVAPLVPRILAAALRRVRDQDSSVRAALVDTARAAAAASASASAALRPLTDALLHEQDQCAQLAAALATAAAVEASAVTADLASYLHKLQPRLLKLLRSNAFKAKPALITLIGASAAMAGDAEVTASIPCLRDAIASDDWAARKAAAEALAALALEHTDLLTTYKSSCVTFFEARRFDKVKIVRESMNRMIEAWKEIPGAEEDECSSAPPPASQSQRRSSLTGSASDGRYPAASLGSNSVPSSTRRSRLPVSRSSPPDVSPSVTKTNSPSSIRNKKLSPPSYRKVRQANNCDYKVEIAVAPDATPIKVVTEEKLLKGGNVRDRLEARRTLFQGSEDRSAKLAGHKAGSRVVPYEGGGNLEEISEVEGGSERYTVHKDESLSEIRTQLLQIENQQSSLLDLLQKFMGKSENGMNSLETRVHGLEMALDEISRDLAFSSGRMSNREPDVKTCCILSPKFWRRHNGGRSSSRFSASDPANSSDESRTSYKWERQKFGLQGGFVTNPLAEPNISSVGKTMVTQEGRKKDTTLQKSSSVAEDTVVRT

SEQ ID NO: 12411 - DNA, 1137 bp, Sorghum bicolor
  misc_feature: Ceres ANNOT ID no. 6086597
  misc_feature: Encodes the peptide sequence at SEQ ID NO 12412
atgatactagtattttcgacgataacagcaagaagccttcataaagccatacctgcttctcattcacattcttcaaacttttggaacaaagaattctttagctgtaagccaacatttcaacatcttagcactgacaacccgatgagcccaaatgatttgttggaggctcaggatagggttcctgctgagggaaaccacagttgctcctcaagtgttcagtccaccccagaaattgagaaaaagtatgtgcatcgtgtctatgatgctatagccccccatttcagtgcaacaagatttgctaaatggcccaaggttgctggattcttgaattccttgaggcctgggtcgattgtactggatgctggctgtggtaatggcaagtatttgggcttcaaccctgattgtttattcataggatgtgatataagcccaccgcttattgagatatgtgctgggagagggcatgaggtgttggttgctgatgctgtcaacctcccatacagggatgattttggtgatgcagcaatttcaattgctgtgttgcatcatttgagtactgatgatagacggaggaaggccatagaagagctcatacgtgttgttcggagaggtggtctggtgctcataacagtctgggctagggagcaggaagacaagtcattgcttaacaagtggactcccctctgtgagaaatataatgaagagtgggttgaacagagcagtcctccagtacgtagtcaatctggaactcttctggaaagcattgcagaaactgatgaagacactggtgtaatgaagcaaacagatgaccaattgaaaaaatgtcatgatggggtggaggataagatcattgactgtagtaattcaaagactgatgaaaatgagaaaaaccagcaggagtactttgttccatggcatctaccatttcaccgagctgaaattggtgctgcatctgctgctctggagattggatttgcaaagaaagatgagaagaagggtacagtggtctacaatcgttattatcatgtttttgttgaaggagaacttcaaagattggtttctggcataaagaatgctactattgttgaccagttctatgacaaatccaactggtgcattgttctcgagaagctttga

SEQ ID NO: 12412 - protein, 378 aa, Sorghum bicolor
  misc_feature: Ceres ANNOT ID no. 6086597
  misc_feature (119)..(209): Pfam Id: Methyltransf_11 Pfam Desc: Methyltransferase domain
  misc_feature (119)..(207): Pfam Id: Methyltransf_12 Pfam Desc: Methyltransferase domain
  misc_feature (1)..(378): NCBI GI: 46390207 NCBI Desc: methyltransferase-like [oryza sativa (japonica cultivar-group)]
  misc_feature (67)..(378): NCBI GI: 61675696 NCBI Desc: riken cdna 4930562c03 [mus musculus]
  misc_feature (124)..(259): NCBI GI: 50261863 NCBI Desc: at1g36310 [arabidopsis lyrata subsp. petraea]
  misc_feature (67)..(377): NCBI GI: 119587493 NCBI Desc: alkb, alkylation repair homolog 8 (e. coli), isoform cra_b [homo sapiens]
  misc_feature (77)..(314): NCBI GI: 55234784 NCBI Desc: ensangp00000021203 [anopheles gambiae str. pest]
MILVFSTITARSLHKAIPASHSHSSNFWNKEFFSCKPTFQHLSTDNPMSPNDLLEAQDRVPAEGNHSCSSSVQSTPEIEKKYVHRVYDAIAPHFSATRFAKWPKVAGFLNSLRPGSIVLDAGCGNGKYLGFNPDCLFIGCDISPPLIEICAGRGHEVLVADAVNLPYRDDFGDAAISIAVLHHLSTDDRRRKAIEELIRVVRRGGLVLITVWAREQEDKSLLNKWTPLCEKYNEEWVEQSSPPVRSQSGTLLESIAETDEDTGVMKQTDDQLKKCHDGVEDKIIDCSNSKTDENEKNQQEYFVPWHLPFHRAEIGAASAALEIGFAKKDEKKGTVVYNRYYHVFVEGELQRLVSGIKNATIVDQFYDKSNWCIVLEKL

SEQ ID NO: 12413 - DNA, 924 bp, Sorghum bicolor
  misc_feature: Ceres ANNOT ID no. 6086797
  misc_feature: Encodes the peptide sequence at SEQ ID NO 12414
atgaagttcggcaagaagtacgaggcgtacatgaggggcatggaggcggagctccccgccgtcgggatcaagcgcctcaagaagatgctcaagacgtgccgcctgtgtgatgggagtttcttcccgtctcttctgaacgagatgtcagctgtggtcggctgcttcaacgagaaagccaagaagctactcgaactgcacctggcgtcaggattcaagaaatacaccatgtggttcaccaacaagggtggcaagagccacgggagactgacacagcaaggcaaagacttggttacctatgcgattataaatgccgtggccatgaggaagattctcaagaagtatgacaagatacattactcaaagcaagggcaagaattcaaagctcaagctcagagcctccacattgagatacttcagtccccatggctctgtgagctgatggctttctacatgaacttgaggaggagcaagaagaacaatgccgctgcaatggaactctttggcgactgttccctcgtattcgatgacgacagaccaacgctctcatgcaacctctttgactccatgctgatatgctgcagtccaatctgtgatcactctacaatacggctattttgccctgatacagtgtttgatccagtctctctttcctgtggccacatattctgctacttatgctgctgttctgctgcatctgtgacaattgtcgatgggctgaagtctgcagatcacaaatcaaaatgtcccctatgccgacagcaaggggtctttcctgacgctatgcacctggatgaactcaacatgctgttgagtcacagttgtccagagtactgggagaagagaatgcaattggagcgagttgaacgtgttcgcctggctaaggagcattgggagtcacagtgcagagcatttttaggcatctaa

SEQ ID NO: 12414 - protein, 307 aa, Sorghum bicolor
  misc_feature: Ceres ANNOT ID no. 6086797
  misc_feature (1)..(131): Pfam Id: SPX Pfam Desc: SPX domain
  misc_feature (1)..(307): NCBI GI: 92878435 NCBI Desc: zinc finger, ring-type; spx, n-terminal [medicago truncatula]
MKFGKKYEAYMRGMEAELPAVGIKRLKKMLKTCRLCDGSFFPSLLNEMSAVVGCFNEKAKKLLELHLASGFKKYTMWFTNKGGKSHGRLTQQGKDLVTYAIINAVAMRKILKKYDKIHYSKQGQEFKAQAQSLHIEILQSPWLCELMAFYMNLRRSKKNNAAAMELFGDCSLVFDDDRPTLSCNLFDSMLICCSPICDHSTIRLFCPDTVFDPVSLSCGHIFCYLCCCSAASVTIVDGLKSADHKSKCPLCRQQGVFPDAMHLDELNMLLSHSCPEYWEKRMQLERVERVRLAKEHWESQCRAFLGI

SEQ ID NO: 12415 - DNA, 777 bp, Sorghum bicolor
  misc_feature: Ceres ANNOT ID no. 6086807
  misc_feature: Encodes the peptide sequence at SEQ ID NO 12416
atggcggaggagcagcccaacccccagccgcagcaagcggaggagagcgaggttgttgtggagcagcagccgaggagggccccgaagctgaggtacctggacttcgtccaggtggcggcggcgcaggccgtggtgtgcctcgcggggctctacggcctcgccaaggaccacgccggcccgctccgccccggcgtcgacgccgtcgagtccaccgtcaagggcgtcgccggccccgtctacgctcgcttcggcggcctgcccctcgacgtcctcgccttcgtcgaccgcaaggtggacgacacggtgcacgaggtggacaagcacctcccgggcgcgctgaaggcggcgtcggcgcgtgcctacgcggtggcgcggggcgtgcctgaggtggcgcgcgagctggtggcggaggcgcagcagtcgggcgtgaagggcgcggcgcgcgcggcgctcgccagggcggagcccgtggcgagggacgtgtacggccgcgtggagcccgtggcgagggacctgtacgtgcggtacgagcccgcggcggagcacctggccgtctccgcctggcgctctctcaacggcctgccggtgttcccgcacgtcgcgcagatcgtcgtgcccaccgccgcgcactgggccgagaagtacaacagggcggtcgtcgccgcggccgagcggggctacgccggagccaagtacctccccgccatccccactgagcgcatcgccaaggtgttctcgtcgccggatgccgagccgctggccgccgagtcccagtag

SEQ ID NO: 12416 - protein, 258 aa, Sorghum bicolor
  misc_feature: Ceres ANNOT ID no. 6086807
  misc_feature (21)..(249): Pfam Id: REF Pfam Desc: Rubber elongation factor protein (REF)
  misc_feature (2)..(257): NCBI GI: 115474005 NCBI Desc: os07g0671800 [oryza sativa (japonica cultivar-group)]
  misc_feature (2)..(257): NCBI GI: 29367349 NCBI Desc: stress-related protein-like protein [oryza sativa (japonica cultivar-group)]
  misc_feature (15)..(252): NCBI GI: 5802955 NCBI Desc: stress related protein [vitis riparia]
  misc_feature (9)..(257): NCBI GI: 33332330 NCBI Desc: rubber synthesis protein [parthenium argentatum]
  misc_feature (82)..(253): NCBI GI: 37622210 NCBI Desc: small rubber particle protein [hevea brasiliensis]
MAEEQPNPQPQQAEESEVVVEQQPRRAPKLRYLDFVQVAAAQAVVCLAGLYGLAKDHAGPLRPGVDAVESTVKGVAGPVYARFGGLPLDVLAFVDRKVDDTVHEVDKHLPGALKAASARAYAVARGVPEVARELVAEAQQSGVKGAARAALARAEPVARDVYGRVEPVARDLYVRYEPAAEHLAVSAWRSLNGLPVFPHVAQIVVPTAAHWAEKYNRAVVAAAERGYAGAKYLPAIPTERIAKVFSSPDAEPLAAESQ

SEQ ID NO: 12417 - DNA, 939 bp, Sorghum bicolor
  misc_feature: Ceres ANNOT ID no. 6086853
  misc_feature: Encodes the peptide sequence at SEQ ID NO 12418
atggcttcctccttaccgctggtcacggctggactccgccgtccgttgtcgtcgacgacggcggccagcgacggcacgcgccccaatggtagcggccggcagctgaacgaggaccctctgcactggtgcgcgtgggcgcaccaagggcaccgcctctgggcagggatgcccgtctccttctgggtattcacgtacaaagtggaacggtgcccgttccggcgcagcaacaacgaccacgtctggatgtcgtgcccgtacgcgcacaggggcgagcgcgcgcggcgccgcgacccgagaaccttcctgtactccgccacgccgtgcccggcgtacgaggagtccaagcggcagctccggctggccaggtctaccgcggcgcccacctgtgcgcgtggcctccgctgcggctacgcgcacggcgtcttcgagacgtggctgcaccccagcaggttccgcaccgtcatgtgccagcgcggcgccgagtgctcgcgcaacatctgcttctttgcgcactcccccgcgcagcgtaggcggcgtcaggacgacgacgacgacgtgccactcgtcgtcttccccgtgacgacgacgccgcagccgccccgatcagccttcgtcccgcgcctcgccgcgtcgtcgtcggcggtggcgtcccgctcccagccggtcgtcgtctctcatccgattgaccggcgggttacgctggccatggagcagggccacaccgtgcgcctgcttacgcggcactccaatgccgccgctggtggcgcttcgtcgtcgtcctcctcctcccttgccgccgcgccgtcgcccgtcgatgacgaagacattgacttcgtcactattgtgaccaactgctgcctcgcttccgaggcagactctaaggctgagggcaatggctacccgcagtttgacctcttcatggacaccgtgaggaggtag

SEQ ID NO: 12418 - protein, 312 aa, Sorghum bicolor
  misc_feature: Ceres ANNOT ID no. 6086853
  misc_feature (38)..(310): NCBI GI: 23307508 NCBI Desc: zinc finger transcription factor-like protein [oryza sativa (japonica cultivar-group)]
  misc_feature (60)..(180): NCBI GI: 34013885 NCBI Desc: zing finger transcription factor pei1 [boechera drummondii]
  misc_feature (60)..(180): NCBI GI: 38260624 NCBI Desc: cu2+ plastocyanin-like [arabidopsis arenosa]
  misc_feature (60)..(180): NCBI GI: 38260661 NCBI Desc: zn-finger transcription factor [olimarabidopsis pumila]
  misc_feature (60)..(180): NCBI GI: 38260676 NCBI Desc: zn-finger transcription factor [arabidopsis arenosa]
MASSLPLVTAGLRRPLSSTTAASDGTRPNGSGRQLNEDPLHWCAWAHQGHRLWAGMPVSFWVFTYKVERCPFRRSNNDHVWMSCPYAHRGERARRRDPRTFLYSATPCPAYEESKRQLRLARSTAAPTCARGLRCGYAHGVFETWLHPSRFRTVMCQRGAECSRNICFFAHSPAQRRRRQDDDDDVPLVVFPVTTTPQPPRSAFVPRLAASSSAVASRSQPVVVSHPIDRRVTLAMEQGHTVRLLTRHSNAAAGGASSSSSSSLAAAPSPVDDEDIDFVTIVTNCCLASEADSKAEGNGYPQFDLFMDTVRR

SEQ ID NO: 12419 - DNA, 834 bp, Sorghum bicolor
  misc_feature: Ceres ANNOT ID no. 6086916
  misc_feature: Encodes the peptide sequence at SEQ ID NO 12420
atggcggtggcgcggctgcgcgcggcggccgccgcccggctgccgccggcgctctcccgcggagagaggcggccgctcgggacggcggcggaggtggccacgaccgcggggccaggggccgcgaggtgggagctcatgggggcgcgggagtactacgactaccggcgggccatctacggcgacatcacgcataaggccatcctcgtcgacgccgccggcacgctgctcgcccccaccgaacccatggcccaggtgtacagaacgataggccagaagtatggagtggattattcagaggatgagattctgatgcggtatcgccgggcttatgcgcagccatggggtagatcacgtctgaggtatgttaatgatggaaggcccttttggcaatacatagtgagttcatccactggctgttcagatctacagtattttgaggaactgtatcagtactatacaactgaaaaggcttggcatctctgcgatccagatgctggacgtgtttttgaggcattgaggagggctggtgtcaaaacagctgtcgtgtccaactttgacactcgtcttcggccacttctacaagcactgaaatgtgacggctggtttgatgcagttgctatatctgctgaggttgccgcagaaaagccaaaccctacaatattcttgaaggcttgtgagctgttgggagtgaaacctgaagaagctgtgcatattggtgatgaccgtaggaacgacgtatggggagcaagggatgcaggctgcgatgcctggctttggggcagtgatgtgtactccttcaaggaggttgcagagaggatcggggttgaggtgtag

SEQ ID NO: 12420 - protein, 277 aa, Sorghum bicolor
  misc_feature: Ceres ANNOT ID no. 6086916
  misc_feature (64)..(262): Pfam Id: Hydrolase Pfam Desc: haloacid dehalogenase-like hydrolase
  misc_feature (46)..(277): NCBI GI: 70927822 NCBI Desc: dt-related protein [oryza sativa (japonica cultivar-group)]
  misc_feature (49)..(277): NCBI GI: 92898439 NCBI Desc: haloacid dehalogenase/epoxide hydrolase [medicago truncatula]
  misc_feature (64)..(273): NCBI GI: 50897254 NCBI Desc: at1g14310 [arabidopsis thaliana]
  misc_feature (65)..(274): NCBI GI: 86605887 NCBI Desc: haloacid dehalogenase, ia family protein [cyanobacteria bacterium yellowstone a-prime]
  misc_feature (65)..(258): NCBI GI: 75907032 NCBI Desc: had-superfamily hydrolase, subfamily ia, variant 1 [anabaena variabilis atcc 29413]
MAVARLRAAAAARLPPALSRGERRPLGTAAEVATTAGPGAARWELMGAREYYDYRRAIYGDITHKAILVDAAGTLLAPTEPMAQVYRTIGQKYGVDYSEDEILMRYRRAYAQPWGRSRLRYVNDGRPFWQYIVSSSTGCSDLQYFEELYQYYTTEKAWHLCDPDAGRVFEALRRAGVKTAVVSNFDTRLRPLLQALKCDGWFDAVAISAEVAAEKPNPTIFLKACELLGVKPEEAVHIGDDRRNDVWGARDAGCDAWLWGSDVYSFKEVAERIGVEV

SEQ ID NO: 12421 - DNA, 462 bp, Sorghum bicolor
  misc_feature: Ceres ANNOT ID no. 6086933
  misc_feature: Encodes the peptide sequence at SEQ ID NO 12422
atggcaacatccaccgtctccttcctcgccatggccgtcgtggcgatggcattgcttcaagctgcggctgccaatccgccaccaacaccgtacggcaggccgacgagctgtgcagcaacgttattcgagctcagcaactgcgctccattcctgacgatcggaacggttatctccggccctccggccaactgctgtgcccccctgagggcggttctcgccacgccggcgtccatctgcctctgccacaccattggcggcgagatcaacgagctcttgcgcattaatatcgaccccatccgactggctttgctacctgttgcctgctgggcgataattggacctgtgccacccatctccaccatcccgcctatgcctccgtccccgccggtgacgcctccgtcgcctatgcctccatcgccgccagtgacgcctccgtcgccgccgatggggcctctgccctag

SEQ ID NO: 12422 - protein, 153 aa, Sorghum bicolor
  misc_feature: Ceres ANNOT ID no. 6086933
  misc_feature (25)..(153): NCBI GI: 1657851 NCBI Desc: cold acclimation protein wcor518 [triticum aestivum]
  misc_feature (7)..(153): NCBI GI: 15220327 NCBI Desc: protease inhibitor/seed storage/lipid transfer protein (ltp) family protein [arabidopsis thaliana]
  misc_feature (114)..(153): NCBI GI: 119569811 NCBI Desc: hcg1818116 [homo sapiens]
  misc_feature (35)..(137): NCBI GI: 38347146 NCBI Desc: osjnba0039g19.6 [oryza sativa (japonica cultivar-group)]
  misc_feature (9)..(139): NCBI GI: 50509338 NCBI Desc: protease inhibitor-like protein [oryza sativa (japonica cultivar-group)]
MATSTVSFLAMAVVAMALLQAAAANPPPTPYGRPTSCAATLFELSNCAPFLTIGTVISGPPANCCAPLRAVLATPASICLCHTIGGEINELLRINIDPIRLALLPVACWAIIGPVPPISTIPPMPPSPPVTPPSPMPPSPPVTPPSPPMGPLP

SEQ ID NO: 12423 - DNA, 648 bp, Sorghum bicolor
  misc_feature: Ceres ANNOT ID no. 6086942
  misc_feature: Encodes the peptide sequence at SEQ ID NO 12424
atggcggccgcggactccgactccacctccgcctgcccgcactgcttctgcaaattgtcgaacaagagtacatttcctgtatcgtatattcgtatcagtcagcgggagattccatcttcaaacattgaattgcacagcgcgcactgcgctcggaaccttcagaagtgtgagcattgtggagatatggttccgaggaagcttatggatgaacactacgatgaaaaccatgctccgatgaattgctcactttgcaaacacacagtagaacgtgagatatgggatcttcatacaggcatacaatgcccacaaaggatgctcgcatgccaatactgtcagtttgaattgcctgcagtcgatctttttgaacatcaggatgtgtgtggaaatcgaacagaatattgtcaaagttgcaggaagtatatcagacttcgccaatggattggacatgaactccagttccatacgattttaaatgctgcatcagaactttcaagtgacaggactccagcagcagcagccgagcagccagtaccaaagccagcgcgacctgctactggttcacttaacaaacaactgctcttgacggttgcaataactggagttgcagttttgattggatcaatactgtaccaaagtaaggggaagtag

SEQ ID NO: 12424 - protein, 215 aa, Sorghum bicolor
  misc_feature: Ceres ANNOT ID no. 6086942
  misc_feature (33)..(214): NCBI GI: 115473829 NCBI Desc: os07g0657500 [oryza sativa (japonica cultivar-group)]
  misc_feature (35)..(214): NCBI GI: 50510133 NCBI Desc: xiap associated factor-1-like protein [oryza sativa (japonica cultivar-group)]
  misc_feature (34)..(149): NCBI GI: 49114926 NCBI Desc: mgc80116 protein [xenopus laevis]
  misc_feature (34)..(149): NCBI GI: 89268769 NCBI Desc: novel protein [xenopus tropicalis]
  misc_feature (28)..(149): NCBI GI: 40288191 NCBI Desc: xiap associated factor-1 isoform 1 [homo sapiens]
  misc_feature: Useful for making plants with altered terpenoid content
  misc_feature: Functional homolog of the protein sequence given in SEQ ID NO 13324
  misc_feature: Useful for making plants with altered terpenoid content
  misc_feature: Functional homolog of the protein sequence given in SEQ ID NO 13324
MAAADSDSTSACPHCFCKLSNKSTFPVSYIRISQREIPSSNIELHSAHCARNLQKCEHCGDMVPRKLMDEHYDENHAPMNCSLCKHTVEREIWDLHTGIQCPQRMLACQYCQFELPAVDLFEHQDVCGNRTEYCQSCRKYIRLRQWIGHELQFHTILNAASELSSDRTPAAAAEQPVPKPARPATGSLNKQLLLTVAITGVAVLIGSILYQSKGK

SEQ ID NO: 12425 - DNA, 1029 bp, Sorghum bicolor
  misc_feature: Ceres ANNOT ID no. 6086975
  misc_feature: Encodes the peptide sequence at SEQ ID NO 12426
atgatcccgtggggcggcgtggggtgttgcctcagcgctgcggcgctgtatctcctcggcaggagcagcggaagggatgcggaggtgctgcggtcggtggcgagggctggcagcatgaaggatttagctgctatcttggacactgcaagtaaagtcctaccacttgtagttgctgtctctgggagagttagttcagacacaccacttatatgccaacaaagcggcatgagaggtgtaatcgttgaggaaacggcagaacaacacttcttgaagcacaacgatgctggatcctggattcaagattctgcagtgatgctttctgttagcaaagaggttccatggtatctggatgatggaactggacgtgtatatgtggtcggtgctcgttctgcagctggtttaattttaactgttgctagtgaggtttttgaggagtcggggagaacacttgtacgtggaactctagattatttacaagggttgaagatgctgggagtaaagcgaactgaaagggttcttccaactggaacctcgctgacggttgttggtgaggctattagagatgatgttggaactattcgaattcagcgaccacataaaggacccttttatgtatcaccaaaaagcattgatcaacttattatgaatcttggaaaatgggccaagttataccgccttgcttcaatgggctttgcaacatttggtgtcttccttcttgcaaagcgtgcaatacaacattttctagaaagaaagcgccggcatgaactccaaaaaagggttcttaatgcagcagcacaaaggcaagctagagaagctgaagggagcaatggttcatcggacacagagcctaacagtaaaaaggaccaattagtgttggacatatgtgtcatatgccttgagcaagagtacaatgctgtttttgtgccgtgcggtcacatgtgttgctgtatggcatgctcttcacatttgacaaactgcccactttgccggagaagaattgaccaagctgtcagaaccttccgccattga

SEQ ID NO: 12426 - protein, 342 aa, Sorghum bicolor
  misc_feature: Ceres ANNOT ID no. 6086975
  misc_feature (1)..(259): NCBI GI: 115473747 NCBI Desc: os07g0647800 [oryza sativa (japonica cultivar-group)]
  misc_feature (1)..(342): NCBI GI: 144924893 NCBI Desc: zinc finger, ring-type [medicago truncatula]
  misc_feature (1)..(342): NCBI GI: 8778741 NCBI Desc: t30e16.12 [arabidopsis thaliana]
  misc_feature (105)..(342): NCBI GI: 6520214 NCBI Desc: zcf61 [arabidopsis thaliana]
  misc_feature (26)..(162): NCBI GI: 72537414 NCBI Desc: at1g63900-like protein [arabidopsis lyrata]
MIPWGGVGCCLSAAALYLLGRSSGRDAEVLRSVARAGSMKDLAAILDTASKVLPLVVAVSGRVSSDTPLICQQSGMRGVIVEETAEQHFLKHNDAGSWIQDSAVMLSVSKEVPWYLDDGTGRVYVVGARSAAGLILTVASEVFEESGRTLVRGTLDYLQGLKMLGVKRTERVLPTGTSLTVVGEAIRDDVGTIRIQRPHKGPFYVSPKSIDQLIMNLGKWAKLYRLASMGFATFGVFLLAKRAIQHFLERKRRHELQKRVLNAAAQRQAREAEGSNGSSDTEPNSKKDQLVLDICVICLEQEYNAVFVPCGHMCCCMACSSHLTNCPLCRRRIDQAVRTFRH

SEQ ID NO: 12427 - DNA, 285 bp, Sorghum bicolor
  misc_feature: Ceres ANNOT ID no. 6087012
  misc_feature: Encodes the peptide sequence at SEQ ID NO 12428
atgtatatccgagtgaagcgcaacaagactacctacttcattcaatgtgaaccaacagaaacggctttgagcatcaaacagaagttgcattcgctgatagaccaacctcctattaatcagcagttgctcttgtggcccagcagtgatgtgcttgaagactcaaagacgctggcagatcaaaaggtggaaaacgattccattgttgctttggcactaagaaaagatgacgatgagtttgaggaagttttcatcgccaggccagaggatttcatgtcatcatcatga

SEQ ID NO: 12428 - protein, 94 aa, Sorghum bicolor
  misc_feature: Ceres ANNOT ID no. 6087012
  misc_feature (1)..(94): NCBI GI: 115453139 NCBI Desc: os03g0364000 [oryza sativa (japonica cultivar-group)]
  misc_feature (1)..(93): NCBI GI: 17154771 NCBI Desc: ubiquitin-like protein [cucumis sativus]
  misc_feature (1)..(73): NCBI GI: 29650470 NCBI Desc: ubiquitin [bombyx mori nuclear polyhedrosis virus]
  misc_feature (1)..(73): NCBI GI: 1174858 NCBI Desc: ubiquitin-like protein
  misc_feature (1)..(73): NCBI GI: 23476580 NCBI Desc: viral ubiquitin [rachiplusia ou multiple nucleopolyhedrovirus]
MYIRVKRNKTTYFIQCEPTETALSIKQKLHSLIDQPPINQQLLLWPSSDVLEDSKTLADQKVENDSIVALALRKDDDEFEEVFIARPEDFMSSS

SEQ ID NO: 12429 - DNA, 1047 bp, Sorghum bicolor
  misc_feature: Ceres ANNOT ID no. 6087048
  misc_feature: Encodes the peptide sequence at SEQ ID NO 12430
atggatctggtgaacggcgtgctcaactgggtggggacgccggccatggtggcctgcctgctgctcttctacccgccctactacctcttcaagacctgctactccttcctctcctggctcttccccgaggacctcgccggcaaggtcgtgctcatcaccggcgcttcctccggcatcggcgagcaactggcttaccagtacgctctgaaacgggcctccctcgccctcgtcgcaagaagggagtcgagcctccgacatgtcgccgaccgagcactcgagctcggcgcgcgcgacgtcatcgtcctcccgggcgacgtctctgcccccgatgactgcaacagatttgttcagaccgcgatcagtcactacgaccgattggaccatctcgtgtgcaatgccggcatcgcgagcgtcggcgcgtttcaggagattccagatgtcacaaaatacagctctcagcttgatgtcaatttctggggttctgttcaaacgacgttcgctgccctgcctcatctgaagagaagccgaggaaggattgtggtgactgcatctgcaaccggatggaacccagttcctagaatgagcttctataatgctgccaatgctgccctcataaacttcttcgagacgctgcggactgagctaggaaaccaagttgggatcacggtggtgacgcccgggtggatcgagtccgagatgtcgaaagggaagtacctcaaggagcatggcgaagtggaggttgatcaagaaatgcgcgacgctcagatcggtctgttcccggtggagtacgccaagaactgcgccaaggccatggtgcaggcggcgcagcaaggcgagcgatacctcaccgtgccggcgtggttcaggccgatgtacctgtggcgggtgttcgcgccggaggtcgtcgaggcctgctaccgcctcctgtacatgcacggccatggcgccaggcaggccgacacggcgagcaggacgatggcggactccggtggtaagcagctgctgtacccgacctcgctgcgctctgaggagatcaagagtgactga

SEQ ID NO: 12430 - protein, 348 aa, Sorghum bicolor
  misc_feature: Ceres ANNOT ID no. 6087048
  misc_feature (48)..(216): Pfam Id: adh_short Pfam Desc: short chain dehydrogenase
  misc_feature (1)..(348): NCBI GI: 115488506 NCBI Desc: os12g0464400 [oryza sativa (japonica cultivar-group)]
  misc_feature (1)..(348): NCBI GI: 112784981 NCBI Desc: 11-beta-hydroxysteroid dehydrogenase-like protein [triticum aestivum]
  misc_feature (2)..(346): NCBI GI: 21742781 NCBI Desc: osjnba0055c08.3 [oryza sativa (japonica cultivar-group)]
  misc_feature (1)..(348): NCBI GI: 20148649 NCBI Desc: 11-beta-hydroxysteroid dehydrogenase-like [arabidopsis thaliana]
  misc_feature (1)..(348): NCBI GI: 124107990 NCBI Desc: short-chain dehydrogenase reductase [brassica napus]
  misc_feature: The sequence is a functional homolog of SEQ ID NO. 389 in the 11/188,298 US application
MDLVNGVLNWVGTPAMVACLLLFYPPYYLFKTCYSFLSWLFPEDLAGKVVLITGASSGIGEQLAYQYALKRASLALVARRESSLRHVADRALELGARDVIVLPGDVSAPDDCNRFVQTAISHYDRLDHLVCNAGIASVGAFQEIPDVTKYSSQLDVNFWGSVQTTFAALPHLKRSRGRIVVTASATGWNPVPRMSFYNAANAALINFFETLRTELGNQVGITVVTPGWIESEMSKGKYLKEHGEVEVDQEMRDAQIGLFPVEYAKNCAKAMVQAAQQGERYLTVPAWFRPMYLWRVFAPEVVEACYRLLYMHGHGARQADTASRTMADSGGKQLLYPTSLRSEEIKSD

SEQ ID NO: 12431 - DNA, 1107 bp, Sorghum bicolor
  misc_feature: Ceres ANNOT ID no. 6087070
  misc_feature: Encodes the peptide sequence at SEQ ID NO 12432
atggacgccaagcttgccgccctcatcgccttgctcgcattgctcggtcctgtggcttgccatggcgccaccgtcatctgcctgggcggttgggttcgcccagtcccatcactcctcggcgggcttgtctgccccggaaacctgctcccaaacccttccctgaacccgatccctgcaccctcatcgtcagttctcaaggtcggctactacaacaacagcagcaacagcaacgcgtgccccaacgcggaagacatcgtgaggaaggtcgtggaggacgcggtgagcaaagaccccggcacgggcgcggggctcatccgcctcttcttccacgactgcttcgtccggggctgcgacgcctccgtcctcctcaggaacacgagcggcggctccaccagcgagcagacggagatgttcggcctccccaacgtgaacagcctccgcggcttcgaggtgatcgacgcggccaaggcggcgctggagtcggcgtgccctggcgtcgtctcgtgcgccgacaccctcgcgttcgccgcccgcgacgcgtccagcgtgctcagcggcggcaggatcagcagcgccttcgcgatgcccgccggccgcctcgacgggcgcgtgtcgctcgccaacgagaccacggacaacctgcccggcccgttctgtgacctcgacgcgctcaccaacttcttcgccgccaagggcctcgacagagacgacatggtcaccctctccggggcgcacaccatcggccaggcacgctgcgctttcgtgtccaaccggacggacatgaacgccaccctcgctaaggatctcaggagggacaagtgcaggagcggcggcaacacgaaggtggcgctggactacaagacccctgacaccatggacgtgcagtactaccagaacgtgaacgacgatgacgtggtgctggactcggacgctgcgctgagctcgccggcgacgaagccgctggtggatacctacgcggccggttcttcgttgagtctgtgggagaccaagttcgcggcagcgatggtgaagatgggcagcatcgaggtcaagaccagccccggtgcggacgccgagatcaggaagaagtgctccatttacaactaa

SEQ ID NO: 12432 - protein, 368 aa, Sorghum bicolor
  misc_feature: Ceres ANNOT ID no. 6087070
  misc_feature (86)..(328): Pfam Id: peroxidase Pfam Desc: Peroxidase
  misc_feature (59)..(368): NCBI GI: 55701005 NCBI Desc: tpa: class iii peroxidase 69 precursor [oryza sativa (japonica cultivar-group)]
  misc_feature (65)..(368): NCBI GI: 12056450 NCBI Desc: peroxidase [zea mays]
  misc_feature (59)..(368): NCBI GI: 115453175 NCBI Desc: os03g0368600 [oryza sativa (japonica cultivar-group)]
  misc_feature (65)..(368): NCBI GI: 115453171 NCBI Desc: os03g0368000 [oryza sativa (japonica cultivar-group)]
  misc_feature (116)..(368): NCBI GI: 115473627 NCBI Desc: os07g0638900 [oryza sativa (japonica cultivar-group)]
  misc_feature: Useful for making plants with altered carbohydrate content
  misc_feature: Functional homolog of the protein sequence given in SEQ ID NO 13714
  misc_feature: Useful for making plants with altered cell wall content and/or composition
  misc_feature: Functional homolog of the protein sequence given in SEQ ID NO 13715
  misc_feature: Useful for making plants with modulated oxidative stress sensitivity
  misc_feature: Functional homolog of the protein sequence given in SEQ ID NO 13607
MDAKLAALIALLALLGPVACHGATVICLGGWVRPVPSLLGGLVCPGNLLPNPSLNPIPAPSSSVLKVGYYNNSSNSNACPNAEDIVRKVVEDAVSKDPGTGAGLIRLFFHDCFVRGCDASVLLRNTSGGSTSEQTEMFGLPNVNSLRGFEVIDAAKAALESACPGVVSCADTLAFAARDASSVLSGGRISSAFAMPAGRLDGRVSLANETTDNLPGPFCDLDALTNFFAAKGLDRDDMVTLSGAHTIGQARCAFVSNRTDMNATLAKDLRRDKCRSGGNTKVALDYKTPDTMDVQYYQNVNDDDVVLDSDAALSSPATKPLVDTYAAGSSLSLWETKFAAAMVKMGSIEVKTSPGADAEIRKKCSIYN

SEQ ID NO: 12433 - DNA, 1107 bp, Sorghum bicolor
  misc_feature: Ceres ANNOT ID no. 6087079
  misc_feature: Encodes the peptide sequence at SEQ ID NO 12434
atggccgctaagctcgccgttctcggcaccttagtagtgctcgcgctgctcggtcctgtgtcgtcccaacaagccggctacgccccgccgccacctgctgcatatcctccgacgacaagcccgacgccgagcccgcctactacctatcctcctccgacacctgctagcccaccaccaccatcacctgcctctgggcctgcactgagtgtcggatactacaacgacaagtgccccggcgcggaagccctcgtgcgggaggccgtgcgcgccgccgacgccggcatcaaagcagggcttgtccgtttgttcttccacgactgcttcgtccagggctgcgacgcctccgttctgctcaagcccgacaacgacaccaacccgcagccggagatactcggcatccccaacctgagcctgcgcggcttggacgtcatcgacgcggcgaagaaggcgctggaggagaaatgcccgggcgtcgtttcctgcgccgacatcgtcgccttcgccggccgcgacgccagcttcttcctcagcggcggcgccatcaacttcaccatgcccgcgggccgctacgacgggaaggtgtcgaacgccagcgataccctccctaacctccccccgccgttcgccgacgtcgcgcagcttaaggccatgttcgccgccaaggggctcgacaccatcgacatggtcgcgctctccggcgcgcacagcatcggccgctcccactgctcgtccttcagcagggaccgcctcccgcccagcaacacctccgacatgaacccggcgttcgccacacagctcaaggcgaactgcacgtcgccgtccggcgccgacaacacggtggcgcaggactacaggacccctgaccagctggacaaccagtactactgggacgtgatcaaccacaaggtgctcttcgcgtcggacgccgcactcctcaagtcaggcgacaccgcagcgctggtgtatgcagccgccttgtttcagaaggaatggcaggacaggtttggaaaagccatggtgaagatgggtggagtcgaggtgaagacggccgccaatggtgagatcagacagatgtgtggctacgtcaacaagccctactccggttga

SEQ ID NO: 12434 - protein, 368 aa, Sorghum bicolor
  misc_feature: Ceres ANNOT ID no. 6087079
  misc_feature (84)..(325): Pfam Id: peroxidase Pfam Desc: Peroxidase
  misc_feature (63)..(363): NCBI GI: 115453175 NCBI Desc: os03g0368600 [oryza sativa (japonica cultivar-group)]
  misc_feature (68)..(363): NCBI GI: 115453171 NCBI Desc: os03g0368000 [oryza sativa (japonica cultivar-group)]
  misc_feature (63)..(363): NCBI GI: 55701005 NCBI Desc: tpa: class iii peroxidase 69 precursor [oryza sativa (japonica cultivar-group)]
  misc_feature (68)..(363): NCBI GI: 12056450 NCBI Desc: peroxidase [zea mays]
  misc_feature (111)..(363): NCBI GI: 115473627 NCBI Desc: os07g0638900 [oryza sativa (japonica cultivar-group)]
  misc_feature: Useful for making plants with altered carbohydrate content
  misc_feature: Functional homolog of the protein sequence given in SEQ ID NO 13713
MAAKLAVLGTLVVLALLGPVSSQQAGYAPPPPAAYPPTTSPTPSPPTTYPPPTPASPPPPSPASGPALSVGYYNDKCPGAEALVREAVRAADAGIKAGLVRLFFHDCFVQGCDASVLLKPDNDTNPQPEILGIPNLSLRGLDVIDAAKKALEEKCPGVVSCADIVAFAGRDASFFLSGGAINFTMPAGRYDGKVSNASDTLPNLPPPFADVAQLKAMFAAKGLDTIDMVALSGAHSIGRSHCSSFSRDRLPPSNTSDMNPAFATQLKANCTSPSGADNTVAQDYRTPDQLDNQYYWDVINHKVLFASDAALLKSGDTAALVYAAALFQKEWQDRFGKAMVKMGGVEVKTAANGEIRQMCGYVNKPYSG

SEQ ID NO: 12435 - DNA, 1182 bp, Sorghum bicolor
  misc_feature: Ceres ANNOT ID no. 6087116
  misc_feature: Encodes the peptide sequence at SEQ ID NO 12436
atgggccgaggccgcaaccgcaagccccgcaacttcgccacgttccgcctctgcccgcgccccggggtcgccgacgcctccgaccgcgtcttcgtccgcgtcgacgacaacccctactccgtccccgggttcgccgacgacgagggccactcgtcctccaccgccgtcggtgcagacggcggcgagcccgccgcctcctcctccgcctcggtcgacgacgacggagcgcccctgcccgagcacgtccgccgcgagatcttggagctcggcctccccgacgacggctacgactacctcacccacctccgcgagctccgcccctccctctcctccaccggcggcgggggatcctcggccgtgttcctccccagccgccgccccgcgcgctccggcccctgcgtggacgtcaaggcgtacgacttcactcgtactccccttggctccgggaaggttgcagtggtgacggctagtcgggctgaggaggctattgacctggatgtcgctaggctgcttgacgggagagattcgccggccgttgagtcgggggatgaggatttggaggaggattttgttatccttgctaacgagccagatgaggagctgatcgaggaagagagtgctgctgggggcaaggagaaagctctgcagctgcctcgcaagcagtttgattcgcttgcttttgaagaatatgcagacagtggagatgattgtcatgttcaagatgcaaagcatgaactttcccaggatgttacaaacaaactgaaatcgcctcacagtgaaaattttgatgctgataaaaattgctgggcagcagcagcacaatatgttgctcacgggatactagagtcagaagagcaaattgatacgtcttctaatgccatgcccgaatgtgttggatatgctggaacatatgaagtcagtgaagaagaacaagtgattcttgctccagaaagtagcgagggatctgcagtcatgtactctactaccacggtttctggatcatatctcgatgttaaaatgcaatttccaaaactttcccctggagaaacaagtatgaaaaaatccatcatcagaaaaggaatagagaagcttcctacagcgtatttacctcagaggaacactttgagtggtcaaaaactgggaccctacaaggaaccaaaagaggaagggacagaaagctag

SEQ ID NO: 12436 - protein, 393 aa, Sorghum bicolor
  misc_feature: Ceres ANNOT ID no. 6087116
MGRGRNRKPRNFATFRLCPRPGVADASDRVFVRVDDNPYSVPGFADDEGHSSSTAVGADGGEPAASSSASVDDDGAPLPEHVRREILELGLPDDGYDYLTHLRELRPSLSSTGGGGSSAVFLPSRRPARSGPCVDVKAYDFTRTPLGSGKVAVVTASRAEEAIDLDVARLLDGRDSPAVESGDEDLEEDFVILANEPDEELIEEESAAGGKEKALQLPRKQFDSLAFEEYADSGDDCHVQDAKHELSQDVTNKLKSPHSENFDADKNCWAAAAQYVAHGILESEEQIDTSSNAMPECVGYAGTYEVSEEEQVILAPESSEGSAVMYSTTTVSGSYLDVKMQFPKLSPGETSMKKSIIRKGIEKLPTAYLPQRNTLSGQKLGPYKEPKEEGTES

SEQ ID NO: 12437 - DNA, 753 bp, Sorghum bicolor
  misc_feature: Ceres ANNOT ID no. 6087230
  misc_feature: Encodes the peptide sequence at SEQ ID NO 12438
atgtctcgcttcggtcgatccggtccgccgccgatccgcgacacgtactcactcctcgtcctcaacatcaccttccgcacgactgctgatgacctcttcccactcttcgacaagtacggcgagattgtcgacatctacatcccaagggaccgcagaactggtgactcgcgcggattcgcgttcgtgaggtacaagtacgaggacgaggcacagaaggcagttgataggctcgatgggagattggtagatgggagggagatcatggtgcagtttgccaagtacggcccaaatgctgagcggattaataaagggagaatagtggagccagttccaaggccaaggggccgttctagaagccgcagtccaagacggaggtaccgtgatgattatcgagatgactaccaggatagagattatagaaggcgaagccgtagccggagtagagatagatatgcccgtgacaggtacagagatagggattaccgccgtcgtagcccgagtcgcagctacagtcctgaagattacaagaagcgtgggagagacagtttgtctcctgcacgaagaagccctagtcgtagccgcagtcgcagctacagtcctgatgattacaagaggcgtggcagagacagcgcatcacctgcaagtaggagccctagtcgctcccctcctcgcaagatgtcaccttctcctgagagatctcctgccaagcacaatgatgaccggtctccacgttctcggagcccttcgacataa

SEQ ID NO: 12438 - protein, 250 aa, Sorghum bicolor
  misc_feature: Ceres ANNOT ID no. 6087230
  misc_feature (18)..(89): Pfam Id: RRM_1 Pfam Desc: RNA recognition motif. (a.k.a. RRM, RBD, or RNP domain)
  misc_feature (1)..(249): NCBI GI: 92896886 NCBI Desc: rna-binding region rnp-1 (rna recognition motif) [medicago truncatula]
  misc_feature (1)..(248): NCBI GI: 9843653 NCBI Desc: splicing factor sc35 [arabidopsis thaliana]
  misc_feature (4)..(222): NCBI GI: 47604918 NCBI Desc: arginine/serine-rich2 splicing factor [gallus gallus]
  misc_feature (4)..(231): NCBI GI: 56342346 NCBI Desc: arginine/serine-rich 2 splicing factor [pan troglodytes]
  misc_feature (4)..(222): NCBI GI: 30583339 NCBI Desc: splicing factor, arginine/serine-rich 2 [homo sapiens]
  misc_feature: Useful for making plants with altered Lignin content
  misc_feature: Useful for making plants with altered alkaloid content
  misc_feature: GREAT-hit functional homolog of the protein sequence given in SEQ ID NO 12946
  misc_feature: GREAT-hit functional homolog of the protein sequence given in SEQ ID NO 12947
  misc_feature: The sequence is a functional homolog of SEQ ID NO. 339 in the 11/188,298 US application
MSRFGRSGPPPIRDTYSLLVLNITFRTTADDLFPLFDKYGEIVDIYIPRDRRTGDSRGFAFVRYKYEDEAQKAVDRLDGRLVDGREIMVQFAKYGPNAERINKGRIVEPVPRPRGRSRSRSPRRRYRDDYRDDYQDRDYRRRSRSRSRDRYARDRYRDRDYRRRSPSRSYSPEDYKKRGRDSLSPARRSPSRSRSRSYSPDDYKRRGRDSASPASRSPSRSPPRKMSPSPERSPAKHNDDRSPRSRSPST

SEQ ID NO: 12439 - DNA, 999 bp, Sorghum bicolor
  misc_feature: Ceres ANNOT ID no. 6087239
  misc_feature: Encodes the peptide sequence at SEQ ID NO 12440
atgcctccccctccgccggcggccgcccgcagcagggggcggtgcagcgcgctcagcttcgcggcggcgcgggaccgctgcttcagccaccggttccgcagggcggggctgcgcccgctcgccgtgccgctcccagcgccaggcccggaccccgacccagacccggccaccacggtccacatgtgggtgcccgcgggcccgccgccgcggaacccgctgcttctcctgcacggcttcggcgcctccgccacgtggcagtgggcgccctacctccgcgcgctgatcgccgccgggttcgaccccatcgtgcccgacctcgtcttcttcggcaactcctgcacgcgcctccccgaccgctccgacgccttccaggcctccgccatcaaggccgccatggacgccatcggggtccccaggttcggcctcgtcggcgtcagctacggcggcttcgtcggccaccggatggccgccatgttcccggaggccgtcgaccgggtcgccttggtctgcgcgggggtctgcctcgaggagaaggacctggccgagggactcttccccgtggctggggtcggggaggccgccgacctgctcgtgccgcgccgaccggaggaggtgcgccgcctcgtccgcctcaccttcgtgcgcccgccgctcatcatgccctcctgcttcctctgggactacatcagggtgatgggctctgatcatatccaggagaagactgagctgctatatgctttgattaatgggagacaactctgtactcttccaaaattgacccagccgacgcttataatctggggggagcaagatcgggtgttcccaatggagctggctcacagattgaacaggcatctagaggggaattctcgattagttgtcataaaaaatgctgggcatgcagtcaatattgagaagcccaaggaagtgtgccggaacatcatagagtttttcaaggagccggttgctggagctgcaaacgtggacgacaaggtctga

SEQ ID NO: 12440 - protein, 332 aa, Sorghum bicolor
  misc_feature: Ceres ANNOT ID no. 6087239
  misc_feature (99)..(316): Pfam Id: Abhydrolase_1 Pfam Desc: alpha/beta hydrolase fold
  misc_feature (2)..(332): NCBI GI: 33146617 NCBI Desc: hydrolase-like protein [oryza sativa (japonica cultivar-group)]
  misc_feature (2)..(332): NCBI GI: 115453331 NCBI Desc: os03g0388800 [oryza sativa (japonica cultivar-group)]
  misc_feature (16)..(317): NCBI GI: 18420566 NCBI Desc: hydrolase, alpha/beta fold family protein [arabidopsis thaliana]
  misc_feature (14)..(317): NCBI GI: 67633792 NCBI Desc: hydrolase [arabidopsis thaliana]
  misc_feature (177)..(321): NCBI GI: 115481756 NCBI Desc: os10g0375700 [oryza sativa (japonica cultivar-group)]
  misc_feature: Useful for making plants with altered Lignin content
  misc_feature: Functional homolog of the protein sequence given in SEQ ID NO 13198
MPPPPPAAARSRGRCSALSFAAARDRCFSHRFRRAGLRPLAVPLPAPGPDPDPDPATTVHMWVPAGPPPRNPLLLLHGFGASATWQWAPYLRALIAAGFDPIVPDLVFFGNSCTRLPDRSDAFQASAIKAAMDAIGVPRFGLVGVSYGGFVGHRMAAMFPEAVDRVALVCAGVCLEEKDLAEGLFPVAGVGEAADLLVPRRPEEVRRLVRLTFVRPPLIMPSCFLWDYIRVMGSDHIQEKTELLYALINGRQLCTLPKLTQPTLIIWGEQDRVFPMELAHRLNRHLEGNSRLVVIKNAGHAVNIEKPKEVCRNIIEFFKEPVAGAANVDDKV

SEQ ID NO: 12441 - DNA, 729 bp, Sorghum bicolor
  misc_feature: Ceres ANNOT ID no. 6087256
  misc_feature: Encodes the peptide sequence at SEQ ID NO 12442
atggatcccaagccctctgccgacgcgcccgccgcggcggccgaggagcacgtggcgtacccgcggatgtctccggaggacatcgccccgccgccgccgcctgtcgtgccgccggccggcgccaacccctacgtgctctccgccccgtcgtccaacccgccctccaagggcgctagggagaatctgagggacatgttcggcatggtggggaagaagttcaacgaggccgcgcgcaagaccgagggcatcgccggcgacgtctggcagcatctgaaaactggacccagcattgctgatactgccatggggaggattgctcagatatccaaggttatatccgagggtggctacgacaagatatttcagcagacctttgagtgctcgcctgatgagaagctcaagaaggcatacgtgtgctacctatcaacgtcgcatggaccgatcatgggtgtcctatatctctcgactgtgaagattgcatttggtagcgacagccctgtcaaatatgtgactgaggacaacaaaactcagtcatccttttataaggttgttttaccacttcctcacctgagatcagttattcccacagcaagtcagcaaaaccctgcagagaggtacattcaggtcgtttcagttgacaaccacgagttctggttcatgggtttcgtgaactatgatagcgctgtaaagaatcttcaggaggctgttcgtggtgttcacggggcctag

SEQ ID NO: 12442 - protein, 242 aa, Sorghum bicolor
  misc_feature: Ceres ANNOT ID no. 6087256
  misc_feature (119)..(197): Pfam Id: GRAM Pfam Desc: GRAM domain
  misc_feature (43)..(242): NCBI GI: 38454154 NCBI Desc: at5g13200 [arabidopsis thaliana]
  misc_feature (39)..(190): NCBI GI: 42570873 NCBI Desc: gram domain-containing protein / aba-responsive protein-related [arabidopsis thaliana]
  misc_feature (42)..(242): NCBI GI: 140038631 NCBI Desc: gram [medicago truncatula]
  misc_feature (43)..(216): NCBI GI: 4103635 NCBI Desc: aba-responsive protein [hordeum vulgare]
  misc_feature (102)..(225): NCBI GI: 9581889 NCBI Desc: tel1s.3 [arabidopsis thaliana]
  misc_feature: The sequence is a functional homolog of SEQ ID NO. 430 in the 11/188,298 US application
MDPKPSADAPAAAAEEHVAYPRMSPEDIAPPPPPVVPPAGANPYVLSAPSSNPPSKGARENLRDMFGMVGKKFNEAARKTEGIAGDVWQHLKTGPSIADTAMGRIAQISKVISEGGYDKIFQQTFECSPDEKLKKAYVCYLSTSHGPIMGVLYLSTVKIAFGSDSPVKYVTEDNKTQSSFYKVVLPLPHLRSVIPTASQQNPAERYIQVVSVDNHEFWFMGFVNYDSAVKNLQEAVRGVHGA

SEQ ID NO: 12443 - DNA, 519 bp, Sorghum bicolor
  misc_feature: Ceres ANNOT ID no. 6087280
  misc_feature: Encodes the peptide sequence at SEQ ID NO 12444
atgagtttcaaccagtctactgtcaaggggcagaccaggagggagaggcctagggctcgccctcatggcctgacgcagcagaagaggcaggaaataaaggaagcctttgatctgtttgatacagataactctggaaccattgatgcaaaagagctcaatgttgccatgagagccttgggatttgagatgactgaagagcaaattaggcaaatgattgctgatgttgacaaagatggcagtggagcaatcgactatgaggagtttgagcacatgatgactgccaaaatcggagaaagggatagtaaagaggagcttacaaaagcattccgcattattgaccaagatggaaatggaaagatttctaacattgatatccagaggattgccaaagagttgggtgtaaatctcaccctcgatgagatccaagacatggtgcaagaggcagatagaaatggtgacggtgagatagactttgatgagttcatcaggatgatgaggaggactagctatggctactag

SEQ ID NO: 12444 - protein, 172 aa, Sorghum bicolor
  misc_feature: Ceres ANNOT ID no. 6087280
  misc_feature (31)..(59): Pfam Id: efhand Pfam Desc: EF hand
  misc_feature (67)..(95): Pfam Id: efhand Pfam Desc: EF hand
  misc_feature (104)..(132): Pfam Id: efhand Pfam Desc: EF hand
  misc_feature (140)..(168): Pfam Id: efhand Pfam Desc: EF hand
  misc_feature (13)..(172): NCBI GI: 729051 NCBI Desc: caltractin (centrin)
  misc_feature (12)..(171): NCBI GI: 6523047 NCBI Desc: centrin [arabidopsis thaliana]
  misc_feature (6)..(172): NCBI GI: 6358509 NCBI Desc: centrin [nicotiana tabacum]
  misc_feature (6)..(172): NCBI GI: 6358511 NCBI Desc: centrin [nicotiana tabacum]
  misc_feature (13)..(171): NCBI GI: 13129449 NCBI Desc: centrin [oryza sativa]
MSFNQSTVKGQTRRERPRARPHGLTQQKRQEIKEAFDLFDTDNSGTIDAKELNVAMRALGFEMTEEQIRQMIADVDKDGSGAIDYEEFEHMMTAKIGERDSKEELTKAFRIIDQDGNGKISNIDIQRIAKELGVNLTLDEIQDMVQEADRNGDGEIDFDEFIRMMRRTSYGY

SEQ ID NO: 12445 - DNA, 951 bp, Sorghum bicolor
  misc_feature: Ceres ANNOT ID no. 6087404
  misc_feature: Encodes the peptide sequence at SEQ ID NO 12446
atggctttcgtcagtagaattggaaatgcgctgaggagaacttcagtgtccaatagcgctccactgcttcagccagtaagatgcatgtcttcttcgaagctttttgttggaggactttcatatgccacagatgaaacaactctgaagaatgtcttttctgcgtatgggaatgtacttgaagctcggatcatcactgatcgggaatcagggaggtcaaagggttttggatttataacttatacatccactgaagaagcctcagctgcagtgacttccatggatggcaaggagcttcaaggacgaagtataagggtggaccatgccaatgaccgtgctggtggaatacgcggaggtggtggattcggctctggtggtggttatggtggtggaggtggatatcctagtggtgggtatggcggtggcggtggtagtggatatagttctgggggtggtggtggatatagttctgggggctatgctggcaatggtggttatagtgttggatctggcagtggcaatggtggcaactacaacaatgcttcaggtggtgggtatgccggcaatgatggttacaacgatgcggctgccagtggtggttatgctaacaacatgagcagtggaaggtataataccactggcagttctgatggaaacactgctgggtacaattcttctcccaacacatatggtgcaagcaactatggtgcagccaactacaatacaggaagttccagtggtggaacctcaggagaatttggtggcggctttagtggtggacattttggtggcaacaactttggaaatgtgaccggtggtggctacagtggcagcagcaacacgggagggttttatggtggcggggcaagctatggagctaacaagccgcagtacaatgaccatgacgacctgatgggcgatttcttcgacaaggaagtggcagagagtaaataa

SEQ ID NO: 12446 - protein, 316 aa, Sorghum bicolor
  misc_feature: Ceres ANNOT ID no. 6087404
  misc_feature (34)..(105): Pfam Id: RRM_1 Pfam Desc: RNA recognition motif. (a.k.a. RRM, RBD, or RNP domain)
  misc_feature (1)..(255): NCBI GI: 115473215 NCBI Desc: os07g0602600 [oryza sativa (japonica cultivar-group)]
  misc_feature (1)..(296): NCBI GI: 15822705 NCBI Desc: rna-binding protein precursor [solanum tuberosum]
  misc_feature (1)..(210): NCBI GI: 624925 NCBI Desc: rna-binding glycine rich protein (rgp-2) [nicotiana sylvestris]
  misc_feature (1)..(261): NCBI GI: 15822703 NCBI Desc: rna-binding protein precursor [nicotiana tabacum]
  misc_feature (24)..(289): NCBI GI: 49402291 NCBI Desc: heterogeneous nuclear ribonucleoprotein a1 [danio rerio]
  misc_feature: The sequence is a functional homolog of SEQ ID NO 1042 in the 10/374,780US patent application
  misc_feature: The sequence is a functional homolog of SEQ ID NO 852 in the 10/666,642US patent application
  misc_feature: Useful for making plants with modulated growth and phenotype characteristics
  misc_feature: The sequence is a functional homolog of SEQ ID NO 1042 in the 20060162006 US patent application
  misc_feature: The sequence is a functional homolog of SEQ ID NO. 339 in the 11/188,298 US application
  misc_feature: The sequence is a functional homolog of SEQ ID NO. 458 in the 11/188,298 US application
MAFVSRIGNALRRTSVSNSAPLLQPVRCMSSSKLFVGGLSYATDETTLKNVFSAYGNVLEARIITDRESGRSKGFGFITYTSTEEASAAVTSMDGKELQGRSIRVDHANDRAGGIRGGGGFGSGGGYGGGGGYPSGGYGGGGGSGYSSGGGGGYSSGGYAGNGGYSVGSGSGNGGNYNNASGGGYAGNDGYNDAAASGGYANNMSSGRYNTTGSSDGNTAGYNSSPNTYGASNYGAANYNTGSSSGGTSGEFGGGFSGGHFGGNNFGNVTGGGYSGSSNTGGFYGGGASYGANKPQYNDHDDLMGDFFDKEVAESK

SEQ ID NO: 12447 - DNA, 1086 bp, Sorghum bicolor
  misc_feature: Ceres ANNOT ID no. 6087410
  misc_feature: Encodes the peptide sequence at SEQ ID NO 12448
atgccgccgctcctcacctcctcctccctaccggcgctgccgctaccgccgctggccgcgtcgcccaggtcccgcctcagggtcgcggcctccacgccggacggggccggcgccactgccagaggcaccagcgcggccgggttcccgtccttccttccccaggcggtggagcgcatccgcgacggcgccgccatccgcctcgccaagcgaatcgagcgcgtccccgtccagaccggtttctcggagagcgcgataccgagcagctgcgtgaggccgctcaagctgcaacaagacggtgatccggtcgtgctgctgcatggcttcgacagttctgttctagagtggagatacacctacccgttgctcgaggaggccggattggaggcttgggctgtggacatccttggttggggcttctctgatttagaagcacggcctccatgtgatgttgcatccaaacgcgagcatctttaccagttctggaaatcctacatcaaaaggcctatggtgttagttgggccaagccttggtgctgctgttgccattgatttttcagtcaactacccggatgcggtctcaaaattgatcttcattggtgcaagtgtatactctgagggcccaaaagatatgactaggatgcctaaatttgtttcatatgctggggtgttcatattgaagagtcttccactgcgatttttagcaacaaatttggcatttaaaaaagctccaaatgaattctttgattgggtgcaaattggccgtctgcattgcctactcccctggtgggaggatgctacagtagattttatgataagagggggttataatgtcataaaccaaataaaacaggtgaagcataaatgcctgatcatgtggggagaggatgatggaataataagcagcaaactagcatataggttgcatcaggaactcccagatgcaattctgaggcaggtccagcagtgtggtcatattcctcacgtcgaaaagccaagggaggcagtaaaacatgtgattgaattccttgcaagaaacacgtcaaacaagtcggatcagtcttcttccgaaccatcagtacttgtgtaa

SEQ ID NO: 12448 - protein, 361 aa, Sorghum bicolor
  misc_feature: Ceres ANNOT ID no. 6087410
  misc_feature (127)..(340): Pfam Id: Abhydrolase_1 Pfam Desc: alpha/beta hydrolase fold
  misc_feature (43)..(346): NCBI GI: 92891729 NCBI Desc: at1g13820 [medicago truncatula]
  misc_feature (44)..(355): NCBI GI: 8778385 NCBI Desc: f16a14.4 [arabidopsis thaliana]
  misc_feature (48)..(341): NCBI GI: 75910904 NCBI Desc: alpha/beta hydrolase fold [anabaena variabilis atcc 29413]
  misc_feature (48)..(341): NCBI GI: 17227812 NCBI Desc: 2-hydroxy-6-oxohepta-2,4-dienoate hydrolase [nostoc sp. pcc 7120]
  misc_feature (48)..(345): NCBI GI: 119484283 NCBI Desc: 2-hydroxy-6-oxohepta-2,4-dienoate hydrolase [lyngbya sp. pcc 8106]
MPPLLTSSSLPALPLPPLAASPRSRLRVAASTPDGAGATARGTSAAGFPSFLPQAVERIRDGAAIRLAKRIERVPVQTGFSESAIPSSCVRPLKLQQDGDPVVLLHGFDSSVLEWRYTYPLLEEAGLEAWAVDILGWGFSDLEARPPCDVASKREHLYQFWKSYIKRPMVLVGPSLGAAVAIDFSVNYPDAVSKLIFIGASVYSEGPKDMTRMPKFVSYAGVFILKSLPLRFLATNLAFKKAPNEFFDWVQIGRLHCLLPWWEDATVDFMIRGGYNVINQIKQVKHKCLIMWGEDDGIISSKLAYRLHQELPDAILRQVQQCGHIPHVEKPREAVKHVIEFLARNTSNKSDQSSSEPSVLV

SEQ ID NO: 12449 - DNA, 423 bp, Sorghum bicolor
  misc_feature: Ceres ANNOT ID no. 6087457
  misc_feature: Encodes the peptide sequence at SEQ ID NO 12450
atggtctccttcgagatgaacgaccgcaagaagattgggctgggcttgactggatttggagttctcttctcactgcttgggatcattatgctgtttgacaagggattcctggcaatggggaatattctcttcgtttcaggcgtcttactgaccattgggctgaagccaactgtgcaattcttcaccaagcctaagaatcacaagggttcactttctttcgggtttggctttttcctggtcctcattggatggcctatcttaggcatgatggtggagtcgtatggcttcatcacgctcttcagtggcttctggccaacagctgctgtttacctgcaaaagagcccctccttcggttggatattccaccaccctcttgtgacttcgctgatcactcggttcagaggaagacgggtcccggtgtga

SEQ ID NO: 12450 - protein, 140 aa, Sorghum bicolor
  misc_feature: Ceres ANNOT ID no. 6087457
  misc_feature (30)..(130): Pfam Id: Got1 Pfam Desc: Got1-like family
  misc_feature (11)..(129): NCBI GI: 33146513 NCBI Desc: nfkb activating protein-like [oryza sativa (japonica cultivar-group)]
  misc_feature (1)..(140): NCBI GI: 38603916 NCBI Desc: at3g03180 [arabidopsis thaliana]
  misc_feature (5)..(135): NCBI GI: 61677905 NCBI Desc: cg32576-pb, isoform b [drosophila melanogaster]
  misc_feature (4)..(135): NCBI GI: 48110113 NCBI Desc: similar to ensangp00000015000 [apis mellifera]
  misc_feature (2)..(137): NCBI GI: 47497305 NCBI Desc: nfkb activating protein-like [oryza sativa (japonica cultivar-group)]
MVSFEMNDRKKIGLGLTGFGVLFSLLGIIMLFDKGFLAMGNILFVSGVLLTIGLKPTVQFFTKPKNHKGSLSFGFGFFLVLIGWPILGMMVESYGFITLFSGFWPTAAVYLQKSPSFGWIFHHPLVTSLITRFRGRRVPV

SEQ ID NO: 12451 - DNA, 549 bp, Sorghum bicolor
  misc_feature: Ceres ANNOT ID no. 6087934
  misc_feature: Encodes the peptide sequence at SEQ ID NO 12452
atgggagtatatgatgctatgaaattttgcaaagctgatgtctcaactgtttgctttggattggcggcttcaatgggtgcatttttacttgctgctgggacaaagggtaagaggtactgcatgccaaatgcaaggattatgatccatcagccatcaggtggtgctggcgggaaagtcacggagatgggactacagataagagagatgatgtacgagaagattaagatcaataaaataatgtcgagaattactggaaaatctaaagagcagattgatgaagacacaaagtttgattatttcatgagtccttgggaagccaaggattatgggatagttgacagtatcatagatgaggggaaaccagggttggtagctcccttggcaggatctgttcggcctccaaaatcgcgtgtgtggtacttgtggaaggcttcgggcccgaccaggaagatcatgaaacatctaccttcagaggagaaactaattaacaatggtaacggaacagcaactggagatgatgagaagctcaagagggcatcggcaacctga

SEQ ID NO: 12452 - protein, 182 aa, Sorghum bicolor
  misc_feature: Ceres ANNOT ID no. 6087934
  misc_feature (1)..(119): Pfam Id: CLP_protease Pfam Desc: Clp protease
  misc_feature (1)..(180): NCBI GI: 115436866 NCBI Desc: os01g0507900 [oryza sativa (japonica cultivar-group)]
  misc_feature (1)..(180): NCBI GI: 21449427 NCBI Desc: atp-dependent clp protease [oryza sativa (indica cultivar-group)]
  misc_feature (1)..(168): NCBI GI: 6069464 NCBI Desc: s-locus protein 2 [brassica rapa]
  misc_feature (1)..(168): NCBI GI: 17028170 NCBI Desc: clpp [brassica oleracea]
  misc_feature (1)..(165): NCBI GI: 21592949 NCBI Desc: atp-dependent clp protease proteolytic subunit clpp3 [arabidopsis thaliana]
  misc_feature (1)..(122): SWISSPROT Homolog: EC 3.4.21.92 ATP-dependent Clp protease proteolytic subunit 1
  misc_feature: The plant is abnormally small.
  misc_feature: Useful for making plants with modulated biomass
  misc_feature: GREAT-hit functional homolog of the protein sequence given in SEQ ID NO 13114
  misc_feature: Useful for making plants with modulated biomass
  misc_feature: Functional homolog of the protein sequence given in SEQ ID NO 13114
MGVYDAMKFCKADVSTVCFGLAASMGAFLLAAGTKGKRYCMPNARIMIHQPSGGAGGKVTEMGLQIREMMYEKIKINKIMSRITGKSKEQIDEDTKFDYFMSPWEAKDYGIVDSIIDEGKPGLVAPLAGSVRPPKSRVWYLWKASGPTRKIMKHLPSEEKLINNGNGTATGDDEKLKRASAT

SEQ ID NO: 12453 - DNA, 1095 bp, Sorghum bicolor
  misc_feature: Ceres ANNOT ID no. 6089797
  misc_feature: Encodes the peptide sequence at SEQ ID NO 12454
atgtcggccccgcaaccgcaatctgccgcgcttgtcgttaatgagccccgctccgcctcggcgatcgtcggagacgtcgagggctactcgcgcaccaaggatgagctccccaccggcaaatcaatccggtctcgcccgttcagtgtggggggtcgccagtggagcatccgctattaccccaatggcacagattctgagtgcgctgacttcgtatccttcgtcctctttctcgccaagagtgccggcgggcccatgaaggcgcgtgtcaggttccatttgctcgatcgggcagggaacccgctgccgtcgaaatcccgaaccacaggtccatgcgagttctctcctggtggttcaggctatggcttcagtatcattaaaagggagttcttggagaagtcggagcagctcttgatgaacgactccttcaagatcagctgcgacatcattattcccatggaactccgcacggaggacaggattgtctcgctcctagacgcagtaccaccacctgacctgaatcagcatcttagcgatctccttatgtccaaagagggcgccgacgttactttccaagttgccggcgaggcatttagcgcgcacaggtttctgcttgcggcgcggtcgcgagtctttaaagcacagctgtgtggcgccatgaaggagagcacggccacaggggactgcatccggattgacgacatgttacctcaggtgttcaaggccttgctccagttcatctacactgactcgctgccacagatggaggaacaacaggaggccgtgatggcccagcatctgctggaagcagcggacaggtatgacatgcagaggctcaagctgatttgtgaggagaagctgtacaggcacatagacgtcagcacggctgcaaccacgttggtgttggctgaacagcactgctgccgtggtctcaagaaggcttgcatcgagtttctgaaatctcctgatgcactggaagcagtcatggaaactgatggctttgagcatctgactaaaagctgccctgctcttgtgaaggagttgatgtcagagctttacgtgttcaagcaatgcaagaggaggaaattgaaggcatga

SEQ ID NO: 12454 - protein, 364 aa, Sorghum bicolor
  misc_feature: Ceres ANNOT ID no. 6089797
  misc_feature (176)..(290): Pfam Id: BTB Pfam Desc: BTB/POZ domain
  misc_feature (125)..(348): NCBI GI: 115482086 NCBI Desc: os10g0423600 [oryza sativa (japonica cultivar-group)]
  misc_feature (4)..(348): NCBI GI: 115482084 NCBI Desc: os10g0423300 [oryza sativa (japonica cultivar-group)]
  misc_feature (1)..(258): NCBI GI: 115482088 NCBI Desc: os10g0423800 [oryza sativa (japonica cultivar-group)]
  misc_feature (17)..(351): NCBI GI: 115482128 NCBI Desc: os10g0429400 [oryza sativa (japonica cultivar-group)]
  misc_feature (3)..(351): NCBI GI: 108864601 NCBI Desc: btb/poz domain containing protein [oryza sativa (japonica cultivar-group)]
MSAPQPQSAALVVNEPRSASAIVGDVEGYSRTKDELPTGKSIRSRPFSVGGRQWSIRYYPNGTDSECADFVSFVLFLAKSAGGPMKARVRFHLLDRAGNPLPSKSRTTGPCEFSPGGSGYGFSIIKREFLEKSEQLLMNDSFKISCDIIIPMELRTEDRIVSLLDAVPPPDLNQHLSDLLMSKEGADVTFQVAGEAFSAHRFLLAARSRVFKAQLCGAMKESTATGDCIRIDDMLPQVFKALLQFIYTDSLPQMEEQQEAVMAQHLLEAADRYDMQRLKLICEEKLYRHIDVSTAATTLVLAEQHCCRGLKKACIEFLKSPDALEAVMETDGFEHLTKSCPALVKELMSELYVFKQCKRRKLKA

SEQ ID NO: 12455 - DNA, 2073 bp, Sorghum bicolor
  misc_feature: Ceres ANNOT ID no. 6090013
  misc_feature: Encodes the peptide sequence at SEQ ID NO 12456
atggcggtgatcaccgggcggccgccgaagcgcgtgcgggtgacggcggggccgcgcgcgctggacctgcggccgttcccggccgccggcgagccggtgccgccgccaccacgcggggcgttccgcgactgcgtgcgcgcgttcctggcgcggtccgcggagcccgccgacggcgcgtggcgggtggccttccgcgtcggggaagggggcggggacggggcggtcgtggggatggaggtggtcgaggaggacgtggctagggccggggccgggcggatctactgcgagcactgcaccgttgccggctggagcagacaccctgtttgtgggaggaggtaccatttcataattcggaatgaatatgacgtgcaagactacaaaacctgcaagcattgtgggtttatggcccagttgtttgaaacacggtgcccgtcatgcaaaaatgggatctcctatgatgatccggaagattgggactataggcagctggataatccacgtcacttgctgcatggcattgtacatgataatgggtttggtcaccttgtccggataaatggcagagagggtggctctagtcttctgacggggattcaactgatgggtttctgggatcggctctgcaaatatcttagagtcagaaaggtctcgctgatggatgtctctaagaagtatggaactgattaccggatcttacatgccatcaccactggttattcttggtatggccaatggggattcaaactcaacaaagggagctttggaatcacatcaaaagaatacttaaaagctgtagacaacctttcctcaactccattatcacacttcttcccccactcccgatatcctcgaaaccagctacaagataccatttcattctaccaatctctttcaaagcaccctctcaccacaattcgtgaactgttcctctatgtgctgggccttgccactagcaagggtataaatatgcactatggatcaatgcataaggagcattcacatacccatatgcaagagacatggtctgatgaggaaataaaacgtgcaacagaaattgctataaaagttcttcgcgctgttgaaaaaacaaggtgggtggccatgcgaaccctaaaggcagccatgtgccatccaattggttcaccgcagctagttgactactgcctcaagacccttggtaccagaacaattgatggaatgatggttgccgtcagatgcaacagtgagacaaacaccctcgagtacaggcttacagatgaacccatcatcctgccgaatgtatccatgccaactcaagaccatcttcaccgtgacataaagttcttgcatgatgctctactctacccacatacaatgcatccatacaaaccggaaaactgttatgagcaagccaagaggtctgccatgatacttttggactgcaaacaattcacgaagcattatgacctggaacaggagttcttgcctcaaaacccatccatgttgcacatgtggtgccaagtagagctgttagaccaggttggtgatccaccttgcatcccaccagagctcctaactcttccacagacagcaactgtggctgatctaaaggtggaggtgaccagaacgttccatgacatctatctgatgttacagtcttttgtagccaatcagcttcttgactgtggaactgcaagtgagtcaactcagctcaaactcttgtttggagcaaatggaactgttcgcgtccaaggcagatgtgctggtggtgaacgcagggttggaatttaccggatggagagaggtgtggataaatggacggtcaattgctcttgtggagctaaggatgatgatggtgagaggatgctgtcttgtgactcttgccatgtgtggcagcacactaggtgtgctgggattagtgattttgatcaggtgccaaagagatatgtatgtaactcttgtaaattactccacaagcataagagcagtgggcccaggccagtttataatagtggcccaagcaaaagatgcaagattggcacaggagcctttagccatgtaggtgggggatttttgaggcctcacattggttga

SEQ ID NO: 12456 - protein, 690 aa, Sorghum bicolor
  misc_feature: Ceres ANNOT ID no. 6090013
  misc_feature (602)..(650): Pfam Id: PHD Pfam Desc: PHD-finger
  misc_feature (168)..(481): NCBI GI: 115479451 NCBI Desc: os09g0449000 [oryza sativa (japonica cultivar-group)]
  misc_feature (140)..(426): NCBI GI: 15554515 NCBI Desc: male sterility 1 protein [arabidopsis thaliana]
  misc_feature (341)..(647): NCBI GI: 32140244 NCBI Desc: male meiotic chromosome organization protein [arabidopsis thaliana]
  misc_feature (168)..(647): NCBI GI: 115454955 NCBI Desc: os03g0716200 [oryza sativa (japonica cultivar-group)]
  misc_feature (592)..(647): NCBI GI: 56966777 NCBI Desc: chain a, solution structure of phd domain in phd finger family protein
MAVITGRPPKRVRVTAGPRALDLRPFPAAGEPVPPPPRGAFRDCVRAFLARSAEPADGAWRVAFRVGEGGGDGAVVGMEVVEEDVARAGAGRIYCEHCTVAGWSRHPVCGRRYHFIIRNEYDVQDYKTCKHCGFMAQLFETRCPSCKNGISYDDPEDWDYRQLDNPRHLLHGIVHDNGFGHLVRINGREGGSSLLTGIQLMGFWDRLCKYLRVRKVSLMDVSKKYGTDYRILHAITTGYSWYGQWGFKLNKGSFGITSKEYLKAVDNLSSTPLSHFFPHSRYPRNQLQDTISFYQSLSKHPLTTIRELFLYVLGLATSKGINMHYGSMHKEHSHTHMQETWSDEEIKRATEIAIKVLRAVEKTRWVAMRTLKAAMCHPIGSPQLVDYCLKTLGTRTIDGMMVAVRCNSETNTLEYRLTDEPIILPNVSMPTQDHLHRDIKFLHDALLYPHTMHPYKPENCYEQAKRSAMILLDCKQFTKHYDLEQEFLPQNPSMLHMWCQVELLDQVGDPPCIPPELLTLPQTATVADLKVEVTRTFHDIYLMLQSFVANQLLDCGTASESTQLKLLFGANGTVRVQGRCAGGERRVGIYRMERGVDKWTVNCSCGAKDDDGERMLSCDSCHVWQHTRCAGISDFDQVPKRYVCNSCKLLHKHKSSGPRPVYNSGPSKRCKIGTGAFSHVGGGFLRPHIG

SEQ ID NO: 12457 - DNA, 666 bp, Sorghum bicolor
  misc_feature: Ceres ANNOT ID no. 6090522
  misc_feature: Encodes the peptide sequence at SEQ ID NO 12458
atgcagatctttgtgaagagccccaccggtcggacaatctgcctcagggtacaaccatcagataccttgcaaaccgtgaaggcaaagattcaggaacgggaataccttgtctatgatggagtgcggctcgaggacaataatcttacactagctgactatggcatccagcatagatctacgcttgacctcgaagagaagatgcaaatctatgtagtggaaacactagcaggcacaaccatcactcttgaggtggacagctcagaaactattgacagcatcaagggaaagattcagtatagtgagagatttcctaaggttcagcagtgcctcatatttggtgacaaacagctggaggacaacagcaccttggcggaccacaacatttcaaaggagtccacccttcttcttgtcctccacccgcttccaagaggcaccatgcgtatcaaggtatatattggcgatggaaggattgtccctctggaagttcagaagtcagatacgattgccagtgtcagtttaaagatctatgagaaggcctttgttcggcccgtacagcatgcaatctattttgactcaacgaggctggagggcagcaagaccctggcacactatggcattgagaatggggatactctcgatttgattatctgccagtgtggctgttga

SEQ ID NO: 12458 - protein, 221 aa, Sorghum bicolor
  misc_feature: Ceres ANNOT ID no. 6090522
  misc_feature (6)..(68): Pfam Id: ubiquitin Pfam Desc: Ubiquitin family
  misc_feature (73)..(141): Pfam Id: ubiquitin Pfam Desc: Ubiquitin family
  misc_feature (149)..(219): Pfam Id: ubiquitin Pfam Desc: Ubiquitin family
  misc_feature (1)..(216): NCBI GI: 92790172 NCBI Desc: polyubiqutin 2 [polyplastron multivesiculatum]
  misc_feature (1)..(216): NCBI GI: 92790170 NCBI Desc: polyubiqutin 1 [polyplastron multivesiculatum]
  misc_feature (1)..(216): NCBI GI: 92790184 NCBI Desc: polyubiqutin 2 [epidinium ecaudatum]
  misc_feature (1)..(216): NCBI GI: 92790160 NCBI Desc: polyubiqutin 3 [isotricha prostoma]
  misc_feature (1)..(216): NCBI GI: 92790156 NCBI Desc: polyubiqutin 1 [isotricha prostoma]
  misc_feature: Useful for making plants with modulated cold sensitivity
  misc_feature: Functional homolog of the protein sequence given in SEQ ID NO 13521
MQIFVKSPTGRTICLRVQPSDTLQTVKAKIQEREYLVYDGVRLEDNNLTLADYGIQHRSTLDLEEKMQIYVVETLAGTTITLEVDSSETIDSIKGKIQYSERFPKVQQCLIFGDKQLEDNSTLADHNISKESTLLLVLHPLPRGTMRIKVYIGDGRIVPLEVQKSDTIASVSLKIYEKAFVRPVQHAIYFDSTRLEGSKTLAHYGIENGDTLDLIICQCGC

SEQ ID NO: 12459 - DNA, 648 bp, Sorghum bicolor
  misc_feature: Ceres ANNOT ID no. 6090528
  misc_feature: Encodes the peptide sequence at SEQ ID NO 12460
atgtatatctttgtgaagagctccattagcaggacaatccgtctcagggtccagccaactgatacattgtccactgtcaaggcaaagatccaggaacaatactaccttgcctttgatggagagcagctagacgataaccttacgttggctgattatgacatccagaataggtccacacttgacctcgaagaaaagatggaaatttatgtacaggagacgctgttaggcacaaaaatcaccgttgaggtagatagcttagataccattggtaacgtcaaggacatgattgaatctatagagggctttcccaagcatcagcagtgcctcctctttgacaagaaacaactagaggacaacagcaccatagctgacaacaacatttgcaaggaggccacccttctccttgtcctccactcgtctccaagaggtacgatgcaaatctttgtggagacgatactcaggaccctggctctagaggtgaacagcacagacaccatcagcaatgtcaagatgatgatctataagaaggagggcactcggcctaacaagcaacgcctcctctttgctggccagcagctgcaaaatgaccgcactcttggagactatggcattaagaatgagacgaccctccatctggtgctctgctga

SEQ ID NO: 12460 - protein, 215 aa, Sorghum bicolor
  misc_feature: Ceres ANNOT ID no. 6090528
  misc_feature (6)..(67): Pfam Id: ubiquitin Pfam Desc: Ubiquitin family
  misc_feature (72)..(140): Pfam Id: ubiquitin Pfam Desc: Ubiquitin family
  misc_feature (150)..(216): Pfam Id: ubiquitin Pfam Desc: Ubiquitin family
  misc_feature (1)..(214): NCBI GI: 92790172 NCBI Desc: polyubiqutin 2 [polyplastron multivesiculatum]
  misc_feature (1)..(214): NCBI GI: 92790170 NCBI Desc: polyubiqutin 1 [polyplastron multivesiculatum]
  misc_feature (1)..(214): NCBI GI: 3126967 NCBI Desc: polyubiquitin [elaeagnus umbellata]
  misc_feature (1)..(214): NCBI GI: 433970 NCBI Desc: polyubiquitin [acetabularia cliftonii]
  misc_feature (1)..(214): NCBI GI: 2760349 NCBI Desc: ubiquitin [arabidopsis thaliana]
  misc_feature: Useful for making plants with modulated cold sensitivity
  misc_feature: Functional homolog of the protein sequence given in SEQ ID NO 13521
MYIFVKSSISRTIRLRVQPTDTLSTVKAKIQEQYYLAFDGEQLDDNLTLADYDIQNRSTLDLEEKMEIYVQETLLGTKITVEVDSLDTIGNVKDMIESIEGFPKHQQCLLFDKKQLEDNSTIADNNICKEATLLLVLHSSPRGTMQIFVETILRTLALEVNSTDTISNVKMMIYKKEGTRPNKQRLLFAGQQLQNDRTLGDYGIKNETTLHLVLC

SEQ ID NO: 12461 - DNA, 2124 bp, Sorghum bicolor
  misc_feature: Ceres ANNOT ID no. 6090842
  misc_feature: Encodes the peptide sequence at SEQ ID NO 12462
atggacttcggcgacgacgtcatggacggcggctccgacgcccagcgtcgcaagaagagataccaccgccacaccccgcgccagattcagcagctcgaggcgatgttcaaggagtgcccgcacccggacgagaaccagcggatgcagctgagcagggagctggggctggagccccggcagatcaagttctggttccagaaccgccggacgcagatgaaggcacagcacgagcggcaggacaactgcttcctgcgcgcggagaacgacaagatccggtgcgagaacatcgccatgcgggaggccctccgcaccgtcatctgccacacctgcggcggtccgcccgtcaccgacgactacttcgacgagcagaagctgcgcatggagaacgcgcggctcaaggaagagcttgaccgggtgtccagcctgacgtccaagtacctggggcggcccatcacgcagctgccgccggtgcagccgctgtccatgtcctcgtcgctggacctgtccgtcggcgggctcggcagcccggcgctgggcccgtcgctggacctcgacctcctcagcggcggctcctccgggtaccctccgttccacctcccgatgacggtgtcggagatggagcggcccatgatggccgagatggcgacgcgcgccatggacgagctcatcaggatggcgcaggccggcgagcacctgtgggtcaagacggcgggcggcggccctgacggtcgcgaggtgctcaacgtcgacacgtacgacagcatcttcgccaagcccgggggctcgttccgcggccccgacgtgcacgtcgagggctcccgcgactcgggcctcgtcttcatgagcgccatcggcctcgtcgacatgttcatggactcgagcaagtttacggagttcttccctgccatcgtgtccaaggcgcgcacgatggacgtcctcgtgaacggcatggccgggcggagcgactctttggttctgatgtacgaggagctgcacatgatgtcgccggtcgtcccgacgcgcgagttctgcttcctccgctactgccggcagatagagcacgggctatgggcgatcgcggacatctcggtagacctgcagcagcgcgacgcaaggttcggtgcgccgccatcgcgctcgtgccgcctcccgtcgggatgcctcattgctgatatggccgatggctcctccaaggtgacctgggtcgagcacatggagatcgaggacagggttcccatccacctgctgtaccgcgacctcatcctcagcggcgccgcgttcggggcgcaccggtggctcgccgcgctgcagagggcgtgcgagcggtgcgcgtgcctagccacggccggcatgccgcaccgggacattgcagctgcaggagtgacgccggaagggaagcggagcatgatgaagctgtcgcagcggatggtgagcagcttctgcgcgagcctgagcgcgtcgcagctccaccggtggacgacgctgtcggggcccaacgatgtgggcgtccgcgtcatggtgcaccgcagcacggacccggggcagcccagcggcgtggtgctcagcgctgccacgtccatctggctgccggtcccgtgcgaccgggtgttcgccttcgtccgcgacgagcacacgcgctcccagtgggacgtgctgtcgcacggcaacccggtgcaggaggtgtcgcgcatccccaacggctcccaccctggaaactgtatctccttgctcagaggcctgaacgcgagccagaacagcatgctgatcctgcaggagagctgcaccgacgcgtcgggctcgctggtggtgtacgcgccgatcgacatcccggcggcgaacgtggtgatgagcggcgaggacccgtcggcgatcccgctcctgccgtccggcttcaccatcctgcccgacgggcggcccggcgcatcgtcgtcgtcgtcgagcgctgccggtggcacgctgggcgcgacggcggcggccgggtcgctggtgacggtggcgttccagatcctggtgagcagcctgccgtcgtcgaagctgaacgccgagtcggtggcgacggtcaacagcctcatcagcaccactgtggagcaaattaaggcggccttgaattgcgccagccattga

SEQ ID NO: 12462 - protein, 707 aa, Sorghum bicolor
  misc_feature: Ceres ANNOT ID no. 6090842
  misc_feature (213)..(442): Pfam Id: START Pfam Desc: START domain
  misc_feature (18)..(74): Pfam Id: Homeobox Pfam Desc: Homeobox domain
  misc_feature (12)..(706): NCBI GI: 51872287 NCBI Desc: homeodomain protein hox3 [gossypium hirsutum]
  misc_feature (11)..(706): NCBI GI: 76782208 NCBI Desc: baby boom interacting protein 1a [brassica napus]
  misc_feature (11)..(706): NCBI GI: 77378036 NCBI Desc: baby boom interacting protein 1b [brassica napus]
  misc_feature (4)..(702): NCBI GI: 109729922 NCBI Desc: tpa: tpa_inf: class iv hd-zip protein hdz41 [physcomitrella patens]
  misc_feature (4)..(702): NCBI GI: 109729926 NCBI Desc: tpa: tpa_inf: class iv hd-zip protein hdz43 [physcomitrella patens]
  misc_feature: The sequence is a functional homolog of SEQ ID NO 10 in the 10/225,066US patent application
  misc_feature: The sequence is a functional homolog of SEQ ID NO 102 in the 10/225,066US patent application
  misc_feature: The sequence is a functional homolog of SEQ ID NO 1024 in the 10/225,066US patent application
  misc_feature: The sequence is a functional homolog of SEQ ID NO 136 in the 11/375,241US patent application
  misc_feature: The sequence is a functional homolog of SEQ ID NO 1873 in the 11/479,226US patent application
  misc_feature: The sequence is a functional homolog of SEQ ID NO 2294 in the 10/374,780US patent application
  misc_feature: The sequence is a functional homolog of SEQ ID NO 2886 in the 10/374,780US patent application
  misc_feature: The sequence is a functional homolog of SEQ ID NO 304 in the 10/374,780US patent application
  misc_feature: The sequence is a functional homolog of SEQ ID NO 434 in the 10/666,642US patent application
  misc_feature: The sequence is a functional homolog of SEQ ID NO 838 in the 10/225,066US patent application
  misc_feature: Useful for making plants with modulated growth and phenotype characteristics
  misc_feature: The sequence is a functional homolog of SEQ ID NO 10 in the 20050160493 US patent application
  misc_feature: The sequence is a functional homolog of SEQ ID NO 102 in the 20050160493 US patent application
  misc_feature: The sequence is a functional homolog of SEQ ID NO 1024 in the 20050160493 US patent application
  misc_feature: The sequence is a functional homolog of SEQ ID NO 1024 in the 10/225,066 US patent application
  misc_feature: The sequence is a functional homolog of SEQ ID NO 2886 in the 10/374,780 US patent application
  misc_feature: The sequence is a functional homolog of SEQ ID NO 434 in the 10/666,642 US patent application
MDFGDDVMDGGSDAQRRKKRYHRHTPRQIQQLEAMFKECPHPDENQRMQLSRELGLEPRQIKFWFQNRRTQMKAQHERQDNCFLRAENDKIRCENIAMREALRTVICHTCGGPPVTDDYFDEQKLRMENARLKEELDRVSSLTSKYLGRPITQLPPVQPLSMSSSLDLSVGGLGSPALGPSLDLDLLSGGSSGYPPFHLPMTVSEMERPMMAEMATRAMDELIRMAQAGEHLWVKTAGGGPDGREVLNVDTYDSIFAKPGGSFRGPDVHVEGSRDSGLVFMSAIGLVDMFMDSSKFTEFFPAIVSKARTMDVLVNGMAGRSDSLVLMYEELHMMSPVVPTREFCFLRYCRQIEHGLWAIADISVDLQQRDARFGAPPSRSCRLPSGCLIADMADGSSKVTWVEHMEIEDRVPIHLLYRDLILSGAAFGAHRWLAALQRACERCACLATAGMPHRDIAAAGVTPEGKRSMMKLSQRMVSSFCASLSASQLHRWTTLSGPNDVGVRVMVHRSTDPGQPSGVVLSAATSIWLPVPCDRVFAFVRDEHTRSQWDVLSHGNPVQEVSRIPNGSHPGNCISLLRGLNASQNSMLILQESCTDASGSLVVYAPIDIPAANVVMSGEDPSAIPLLPSGFTILPDGRPGASSSSSSAAGGTLGATAAAGSLVTVAFQILVSSLPSSKLNAESVATVNSLISTTVEQIKAALNCASH

SEQ ID NO: 12463 - DNA, 642 bp, Sorghum bicolor
  misc_feature: Ceres ANNOT ID no. 6090892
  misc_feature: Encodes the peptide sequence at SEQ ID NO 12464
atgggcacagttgtggatgccgctccagctgttgtggctgaggaggtcactgagaacatgttgggtggcaagaaagttacagttgtatttgttctaggtggtcctggaagtggaaagggcacacaatgtgccaacattgtggagcactttggattcacccatcttagtgctggagatcttttgcgtgcagaaattaaatctggctctgagaacggaaccatgatcgagaacatgataaaggagggaaagattgttccatcggaggtgactataaagctgttgcaggaggcaatgataaaaaatgaaaatgacaaattcctgattgatggatttccaaggaacgaggagaatcgtgcagcgtttgagaatgttaccaaaatttctcctgcgtttgtgctattctttgactgttctgaggaagagatggagagacgtctcttgggccgcaatcagggaagagttgatgataacattgaaactatcaaaaaaaggtttaaaacctttgttgaatcaagtctgcctgtcattgagcattacaactcaagggacaaggttaaaaagattgatgctgcaaaaccaattcctgaggtgtttgaagacgtcaaagccatttttgccccattttcttcaaaggctgaatag

SEQ ID NO: 12464 - protein, 213 aa, Sorghum bicolor
  misc_feature: Ceres ANNOT ID no. 6090892
  misc_feature (31)..(184): Pfam Id: ADK Pfam Desc: Adenylate kinase
  misc_feature (1)..(213): NCBI GI: 33146624 NCBI Desc: ump/cmp kinase a [oryza sativa (japonica cultivar-group)]
  misc_feature (1)..(213): NCBI GI: 6683813 NCBI Desc: ump/cmp kinase b [oryza sativa]
  misc_feature (23)..(213): NCBI GI: 2497486 NCBI Desc: uridylate kinase (uk) (uridine monophosphate kinase) (ump kinase) (ump/cmp kinase)
  misc_feature (23)..(213): NCBI GI: 30690243 NCBI Desc: uridylate kinase / uridine monophosphate kinase / ump kinase (pyr6) [arabidopsis thaliana]
  misc_feature (24)..(206): NCBI GI: 7076771 NCBI Desc: uridylate kinase-like protein [arabidopsis thaliana]
  misc_feature (28)..(209): SWISSPROT Homolog: EC 2.7.4.3 Adenylate kinase
  misc_feature (25)..(205): SWISSPROT Homolog: EC 2.7.4.14 Cytidylate kinase
MGTVVDAAPAVVAEEVTENMLGGKKVTVVFVLGGPGSGKGTQCANIVEHFGFTHLSAGDLLRAEIKSGSENGTMIENMIKEGKIVPSEVTIKLLQEAMIKNENDKFLIDGFPRNEENRAAFENVTKISPAFVLFFDCSEEEMERRLLGRNQGRVDDNIETIKKRFKTFVESSLPVIEHYNSRDKVKKIDAAKPIPEVFEDVKAIFAPFSSKAE

SEQ ID NO: 12465 - DNA, 2244 bp, Sorghum bicolor
  misc_feature: Ceres ANNOT ID no. 6090910
  misc_feature: Encodes the peptide sequence at SEQ ID NO 12466
atgaaaggcgtacttcagattaagggggcatcagggcgtgaaaagaaggctcctaaggagctcgagagtgtcttgaaccaatatttcggatattcgggatttcgaggaaaacaactggaagctatagaagctgttctatcaggaagagattgcttttgtttgatgccaactggcggtggaaagtccatgtgctatcaggttccagctctggtgaagacaggcattgttcttgtcatttcacccttgatagcgctgatggagaaccaggttgccagcttgaaaaataaagggattccagctgaatttctctcatcaacacaggcatctcacactaaacaaaggatacatgaagaccttgatactggtaatccttctttaaagttgctatatgtcactcctgagcttgttgcaacatcaggctttatggcaaagctaaagaagctctacaacagaggtcttcttggtcttgttgctattgatgaggctcactgtatttcgacttggggccatgatttcagacctagctatcgcaagctttcatcattgaggaagcagttcccagatatccctttgttagctttaactgcaactgctgtcccgaaggtccagaaagatgtgatatcatcactgtgcctgcaaaatccagtgattcttagagcttcatttaatcgacccaatatattctatgaagttcgttacaaggatcttcttgatgatgtttactctgatatatcaaatttactgaagtcaagcggaaatgcttgctcaattatatattgtcttgaacgggcagcttgtgatgatctaagcatgcatttgtcacagcagggtgtctcttctgctgcttatcatgctggcctaaatagcaaagtgcgaagttctgttctcgatgactggctttcgtcgagaactcaagttgttgttgcaactgtagcctttggacaagatgtccgtattgtatgccacttcaacttgcctaagtcaatggaatccttctatcaggagtcaggtcgagctggtcgtgatcaacgaccttcaagaagtgttttgtattacggattagatgaccggaggagaatggaattcattttgagaaaccccaaaattaacaaagcacaaccgtcttcctcttcaaatgagctttctgagaaggctctagctgacttcagtcagattgttgactactgtgaaagttctagctgccggcgaaaaaagatcattgagagctttggagagaaagtacaaccaactttatgccaacgctcatgtgatgcttgcaagcacccaaatttagtgtcgtcacgtctggaggaactccgtcgtgtgcccaactgtcgctttaataagatctccccagtgtttcaaagctcagttaaaccagcacacttggacacagaattctggaatcgtgaagatgaggcaagcatatcggctgaagacatctcagattctgatgatgggaatgaggtggtgagtaatatagccatttcaaaggttccagcaaaagctggtctggatgcaaaatttaaagctctggagcgtgctgaaaatgcttattaccaaggaaaaggtcagaccaagcagcagggtggtggccttgctgacaagaaaagcatctctcagacgctaagagatgcatgccggaaaagattgttggatgctcttggacaagcaaagctgcgacttgggaatattccgtgcgacgacgaggcttctgctacacaccttgaaacagagtgcttcaaaaaatatgagaaagtgggcaagacgttctacaactcacagatagccgccacagttcggtggctgtcatccgcaacatccagtcagatgcacgaccgcctccatgctgttatcgaccaaactaaagatgatggtgcatcaggctcccccgacattgttccagagtcacctccagcatctcctaaaatcgtcggcacaaagccaggagaaaccagtaactatgaagctgacgtcaaaccacagcatatttgtaagttggggaaaaggggacattcagatgtgtctacagagggtgctgcggcatcgactgggaacatggagctcccctcaataccaactgggaacatggtgctccccgcgataccaacgttcagagaattcttgagccaaaaaggaagggatcgggcaaagagctattcaaattcccagccatctggtattcgtaggaagtctagtggtcaggttgataaggaagaaaccagcaagaggatgaaatcatga

SEQ ID NO: 12466 - protein, 747 aa, Sorghum bicolor
  misc_feature: Ceres ANNOT ID no. 6090910
  misc_feature (35)..(206): Pfam Id: DEAD Pfam Desc: DEAD/DEAH box helicase
  misc_feature (272)..(343): Pfam Id: Helicase_C Pfam Desc: Helicase conserved C-terminal domain
  misc_feature (2)..(659): NCBI GI: 11121447 NCBI Desc: dna helicase [arabidopsis thaliana]
  misc_feature (315)..(747): NCBI GI: 115449055 NCBI Desc: os02g0780800 [oryza sativa (japonica cultivar-group)]
  misc_feature (92)..(659): NCBI GI: 30690466 NCBI Desc: dna helicase (recql3) [arabidopsis thaliana]
  misc_feature (2)..(315): NCBI GI: 140068772 NCBI Desc: atp-requiring dna helicase recq [medicago truncatula]
  misc_feature (19)..(649): NCBI GI: 119609695 NCBI Desc: recq protein-like 5, isoform cra_a [homo sapiens]
  misc_feature: Useful for making plants with altered Lignin content
  misc_feature: Useful for making plants with altered terpenoid content
  misc_feature: Functional homolog of the protein sequence given in SEQ ID NO 13152
MKGVLQIKGASGREKKAPKELESVLNQYFGYSGFRGKQLEAIEAVLSGRDCFCLMPTGGGKSMCYQVPALVKTGIVLVISPLIALMENQVASLKNKGIPAEFLSSTQASHTKQRIHEDLDTGNPSLKLLYVTPELVATSGFMAKLKKLYNRGLLGLVAIDEAHCISTWGHDFRPSYRKLSSLRKQFPDIPLLALTATAVPKVQKDVISSLCLQNPVILRASFNRPNIFYEVRYKDLLDDVYSDISNLLKSSGNACSIIYCLERAACDDLSMHLSQQGVSSAAYHAGLNSKVRSSVLDDWLSSRTQVVVATVAFGQDVRIVCHFNLPKSMESFYQESGRAGRDQRPSRSVLYYGLDDRRRMEFILRNPKINKAQPSSSSNELSEKALADFSQIVDYCESSSCRRKKIIESFGEKVQPTLCQRSCDACKHPNLVSSRLEELRRVPNCRFNKISPVFQSSVKPAHLDTEFWNREDEASISAEDISDSDDGNEVVSNIAISKVPAKAGLDAKFKALERAENAYYQGKGQTKQQGGGLADKKSISQTLRDACRKRLLDALGQAKLRLGNIPCDDEASATHLETECFKKYEKVGKTFYNSQIAATVRWLSSATSSQMHDRLHAVIDQTKDDGASGSPDIVPESPPASPKIVGTKPGETSNYEADVKPQHICKLGKRGHSDVSTEGAAASTGNMELPSIPTGNMVLPAIPTFREFLSQKGRDRAKSYSNSQPSGIRRKSSGQVDKEETSKRMKS

SEQ ID NO: 12467 - DNA, 1503 bp, Sorghum bicolor
  misc_feature: Ceres ANNOT ID no. 6090912
  misc_feature: Encodes the peptide sequence at SEQ ID NO 12468
atggtggagacgggcggggggaggctgcaccagcgccggggcgcggtcgccttcgtcgcggcaaacaaggcgctgctggctgccgcgtgggtcgtcgggttcgcgctcgtgttcctgtggcagagcgcctcgatgtccttcggcagcgctggcgccggcggcgccgctggcggagggttcctcaggctcctgtcggcgccgcctccgccgccgcgccccgcgccgcggcttcgccccacggcgtacaacctcacggacttcggcgccgtcggggacggccgggccgtcaacaccgaggcgttcgagcgcgctgtcgagaccatcgccgccctcgcggagcgaggcggcgggcagcttaatgtgccccccgggcgctggctcacggcgcccttcaacctcaccagccacatgacgctgtttcttgccgagggcgcggagatccttggcattacggatgagaagtactggccattgatgccagcattaccatcatatgggtatgggcgggagcgcaaaggaccacgctttgggagtctcattcatggacagaatttgaaagatgtagtcattacaggacataatgggagcataaatggccagggtgaagtttggtggatgaagcatcgcagaagaattctgaataacacaagacctcctcttgtgcagctgatgtggtccaaggacattattattgccaacataacattgaggaattcacctttctggcacttgcatccgtatgattgcacaaatgtaactgtttcgaatgttactatcttatctcctgtttctggtgctccaaacacagatggcatagatccagattcttctcaggatgtgcttattgagaattgctacatatcggttggtgatgatgcaatagctataaagagtggttgggatcagtatgggattgcatatggtcgcccatcttctaacatttcaatccgcaatgtaaatgcccgttctctagtgagtgctggaatttcaataggaagtgagatgtctggcggagtagcaaatgttacggtggagaatgtacgcatctgggaatcaagaagaggtgtgaggataaagactgccacgggaagaggtggctacatccgtaacatctcctaccgcaacattacttttgacaatgttcgtgctgggattgtgataaaggttgactacaacgagcatgctgatgatggatatgaccggacagcattcccagatatcacgagtatatcgttcaagggaatccatgggcggggtgttcgggtgcctgtccgtgctcatggcagcgatgtcatccccatcagggacatcagcttccaggacatgtcggtaggcatcagctacaagaagaagcacatcttccagtgctcctacgttgaggggcgcgtcgtcaggcccgtgttcccgaaaccatgtgagaacctggacatctatgacgagcaagggcagcttgtcaagcgggcagtggccctgaacagcacagaacttgactacgatatatga

SEQ ID NO: 12468 - protein, 500 aa, Sorghum bicolor
  misc_feature: Ceres ANNOT ID no. 6090912
  misc_feature (134)..(472): Pfam Id: Glyco_hydro_28 Pfam Desc: Glycosyl hydrolases family 28
  misc_feature (8)..(500): NCBI GI: 15221958 NCBI Desc: glycoside hydrolase family 28 protein / polygalacturonase (pectinase) family protein [arabidopsis thaliana]
  misc_feature (152)..(500): NCBI GI: 8954055 NCBI Desc: contains similarity to a polygalacturonase-like protein gi7529266 from arabidopsis thaliana bac f18p9 gbal138654 and contains multiple polygalacturonase (pectinase) pf00295
  misc_feature (152)..(500): NCBI GI: 8954055 (continued) domains
  misc_feature (18)..(500): NCBI GI: 7529266 NCBI Desc: polygalacturonase-like protein [arabidopsis thaliana]
  misc_feature (18)..(500): NCBI GI: 23506093 NCBI Desc: at3g42950/f18p9_110 [arabidopsis thaliana]
  misc_feature (84)..(475): NCBI GI: 6522571 NCBI Desc: endo-polygalacturonase-like protein [arabidopsis thaliana]
  misc_feature: Useful for making plants with altered cell wall content and/or composition
  misc_feature: GREAT-hit functional homolog of the protein sequence encoded by LOCUS at1g19170
  misc_feature: Functional homolog of the protein sequence encoded by LOCUS at3g42950
  misc_feature: Useful for making plants with altered carbohydrate content
  misc_feature: Functional homolog of the protein sequence given in SEQ ID NO 13716
  misc_feature: Useful for making plants with altered cell wall content and/or composition
  misc_feature: Functional homolog of the protein sequence given in SEQ ID NO 13717
  misc_feature: The sequence is a functional homolog of SEQ ID NO. 450 in the 11/188,298 US application
MVETGGGRLHQRRGAVAFVAANKALLAAAWVVGFALVFLWQSASMSFGSAGAGGAAGGGFLRLLSAPPPPPRPAPRLRPTAYNLTDFGAVGDGRAVNTEAFERAVETIAALAERGGGQLNVPPGRWLTAPFNLTSHMTLFLAEGAEILGITDEKYWPLMPALPSYGYGRERKGPRFGSLIHGQNLKDVVITGHNGSINGQGEVWWMKHRRRILNNTRPPLVQLMWSKDIIIANITLRNSPFWHLHPYDCTNVTVSNVTILSPVSGAPNTDGIDPDSSQDVLIENCYISVGDDAIAIKSGWDQYGIAYGRPSSNISIRNVNARSLVSAGISIGSEMSGGVANVTVENVRIWESRRGVRIKTATGRGGYIRNISYRNITFDNVRAGIVIKVDYNEHADDGYDRTAFPDITSISFKGIHGRGVRVPVRAHGSDVIPIRDISFQDMSVGISYKKKHIFQCSYVEGRVVRPVFPKPCENLDIYDEQGQLVKRAVALNSTELDYDI

SEQ ID NO: 12469 - DNA, 1056 bp, Sorghum bicolor
  misc_feature: Ceres ANNOT ID no. 6090950
  misc_feature: Encodes the peptide sequence at SEQ ID NO 12470
atgccgtcaccgccgccgccgccgaggaataattctctcaagtcgttcatggtgggcaacggcaatcacgcgccccagcaggtcggcacgaagcagaggcacggcggcggtggcttcccgaggctgtctgcctccagcaaggcgttggtcctgctgccgctcctgctcctggccttcatcttcctcttcgtgtaccccaaggagttcgagctgcaggcgatgctgagcgcgtgcggcccgccctccgcggagccggcggcggcgggcgcggccgtggtccggaagcccgacttccggctgctcatcggcgtgctgacccgagcggacctgtacgagcggcggcacctgctgcgcatggtgtacgggctgcagctcgcgtcgccaccggaggaggagcccctggccgcgcacgtggacgtccgcttcgtcttctgccggctgtacaaggacgaccagcgcgtgctggtgccgctcgagatcctcgcccacgacgacgtcatcgtgctcgacggctgcgaggagaacctcaacggcggcaagacgtacacgttcctgtccacggtggcgcggctctacgccgacgagccgtacgactacgtgatgaaggccgacgacgacatcttcctccggctgccgcagctggtggcgtcgctgggcgggatgccccgggacgacatgtactacggcgccaccatcccctgcgacagcatggacccgttccgggactacatggccggcatggcctacgcgctgtcgtgggacctcgtgcagtggatcgccacctccgacgtggcgcgaaaccacagcgtgggcacggaggacatgctcacggggctctggctcaggatcggggacaaggggaagaaccgcttcaacgccaagccggccatccatgactacctcaacccggtgccggtggaccagtgcgagcacgagttcatgccaagcaccatcggtgtgcacaggctcaagagcaacccgaggtgggcggaggcgctcaagtacttcaacttcacggcagggctcaagtcgtccaagttctacaagatcgactaa

SEQ ID NO: 12470 - protein, 351 aa, Sorghum bicolor
  misc_feature: Ceres ANNOT ID no. 6090950
  misc_feature (48)..(350): NCBI GI: 115479301 NCBI Desc: os09g0433500 [oryza sativa (japonica cultivar-group)]
  misc_feature (197)..(336): NCBI GI: 74625883 NCBI Desc: beta-1,3-galactosyltransferase pvg3 (pyruvylated gal-beta-1,3-epitope synthesis protein 3) (pvgal synthesis protein 3)
  misc_feature (97)..(263): NCBI GI: 29824883 NCBI Desc: beta-1,3-n-acetylglucosaminyltransferase 5 [sus scrofa]
  misc_feature (97)..(263): NCBI GI: 61555407 NCBI Desc: beta-1,3-n-acetylglucosaminyltransferase bgnt-5 [bos taurus]
  misc_feature (87)..(281): NCBI GI: 89269053 NCBI Desc: udp-gal:betagal beta 1,3-galactosyltransferase polypeptide 6 [xenopus tropicalis]
  misc_feature: The sequence is a functional homolog of SEQ ID NO. 346 in the 11/188,298 US application
MPSPPPPPRNNSLKSFMVGNGNHAPQQVGTKQRHGGGGFPRLSASSKALVLLPLLLLAFIFLFVYPKEFELQAMLSACGPPSAEPAAAGAAVVRKPDFRLLIGVLTRADLYERRHLLRMVYGLQLASPPEEEPLAAHVDVRFVFCRLYKDDQRVLVPLEILAHDDVIVLDGCEENLNGGKTYTFLSTVARLYADEPYDYVMKADDDIFLRLPQLVASLGGMPRDDMYYGATIPCDSMDPFRDYMAGMAYALSWDLVQWIATSDVARNHSVGTEDMLTGLWLRIGDKGKNRFNAKPAIHDYLNPVPVDQCEHEFMPSTIGVHRLKSNPRWAEALKYFNFTAGLKSSKFYKID

SEQ ID NO: 12471 - DNA, 882 bp, Sorghum bicolor
  misc_feature: Ceres ANNOT ID no. 6091139
  misc_feature: Encodes the peptide sequence at SEQ ID NO 12472
atgcctcggccggagttccaggcgccgccggatgtgttctacaacgagtcggaggcccgcaagtacaccacctcctctcgtatcatcgaaatccagtctaggatttccgagagggcgctggagctgcttgctctccccaacgatggcgtccccaagatgcttctcgacataggatgtggttctggacttagtggtgagacattgacggagcatggccaccactggattggctatgatatttcaaagtcgatgctcgatgttgccttggagcgtgaaacagaaggcgacctactacttgcagatatgggacagggcttgggcttgcggccaggagttattgatggtgcaattagtatttcagcagttcagtggttatgcaatgctgacaagtcttctcatgatccaagattgcggttaaaggctttcttcggttcgttatatagatgcctagcaaggggcgcaagagctgttctacagttttatgctgataatgtgaagcagagtgaaatgattgtgactgctgccatgcgtgctggttttgctggtggagttgtggttgactggcctcatagttccaaagcaaagaagtcctaccttgtcctcacttgtggaccaccttcggttaatacatcacttccaaagggtaaaggtgaaaatggtgagatgtgcagcgatgatgatgataatgagagcagtgatgaagatggtgacagaacagtgggcatatatgaaaggaataggccgaagaagcgtcagaagacgaaaaagaacggtaaaggcaaggattggctcttgaagaaaaaggagcaaatgagaagaagaggacatgacgtgcccgcggacacgaagtacaccgggcgtaagcggaagagctatttctag

SEQ ID NO: 12472 - protein, 293 aa, Sorghum bicolor
  misc_feature: Ceres ANNOT ID no. 6091139
  misc_feature (55)..(158): Pfam Id: Methyltransf_11 Pfam Desc: Methyltransferase domain
  misc_feature (55)..(156): Pfam Id: Methyltransf_12 Pfam Desc: Methyltransferase domain
  misc_feature (3)..(293): NCBI GI: 92876677 NCBI Desc: sam (and some other nucleotide) binding motif [medicago truncatula]
  misc_feature (3)..(293): NCBI GI: 49522137 NCBI Desc: mgc82375 protein [xenopus laevis]
  misc_feature (3)..(293): NCBI GI: 109734980 NCBI Desc: wbscr22 protein [mus musculus]
  misc_feature (3)..(221): NCBI GI: 125777365 NCBI Desc: ga10628-pa [drosophila pseudoobscura]
  misc_feature (3)..(221): NCBI GI: 21355093 NCBI Desc: cg10903-pa [drosophila melanogaster]
MPRPEFQAPPDVFYNESEARKYTTSSRIIEIQSRISERALELLALPNDGVPKMLLDIGCGSGLSGETLTEHGHHWIGYDISKSMLDVALERETEGDLLLADMGQGLGLRPGVIDGAISISAVQWLCNADKSSHDPRLRLKAFFGSLYRCLARGARAVLQFYADNVKQSEMIVTAAMRAGFAGGVVVDWPHSSKAKKSYLVLTCGPPSVNTSLPKGKGENGEMCSDDDDNESSDEDGDRTVGIYERNRPKKRQKTKKNGKGKDWLLKKKEQMRRRGHDVPADTKYTGRKRKSYF

SEQ ID NO: 12473 - DNA, 813 bp, Sorghum bicolor
  misc_feature: Ceres ANNOT ID no. 6091152
  misc_feature: Encodes the peptide sequence at SEQ ID NO 12474
atggacgcgcagcagcagcagctggatttggtcatgcgtcaccagagcatggccaccgtctacgagagcgaggacgcgctggggtcgtcggagtcggatcccgcgaggccggcgcgcccgcgcggcaagaggagccgcgccgccgaggtgcacaacctctccgagaagaggaggaggagcaggatcaacgagaagatgaaggcgctgcagaccctcatacccaactcgagcaagacggacaaggcctccatgctcgatgatgccattgagtacctgaagcagcttcagctccaagtgcagatgttgtctatgaggaatggcctgtatctgcccccaggaaacttgtctggagtacctgaggctctggcatcctcagaaatgtgtgccgcacttaaccaaagtggtgccaaggcatcaaattctggcgctgttgtactacctggaaaccaaattcctgtagctcgtcttttatttgatctaccaaatcatgatcaacggcatgaaaacccgcttgtattacaaagtgtccctagtagttcaaccgctgtagagcctcagttccttcaagagccagcacagcccaaccttcaatcctttcagctggctctacctcctgagatgctcttcaaggaggacatgatgttagagcatcgactaacttcagctcaagaaaccacatctttaccagggcatgaggccaagcctggtaggcaggaagcacgcatggtgaattctgatctttttgatagaggttcgctcgggaaagaaagaagtggcgacgcagagggaagtctgagggcaggatcaaactaa

SEQ ID NO: 12474 - protein, 270 aa, Sorghum bicolor
  misc_feature: Ceres ANNOT ID no. 6091152
  misc_feature (47)..(96): Pfam Id: HLH Pfam Desc: Helix-loop-helix DNA-binding domain
  misc_feature (78)..(227): NCBI GI: 115466606 NCBI Desc: os06g0164400 [oryza sativa (japonica cultivar-group)]
  misc_feature (22)..(259): NCBI GI: 144923691 NCBI Desc: helix-loop-helix dna-binding [medicago truncatula]
  misc_feature (22)..(162): NCBI GI: 54306640 NCBI Desc: basic helix-loop-helix protein [fragaria x ananassa]
  misc_feature (3)..(206): NCBI GI: 115454269 NCBI Desc: os03g0639300 [oryza sativa (japonica cultivar-group)]
  misc_feature (22)..(154): NCBI GI: 4093153 NCBI Desc: phytochrome-associated protein 3 [arabidopsis thaliana]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 120 in the 10/374,780US patent application
  misc_feature: The sequence is a functional homolog of SEQ ID NO 124 in the 10/412,699US patent application
  misc_feature: The sequence is a functional homolog of SEQ ID NO 1245 in the 10/412,699US patent application
  misc_feature: The sequence is a functional homolog of SEQ ID NO 1246 in the 10/412,699US patent application
  misc_feature: The sequence is a functional homolog of SEQ ID NO 1742 in the 10/412,699US patent application
  misc_feature: The sequence is a functional homolog of SEQ ID NO 1966 in the 10/374,780US patent application
  misc_feature: The sequence is a functional homolog of SEQ ID NO 2 in the 10/374,780US patent application
  misc_feature: The sequence is a functional homolog of SEQ ID NO 2830 in the 10/374,780US patent application
  misc_feature: The sequence is a functional homolog of SEQ ID NO 299 in the 11/479,226US patent application
  misc_feature: The sequence is a functional homolog of SEQ ID NO 388 in the 10/412,699US patent application
  misc_feature: The sequence is a functional homolog of SEQ ID NO 464 in the 11/435,388US patent application
  misc_feature: The sequence is a functional homolog of SEQ ID NO 494 in the 11/435,388US patent application
  misc_feature: The sequence is a functional homolog of SEQ ID NO 84 in the 11/375,241US patent application
  misc_feature: The sequence is a functional homolog of SEQ ID NO 890 in the 10/225,066US patent application
  misc_feature: The sequence is a functional homolog of SEQ ID NO 905 in the 11/479,226US patent application
  misc_feature: The sequence is a functional homolog of SEQ ID NO 92 in the 10/225,066US patent application
  misc_feature: The sequence is a functional homolog of SEQ ID NO 966 in the 10/374,780US patent application
  misc_feature: The sequence is a functional homolog of SEQ ID NO 967 in the 10/374,780US patent application
  misc_feature: Useful for making plants with altered Lignin content
  misc_feature: Useful for making plants with modulated growth and phenotype characteristics
  misc_feature: Functional homolog of the protein sequence given in SEQ ID NO 13216
  misc_feature: The sequence is a functional homolog of SEQ ID NO 12 in the 20040045049 US patent application
  misc_feature: The sequence is a functional homolog of SEQ ID NO 12 in the 20040045049 US patent application
  misc_feature: The sequence is a functional homolog of SEQ ID NO 124 in the 20040045049 US patent application
  misc_feature: The sequence is a functional homolog of SEQ ID NO 124 in the 20040045049 US patent application
  misc_feature: The sequence is a functional homolog of SEQ ID NO 1245 in the 20040045049 US patent application
  misc_feature: The sequence is a functional homolog of SEQ ID NO 1246 in the 20040045049 US patent application
  misc_feature: The sequence is a functional homolog of SEQ ID NO 388 in the 20040045049 US patent application
  misc_feature: The sequence is a functional homolog of SEQ ID NO 92 in the 20050160493 US patent application
  misc_feature: The sequence is a functional homolog of SEQ ID NO 1245 in the 10/412,699 US patent application
  misc_feature: The sequence is a functional homolog of SEQ ID NO 966 in the 10/374,780 US patent application
  misc_feature: The sequence is a functional homolog of SEQ ID NO 1246 in the 10/412,699 US patent application
  misc_feature: The sequence is a functional homolog of SEQ ID NO 967 in the 10/374,780 US patent application
  misc_feature: The sequence is a functional homolog of SEQ ID NO. 414 in the 11/188,298 US application
  misc_feature: The sequence is a functional homolog of SEQ ID NO. 483 in the 11/188,298 US application
MDAQQQQLDLVMRHQSMATVYESEDALGSSESDPARPARPRGKRSRAAEVHNLSEKRRRSRINEKMKALQTLIPNSSKTDKASMLDDAIEYLKQLQLQVQMLSMRNGLYLPPGNLSGVPEALASSEMCAALNQSGAKASNSGAVVLPGNQIPVARLLFDLPNHDQRHENPLVLQSVPSSSTAVEPQFLQEPAQPNLQSFQLALPPEMLFKEDMMLEHRLTSAQETTSLPGHEAKPGRQEARMVNSDLFDRGSLGKERSGDAEGSLRAGSN

SEQ ID NO: 12475 - DNA, 930 bp, Sorghum bicolor
  misc_feature: Ceres ANNOT ID no. 6091204
  misc_feature: Encodes the peptide sequence at SEQ ID NO 12476
atggagacgacagtggcggcaccgggcgcctccgccagctgcgagagcgagatcacgcgactgccggaggacctcctgttggcgtcgctcgcgcgcgccgggccggtggccgcctgccgcgccgccgctgtctgccaagccttccacgcagcggccgacaccgacgcgctctgggcctgcttcctgccccacgacctccctccgttcgctgacaaggagctctccccaccaccgccgtccaagaaggagctgttcatgcggctctccgacggccccgtcctcctcgccgacggcctcacgagcatgtgcctgcacagggagacaggtgccctgtgctacatgctgtccgcaaggaagctgagcatcgctttggctgacagttttcgtactccggcccactgtcgctggatccccatcaccggttcctgcagattctcagaagctgttgaactccgacattaccggtggttggaaataggtgccaagattgacagcatgatgctctcccaacacacaacatatgctgcttatattgtgtacaaagtagaagagaataggtggcatgaacggtttactagcatttttggggcatcaaagtttcctaaagaaagacatgatggttggatggagggggagatgggcgggttccataatgatgaaggtgaagacggtgaggtttccatcagctttaggacgttgccatatgcgaagattggtcttgttgctctgggtattgagattagacctaaggacacacactttcctcaagacagaggtggtggcgggatgatggaggcggagctaggtgagttccacattagtgaaggcgacaatggtgaggtttccatcagtcttatggatacgttcagctctaagtgtggtcttgttgtcatgggcattgagattagacccaagaaacaaggggtttga

SEQ ID NO: 12476 - protein, 309 aa, Sorghum bicolor
  misc_feature: Ceres ANNOT ID no. 6091204
  misc_feature (16)..(63): Pfam Id: F-box Pfam Desc: F-box domain
  misc_feature (10)..(187): NCBI GI: 47848533 NCBI Desc: f-box family protein-like [oryza sativa (japonica cultivar-group)]
  misc_feature (15)..(250): NCBI GI: 115449503 NCBI Desc: os02g0813100 [oryza sativa (japonica cultivar-group)]
  misc_feature (9)..(180): NCBI GI: 47848218 NCBI Desc: phloem-specific lectin-like [oryza sativa (japonica cultivar-group)]
  misc_feature (11)..(142): NCBI GI: 47848537 NCBI Desc: f-box family protein-like [oryza sativa (japonica cultivar-group)]
  misc_feature (16)..(181): NCBI GI: 92879666 NCBI Desc: cyclin-like f-box [medicago truncatula]
METTVAAPGASASCESEITRLPEDLLLASLARAGPVAACRAAAVCQAFHAAADTDALWACFLPHDLPPFADKELSPPPPSKKELFMRLSDGPVLLADGLTSMCLHRETGALCYMLSARKLSIALADSFRTPAHCRWIPITGSCRFSEAVELRHYRWLEIGAKIDSMMLSQHTTYAAYIVYKVEENRWHERFTSIFGASKFPKERHDGWMEGEMGGFHNDEGEDGEVSISFRTLPYAKIGLVALGIEIRPKDTHFPQDRGGGGMMEAELGEFHISEGDNGEVSISLMDTFSSKCGLVVMGIEIRPKKQGV

SEQ ID NO: 12477 - DNA, 522 bp, Sorghum bicolor
  misc_feature: Ceres ANNOT ID no. 6091216
  misc_feature: Encodes the peptide sequence at SEQ ID NO 12478
atggccgcggcggcgatgggcctcctgcgtgagctcctgcgaaccacgggcacccgccggctctgcggcacggccgtgggcgtggcggcgggcttcctcagcgccgcgaccgtcgcgtcggcgtccgacggcgccgcctgcccggcctacccgtggtcaccacaggacggggcgcgtggcgggcacaaggtgttcatgcagcacgactgcgcggcgtgccactccggcctgccgtacgccggcctcgccgacgaggccctggtggccggaggcgaggtggaagcccaggcggccgagatcgtcgtcgtccacgaccacgaggaggcggcgacggcgctggcggcgacgctccatggcggggcctgcccgccggacctctccgtcatcaccaaaatgctggaagtgctgcgccacggcgacctgtacaacaacgccgacgagatcaagaagccggtggcgctgccttctcctgtctggctgcagtttcttcagccgtacatgaggattccccaggcagcctga

SEQ ID NO: 12478 - protein, 173 aa, Sorghum bicolor
  misc_feature: Ceres ANNOT ID no. 6091216
  misc_feature (15)..(111): NCBI GI: 110738762 NCBI Desc: cytochrome c1 precursor [arabidopsis thaliana]
  misc_feature (15)..(103): NCBI GI: 17981653 NCBI Desc: at3g27240/k17e12_6 [arabidopsis thaliana]
  misc_feature (19)..(103): NCBI GI: 7547401 NCBI Desc: cytochrome c1 precursor [solanum tuberosum]
  misc_feature (27)..(102): NCBI GI: 231924 NCBI Desc: cytochrome c1, heme protein, mitochondrial precursor (clone pc18i)
  misc_feature (27)..(102): NCBI GI: 498789 NCBI Desc: cytochrome c1 [solanum tuberosum]
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: Functional homolog of the protein sequence given in SEQ ID NO 13178
MAAAAMGLLRELLRTTGTRRLCGTAVGVAAGFLSAATVASASDGAACPAYPWSPQDGARGGHKVFMQHDCAACHSGLPYAGLADEALVAGGEVEAQAAEIVVVHDHEEAATALAATLHGGACPPDLSVITKMLEVLRHGDLYNNADEIKKPVALPSPVWLQFLQPYMRIPQAA

SEQ ID NO: 12479 - DNA, 756 bp, Sorghum bicolor
  misc_feature: Ceres ANNOT ID no. 6091220
  misc_feature: Encodes the peptide sequence at SEQ ID NO 12480
atggaggaggtcggcgcggacgtgcctctcccgcgagagaagctctcctctggaccggtcagggacggaggaggccgaggtggcgtcgtgctcgtggccaccgggagcttcaatcctcccacctacatgcacctgcgcatgtttgagttggcaaaggatgaactcgagcagcgaggttattctgtgttgggcggctacatgtctccggtgaatgatgcatataagaagaaggacctcttaccagctgctcatcgaattcgcttttgtgaacttgcgtgcaaaagctcatctttcgtgatggttgatccttgggaggcaatgcagaaaggttatcagcgcactttgaccgttctttcgagagtccggaactcactgtgcaaggatggtgtagctgaccaaggtagcctaaaggtaatgcttttatgtggttctgacttgctcgagtcattcagcactccaggtgtttggatcccagaccaggtcagaaccatatgcaaggactttggtgtgatatgtatacgccgagaaggaaaggatgttggaacaatgatagccaacagtgatatattgcaagaatgcagggataacatcatttcagtcgatgagattgtgccaaatcagatcagttcatccagagtaagagactgcataagaagatgtctatcgataaagtatcttactagtgatgaagtaattgaatacattagagaacacaagctgtttatggaaactgaaggcgttgatacaacgttgtaa

SEQ ID NO: 12480 - protein, 251 aa, Sorghum bicolor
  misc_feature: Ceres ANNOT ID no. 6091220
  misc_feature (32)..(216): Pfam Id: CTP_transf_2 Pfam Desc: Cytidylyltransferase
  misc_feature (22)..(118): NCBI GI: 10442019 NCBI Desc: ufd2/d4cole1e fusion protein [mus musculus]
  misc_feature (22)..(118): NCBI GI: 11596129 NCBI Desc: d4cole1e [mus musculus]
  misc_feature (29)..(251): NCBI GI: 6323360 NCBI Desc: nad(+) salvage pathway; nicotinic acid mononucleotide adenylyltransferase [saccharomyces cerevisiae]
  misc_feature (29)..(125): NCBI GI: 20070321 NCBI Desc: nicotinamide nucleotide adenylyltransferase 1 [homo sapiens]
  misc_feature (29)..(125): NCBI GI: 18652057 NCBI Desc: nicotinamide mononucleotide adenylyl transferase [homo sapiens]
MEEVGADVPLPREKLSSGPVRDGGGRGGVVLVATGSFNPPTYMHLRMFELAKDELEQRGYSVLGGYMSPVNDAYKKKDLLPAAHRIRFCELACKSSSFVMVDPWEAMQKGYQRTLTVLSRVRNSLCKDGVADQGSLKVMLLCGSDLLESFSTPGVWIPDQVRTICKDFGVICIRREGKDVGTMIANSDILQECRDNIISVDEIVPNQISSSRVRDCIRRCLSIKYLTSDEVIEYIREHKLFMETEGVDTTL

SEQ ID NO: 12481 - DNA, 816 bp, Sorghum bicolor
  misc_feature: Ceres ANNOT ID no. 6091234
  misc_feature: Encodes the peptide sequence at SEQ ID NO 12482
atgctcctcggcgggcccctcgccgcgagcgccgcgcccctccctcgccgccgcgccgtcggcggccgccgggtcatgtccacctccgccttcgcttccgcctccgccgcgcccgcgcccgcacccgccccggggccgaggcggcggccgctgcgcggggtggtcttcgacatggacggcaccctgacggtacccgtcatcgacttccaggccatgtaccgcgaggtgctcggcggggaggcggcctacgccgcggcgctcgcggccgggggaggcgccgtcgatatcctccactgcatcgaggactgggaccccgacaagcagcgccacgcgtacgaggttatcgcgcgcttcggacaggaggggctcgaccgcctccagatcatgcccggggcctcggagctatgtggcttcctggacgcaaagcagatcagaagaggtttgatcacccgtaatgtgaaggacgcagttgatttgtttcaccaaaggtttggtatgatgttcactcctgcacttagtagagaatttcacccctataagccagatccagctccactgcttcacatatgctccacttggaacattccgccacacgaagtgatcatggtcggcgacagtctcaaggatgatgttgtttgtggaaagaaggcaggagcttttacttgcttgctcgatgaaacagggcgatatggtcctcatgattgtttgcctgaggaagttaaacctgacttcaaggtgtcctcgcttacagaagtgttcactgtgctggaggagcacttcgatttggcaccagtacctgctgagagtagaatatga

SEQ ID NO: 12482 - protein, 271 aa, Sorghum bicolor
  misc_feature: Ceres ANNOT ID no. 6091234
  misc_feature (51)..(227): Pfam Id: Hydrolase Pfam Desc: haloacid dehalogenase-like hydrolase
  misc_feature (35)..(271): NCBI GI: 115449613 NCBI Desc: os02g0816100 [oryza sativa (japonica cultivar-group)]
  misc_feature (46)..(264): NCBI GI: 140056574 NCBI Desc: had-superfamily hydrolase subfamily ia, variant 3 [medicago truncatula]
  misc_feature (51)..(263): NCBI GI: 91202548 NCBI Desc: similar to phosphoglycolate phosphatase [candidatus kuenenia stuttgartiensis]
  misc_feature (51)..(231): NCBI GI: 119773639 NCBI Desc: hydrolase, haloacid dehalogenase-like family [shewanella amazonensis sb2b]
  misc_feature (52)..(239): NCBI GI: 127513185 NCBI Desc: had-superfamily hydrolase, subfamily ia, variant 1 [shewanella loihica pv-4]
MLLGGPLAASAAPLPRRRAVGGRRVMSTSAFASASAAPAPAPAPGPRRRPLRGVVFDMDGTLTVPVIDFQAMYREVLGGEAAYAAALAAGGGAVDILHCIEDWDPDKQRHAYEVIARFGQEGLDRLQIMPGASELCGFLDAKQIRRGLITRNVKDAVDLFHQRFGMMFTPALSREFHPYKPDPAPLLHICSTWNIPPHEVIMVGDSLKDDVVCGKKAGAFTCLLDETGRYGPHDCLPEEVKPDFKVSSLTEVFTVLEEHFDLAPVPAESRI

SEQ ID NO: 12483 - DNA, 465 bp, Sorghum bicolor
  misc_feature: Ceres ANNOT ID no. 6091259
  misc_feature: Encodes the peptide sequence at SEQ ID NO 12484
atggaatgtggttgtgccatgacgatgcagccggtggttgcgacggtggtgctcaagatcggctccacggggctccactgcgacggctgcatgaaccgcatccgcagcaagctcttcaagatcaagggggtggagcaggtgcgcatggacatggccaagaaccaggtgacggtgacggggaccatggacgccaaggcactgccggagaagctgcgcaagaagctgcggcgccccgtggacgtggtggcgccgggcaaggacaaggacggcaaggagaaggacgggaaggaaggcggcggcaaggacgggaaggacggcaaggagaaggacgggaaggacgcggcgaccaaggccctgacggcggagatggaggcgtggaaggccgccttctacgaccagcagtccctgatcaacgccgagttcatgctcagcgacgagaaccccaacgcctgcgccgtcatgtga

SEQ ID NO: 12484 - protein, 154 aa, Sorghum bicolor
  misc_feature: Ceres ANNOT ID no. 6091259
  misc_feature (19)..(83): Pfam Id: HMA Pfam Desc: Heavy-metal-associated domain
  misc_feature (11)..(153): NCBI GI: 48716353 NCBI Desc: heavy-metal-associated domain-containing protein-like [oryza sativa (japonica cultivar-group)]
  misc_feature (10)..(124): NCBI GI: 4097571 NCBI Desc: gmfp5 [glycine max]
  misc_feature (11)..(117): NCBI GI: 4097545 NCBI Desc: atfp2 [arabidopsis thaliana]
  misc_feature (25)..(91): NCBI GI: 42573467 NCBI Desc: copper-binding family protein [arabidopsis thaliana]
  misc_feature (11)..(117): NCBI GI: 79326820 NCBI Desc: metal ion binding [arabidopsis thaliana]
MECGCAMTMQPVVATVVLKIGSTGLHCDGCMNRIRSKLFKIKGVEQVRMDMAKNQVTVTGTMDAKALPEKLRKKLRRPVDVVAPGKDKDGKEKDGKEGGGKDGKDGKEKDGKDAATKALTAEMEAWKAAFYDQQSLINAEFMLSDENPNACAVM

SEQ ID NO: 12485 - DNA, 3183 bp, Sorghum bicolor
  misc_feature: Ceres ANNOT ID no. 6091405
  misc_feature: Encodes the peptide sequence at SEQ ID NO 12486
  misc_feature: Down-regulated in root tissues in response to methyl jasmonate treatment
atgcccatgccaacaaaactgctccttctcgtgctcctcggctgttgttcggctcggctgttgcagcccaaacccctggcatggggtcgaggaggggaaggcaacatcctggtgctggccacgccgcgcagcctccgcagccgggcgggagaggcgctgctcgtgctcagcagcccccctgctgcaggaagaggaggaggaggaggtcgtggagggatccagcagcaggggcgaggtggaggccgcacgtctcgtggcgggagtggagcgtggcgcccacgtggtgctggtgctacacctctgcagggggctgcctcgtcatccagcccttttgctcccgagctgcgccaagcaatggaggaggctcctcgtgagctcgcaccacaagcgccaccagtgcaggcggcaggtccttcgcagccatcgccagaggctcccccgcctgttcagcctagagagactgtgcctactgggcccactgcaggccaggagattattgtgcctaccgcacctccacaatcaagcaagtcattcaggtttcctttgcgcccaggaaagggcagtattggcaccaggtgcctggttaaggccaaccatttctttgctgagctgccagacaaggatcttcatcactacgatgtctcaatcacaccggaagttacctcaagggttgttggtcgagccatcatcaaggagctggtcaatctctacaagcaatcttacttgggtgggaggctaccggcctatgatggtaggaagagcctgtacacagccggcccactgccgtttacttcacaggaatttcatatcactttatttgacgatgatggtggccctggttccgagaggcgacgtaggaatttcaaagtagtcattaaatttgctgcacgagctgacctccaccgcctcgagctctttttagctgggaggcatgcagaagctcctcaagaggcattgcaggttctggatattgtgctgcgggaactgccttcatcaaggccaagatacgcaccatttggccggtcattcttttcgcctgacttgggccgaaggcagccccttggtgatggattagaaagctggcgtggattctaccagagcattcgtcctactcaaatgggcttgtcactcaacattgatatgtcagcgacagctttcattgagccattgcctgtaatcgaatttgttgcacagctgcttaattgtgaaattcactctaggccactctcagacgcggaacgggtgaagatcaagaaagccttgcgaggagttaaggtggaagttactcatcgtggaaacatgcggagaaagtatcgaatatctgggttaacaactcaggcgactcgagagttaacctttcctgttgatgaagggggtacaataaagtcagttgtacaatactttcaagagacatatggattttccattcaacacacctaccttccttgccttcaagttggcaatcaacagcgtccaaattacttgccaatggaggtctgcaaaatagtggagggacagaggtactccaagagattaaaccagaatcagatcagagctcttttggaggagacatgccagcacccacgcgatcgtgagcgtgatataattcggatggttaaacagaatgcctatgacaaggatgattatgcacaagagtttggcattaagattagcgatcgtctggcatcagttgaggcacggattttgccagctccacggcttaagtacaatgagactggtcgagagaaggactgcttacctagggttggtcagtggaatatgatgaacaagaaaatggtagatggtggtaaggtcagaagttggatatgtgtcaattttgctcgcaatgtgcaagacagtgttgttcgtgggttctgccatgaacttgcactgatgtgccaagcgtcaggaatggatttcgctcgggagcctgttcttccacctctatatgcacgtcctgatcaagtggagcgagctctgaaagctaggtaccatgatgccatgaacgttcttggacccaaacacaaggaacttgatttacttattggaatactacctgacaacaatggctcactttatggtgatttgaagcgtgtctgtgaaatagatcttgggatagtttcacagtgctgttgcacaaagcaggttttcaaaatgaacaacaaacaaattcttgcaaatcttgctctgaagattaatgtgaagttgacatcctttaatttggcaaaggttgggggcaggaacaccgtgctggtagatgccgtctcaaggggaattcctctggtaactgatcgacctacaatcatatttggtgctgatgtgactcatcctcatcccggtgaggacagtagtccctcaattgctgctgttgtggcctcccaagattggccagaggtgacaaagtatgctggactagtttgtgctcaagctcatcggcaagagttgatagaggatttgtataaggtctggcaagatccacagagagggacagtcagcggtggaatgataagggagctacttgtatccttcaaaaaatcaactggtgagaagccccagcgaataatattttacagggatggtgtcagtgaaggacaattttatcaagttctgttgtatgagctcaatgctatccgaaaggcctgtgcctccctggaagcggagtaccaaccaaaggtgacttttgttgtggttcagaagcgccatcatactagattatttgctcacaaccacaatgatcagaattcaattgacaggagtggaaacatactcccaggtactgttgtagattcgaagatctgtcatcctactgaatttgacttctacttgtgtagccatgctggcattaagggcactagccgtccagctcattatcatgtcttgtgggatgaaaacaacttctctgctgacgagttgcagactcttacaaacaacctctgttacacttatgcaaggtgcacccgctctgtatcgatcgttccaccagcgtattatgctcacctggctgccttcagggctcgtttttacatggaaccagagacttctgacagtggatcggtggcaagtggtcctgcaggccgtggacctcagtcagcatcccatagcactcgggcccctggtggtgcagctgttaggccacttccagctctgaaggataacgtaaagagggtcatgttctactgctga

SEQ ID NO: 12486 - protein, 1060 aa, Sorghum bicolor
  misc_feature: Ceres ANNOT ID no. 6091405
  misc_feature (680)..(1010): Pfam Id: Piwi Pfam Desc: Piwi domain
  misc_feature (390)..(527): Pfam Id: PAZ Pfam Desc: PAZ domain
  misc_feature (58)..(1060): NCBI GI: 48716397 NCBI Desc: ago1 homologous protein [oryza sativa (japonica cultivar-group)]
  misc_feature (144)..(1060): NCBI GI: 21280323 NCBI Desc: ago1 homologous protein [oryza sativa (japonica cultivar-group)]
  misc_feature (29)..(1060): NCBI GI: 38344266 NCBI Desc: osjnba0005n02.3 [oryza sativa (japonica cultivar-group)]
  misc_feature (63)..(1060): NCBI GI: 84688906 NCBI Desc: ago1-1 [nicotiana benthamiana]
  misc_feature (59)..(1060): NCBI GI: 30694320 NCBI Desc: argonaute protein (ago1) [arabidopsis thaliana]
  misc_feature: The sequence is a functional homolog of SEQ ID NO 2086 in the 10/374,780US patent application
  misc_feature: Useful for making plants with modulated growth and phenotype characteristics
  misc_feature: The sequence is a functional homolog of SEQ ID NO 2086 in the 20060162006 US patent application
  misc_feature: The sequence is a functional homolog of SEQ ID NO 2086 in the 10/374,780 US patent application
  misc_feature: The sequence is a functional homolog of SEQ ID NO 152 in the 10/225,066 US patent application
  misc_feature: The sequence is a functional homolog of SEQ ID NO 238 in the 10/374,780 US patent application
  misc_feature: Down-regulated in root tissues in response to methyl jasmonate treatment
MPMPTKLLLLVLLGCCSARLLQPKPLAWGRGGEGNILVLATPRSLRSRAGEALLVLSSPPAAGRGGGGGRGGIQQQGRGGGRTSRGGSGAWRPRGAGATPLQGAASSSSPFAPELRQAMEEAPRELAPQAPPVQAAGPSQPSPEAPPPVQPRETVPTGPTAGQEIIVPTAPPQSSKSFRFPLRPGKGSIGTRCLVKANHFFAELPDKDLHHYDVSITPEVTSRVVGRAIIKELVNLYKQSYLGGRLPAYDGRKSLYTAGPLPFTSQEFHITLFDDDGGPGSERRRRNFKVVIKFAARADLHRLELFLAGRHAEAPQEALQVLDIVLRELPSSRPRYAPFGRSFFSPDLGRRQPLGDGLESWRGFYQSIRPTQMGLSLNIDMSATAFIEPLPVIEFVAQLLNCEIHSRPLSDAERVKIKKALRGVKVEVTHRGNMRRKYRISGLTTQATRELTFPVDEGGTIKSVVQYFQETYGFSIQHTYLPCLQVGNQQRPNYLPMEVCKIVEGQRYSKRLNQNQIRALLEETCQHPRDRERDIIRMVKQNAYDKDDYAQEFGIKISDRLASVEARILPAPRLKYNETGREKDCLPRVGQWNMMNKKMVDGGKVRSWICVNFARNVQDSVVRGFCHELALMCQASGMDFAREPVLPPLYARPDQVERALKARYHDAMNVLGPKHKELDLLIGILPDNNGSLYGDLKRVCEIDLGIVSQCCCTKQVFKMNNKQILANLALKINVKLTSFNLAKVGGRNTVLVDAVSRGIPLVTDRPTIIFGADVTHPHPGEDSSPSIAAVVASQDWPEVTKYAGLVCAQAHRQELIEDLYKVWQDPQRGTVSGGMIRELLVSFKKSTGEKPQRIIFYRDGVSEGQFYQVLLYELNAIRKACASLEAEYQPKVTFVVVQKRHHTRLFAHNHNDQNSIDRSGNILPGTVVDSKICHPTEFDFYLCSHAGIKGTSRPAHYHVLWDENNFSADELQTLTNNLCYTYARCTRSVSIVPPAYYAHLAAFRARFYMEPETSDSGSVASGPAGRGPQSASHSTRAPGGAAVRPLPALKDNVKRVMFYC

SEQ ID NO: 12487 - DNA, 2799 bp, Sorghum bicolor
  misc_feature: Ceres ANNOT ID no. 6091510
  misc_feature: Encodes the peptide sequence at SEQ ID NO 12488
atggctgacgatgcttctcacggggccagcagctcgactgtgaaacctgctgatgatccagagtctaccatcgagatcaacatcaagaccctggattcacaagtccacaaacttcgcgtggagaagaatgcacctgtttccgttctaaaagagaaggttgttgaagcgactggggttccattggatcagcagcgcttgatttttagaggaagagtcttgaaggatgatcacctcctatcagaatacccagagggccagaattcttctggggctcctgaaggaaatacacatgctaatgtaaacgttactggaaatgaaggattgttggatgatatttccaggagtgttcgggatcttctgggttccttaggtgttgcaatgtctggtggtgtcactaacactgcattttcggttcctttgactaccgcgccagaaggacccaataatgtgcccggaagaactcagccaatgaacccagcgcaaccaggattctcagttctaaatcatcaaatacaagtaacacaacttcagccgccaggagctattcctcgcaacatgattattccagattctttgacaactctttcggagtacatggatcgcattgaccaagtactacagaataatggtgctccaccatccagggattcagaaagccagcaacaaccgacagtggatgatgctaatgtcaacccaagatacccaagtcctgatgttttggcttcagttattgagagagcccaacaacttcttggcggcagtgcagcttctgctctttcgcacattgcacaacgtattcggcaagatggtgagactgcggatgcatctcttcgtcgtgagatccagactgaatctgttcagctaggaatttcgatgcaacatttgggtgctatgttttttgagcttggtcggacgatgatgatgctccgcacagggcgatctccttctgaggcttttgtaaattctgggcctgctgtttatataaactccacaggaccaaaccctatcatggttcagccatcttatcaaaacacccctccttttggtgtctccaatataccagttatgggtggaatttctggtgcttttggtattgttgatccttctcgatcatctggttttggtgatccttttcgacgtatgaatgtcccaagtaccggtgcatctgcaacaagtggttcagctgctggtactaccaccacttctgaaggagctatcaacgggaaccgccaagatgcggcaagaactcaaggaggtaacccaccaggtcacccggctgcaacacgtggattgccaaccagaacagttgttgctgctgttccagcacggtcctcagtcgaggctccaaaccatgtctttagtgttatcctgcctgttcaagtgaggggtcaagttgcagtgcctactcagtcctctcaaggttctcaaacagcagtgggcaatggagctcaaggaaattcaacatctgctgttccacaagcttctgttggtggtgtttctggtgttcctcctatagtggcacaggtagccaatgcattggccacaaatgcaccaagccaggtttctttatctacagaaactgcagcagatcagggatttcacccgaccacagacagcagagcagttctgaattcttcaacaccagccactacatcactgcagaatgatccctcaggtattttgggttccagtttgccacctcaagacaggaatactttaaatgttcccagtcttgactgtatacaacaacatcctcaatttggagatacttgtgcagatacagctgacttatcaggagactccacagccaccaatactcatgatgttccttcgaacacatcaatagaaaattctgcgctgaagaataaatcctcggatgaagtaggttcacagctcactgagccttctgcaagtggcagtgctgaaccattaggtcttggtggaggtctgattccgaagaaacggagcagagcagtaaaaccatctgggagcacaactgatcctggtagggattcatcatcagtcagccaaaaccaagatcctatttcagtggcccagcagtttctggaaggttttgcttctcggaatactaatgctagcagaagcaatgcccctgcctctggtcctccatcctctgtgccacagcctactgaagttcctctgagaagacagggtggtggacaacctgatattggcagcatgatatctggtatgctcaacaacccagttttcagcaacatattgtcaaatgtcgcaacacaagcagggggttcaagtgctgatttgaggggcgtgatggaaggattacagagccctgctgttgtagatacaataagcagtattgtgcagaatgtggatgagcaagaccttggggccatgtttggttcaggcagggggcaaggtggcctggatttgtcaagaatgttgcagcaaatgatgcctgttgtatcccaggctcttggtggcgcagggggccgttctgctggtgcaaatagtagacaatctaggtcatggcctcagcgcattgacagtggaggaggaaatgtaccagctagcagcagttctcagattgatctccatcaagctcgtgaaagcattgaacaacatgaatctccagagaatatcttcagctctgtccttgaaactgctgctcaggcctatggtgaagatgacagcattcagggaatgatcgaagagcttgccagtgatcaagagcttaccgatgaatacttgaagtttttggtggaacaagttcggcagagggtacagtcagagtcgcagtcgacgagccagccttga

SEQ ID NO: 12488 - protein, 932 aa, Sorghum bicolor
  misc_feature: Ceres ANNOT ID no. 6091510
  misc_feature (29)..(92): Pfam Id: ubiquitin Pfam Desc: Ubiquitin family
  misc_feature (1)..(918): NCBI GI: 115472225 NCBI Desc: os07g0498800 [oryza sativa (japonica cultivar-group)]
  misc_feature (1)..(918): NCBI GI: 29420481 NCBI Desc: calreticulin interacted protein [oryza sativa]
  misc_feature (106)..(789): NCBI GI: 30102508 NCBI Desc: at5g42220/k5j14_2 [arabidopsis thaliana]
  misc_feature (171)..(488): NCBI GI: 92872212 NCBI Desc: at5g42220/k5j14_2 [medicago truncatula]
  misc_feature (314)..(855): NCBI GI: 72547041 NCBI Desc: proteophosphoglycan ppg1 [leishmania major]
MADDASHGASSSTVKPADDPESTIEINIKTLDSQVHKLRVEKNAPVSVLKEKVVEATGVPLDQQRLIFRGRVLKDDHLLSEYPEGQNSSGAPEGNTHANVNVTGNEGLLDDISRSVRDLLGSLGVAMSGGVTNTAFSVPLTTAPEGPNNVPGRTQPMNPAQPGFSVLNHQIQVTQLQPPGAIPRNMIIPDSLTTLSEYMDRIDQVLQNNGAPPSRDSESQQQPTVDDANVNPRYPSPDVLASVIERAQQLLGGSAASALSHIAQRIRQDGETADASLRREIQTESVQLGISMQHLGAMFFELGRTMMMLRTGRSPSEAFVNSGPAVYINSTGPNPIMVQPSYQNTPPFGVSNIPVMGGISGAFGIVDPSRSSGFGDPFRRMNVPSTGASATSGSAAGTTTTSEGAINGNRQDAARTQGGNPPGHPAATRGLPTRTVVAAVPARSSVEAPNHVFSVILPVQVRGQVAVPTQSSQGSQTAVGNGAQGNSTSAVPQASVGGVSGVPPIVAQVANALATNAPSQVSLSTETAADQGFHPTTDSRAVLNSSTPATTSLQNDPSGILGSSLPPQDRNTLNVPSLDCIQQHPQFGDTCADTADLSGDSTATNTHDVPSNTSIENSALKNKSSDEVGSQLTEPSASGSAEPLGLGGGLIPKKRSRAVKPSGSTTDPGRDSSSVSQNQDPISVAQQFLEGFASRNTNASRSNAPASGPPSSVPQPTEVPLRRQGGGQPDIGSMISGMLNNPVFSNILSNVATQAGGSSADLRGVMEGLQSPAVVDTISSIVQNVDEQDLGAMFGSGRGQGGLDLSRMLQQMMPVVSQALGGAGGRSAGANSRQSRSWPQRIDSGGGNVPASSSSQIDLHQARESIEQHESPENIFSSVLETAAQAYGEDDSIQGMIEELASDQELTDEYLKFLVEQVRQRVQSESQSTSQP

SEQ ID NO: 12489 - DNA, 300 bp, Sorghum bicolor
  misc_feature: Ceres ANNOT ID no. 6091618
  misc_feature: Encodes the peptide sequence at SEQ ID NO 12490
atggacaaccccgagatgcagcgattccttcagattgtgaattcataccgttacttgatgataatagatacattgaatcatattaccgcttctccaatttctgcaacactgcagcaagagcagcaaaaggcgatgatgaacgagatggttggcaagctaacgagcgtgtgctgggacaaatgcatcaccagcgctcccggaagcaagttcagctctggggaatcaacctgcctgaccaactgcgcccagaggtttctcgacatgagcgtgctgattgccaaacgctttgagatgcagtga

SEQ ID NO: 12490 - protein, 99 aa, Sorghum bicolor
  misc_feature: Ceres ANNOT ID no. 6091618
  misc_feature (34)..(99): Pfam Id: zf-Tim10_DDP Pfam Desc: Tim10/DDP family zinc finger
  misc_feature (37)..(92): NCBI GI: 5107157 NCBI Desc: small zinc finger-like protein [malus x domestica]
  misc_feature (49)..(99): NCBI GI: 140060063 NCBI Desc: zinc finger, tim10/ddp-type [medicago truncatula]
  misc_feature (37)..(97): NCBI GI: 145350028 NCBI Desc: mpt family transporter: inner membrane translocase (import) tim8 [ostreococcus lucimarinus cce9901]
  misc_feature (22)..(99): NCBI GI: 90101780 NCBI Desc: mitochondrial import inner membrane translocase subunit tim8
  misc_feature (31)..(96): NCBI GI: 87248417 NCBI Desc: translocase of inner mitochondrial membrane 8 homolog b [bombyx mori]
MDNPEMQRFLQIVNSYRYLMIIDTLNHITASPISATLQQEQQKAMMNEMVGKLTSVCWDKCITSAPGSKFSSGESTCLTNCAQRFLDMSVLIAKRFEMQ

SEQ ID NO: 12491 - DNA, 624 bp, Sorghum bicolor
  misc_feature: Ceres ANNOT ID no. 6091644
  misc_feature: Encodes the peptide sequence at SEQ ID NO 12492
atgacggcgcaggctgcggaggagctcgccgcccagatcgagcagcagaagctcgaggagcagaagaccgaggcagaggaggttgtggtggaggatgaggacgatgatgacgaggacgatgacgatgatgacaaggatgatgatgaattggatggacatgaaggggatgccagtggcaagtccaagcaaagcaggagtgagaagaagagccgcaaggccatgctgaagcttggcatgaagcccatcactggtgtcagccgcgtcactgtgaagaaaagcaagaatatgctttttgtcatctccaagccagatgtgttcaagagcccgaattcagacacctacgtcatatttggcgaggccaagatcgaggacctcagctctcagctgcagacccaggctgcagaacagttcaaggctcctgacttgagccaaatgatctcgaagcctgagacatctggcctgggtcaggaggacaatgaggaggaggttgacgaaactggtgttgaggccaaggacattgagctggtcatgacccaggcaactgtttcgagggccaaggctgtcaaggctctcaaggcttctaatggggacatcgtcactgccattatggagttgactaattag

SEQ ID NO: 12492 - protein, 207 aa, Sorghum bicolor
  misc_feature: Ceres ANNOT ID no. 6091644
  misc_feature (65)..(124): Pfam Id: NAC Pfam Desc: NAC domain
  misc_feature (168)..(205): Pfam Id: UBA Pfam Desc: UBA/TS-N domain
  misc_feature (7)..(206): NCBI GI: 115463539 NCBI Desc: os05g0373700 [oryza sativa (japonica cultivar-group)]
  misc_feature (1)..(207): NCBI GI: 124484511 NCBI Desc: alpha chain of nascent polypeptide associated complex [nicotiana benthamiana]
  misc_feature (1)..(207): NCBI GI: 87241023 NCBI Desc: nascent polypeptide-associated complex nac; uba-like [medicago truncatula]
  misc_feature (1)..(206): NCBI GI: 71151986 NCBI Desc: nascent polypeptide-associated complex alpha subunit-like protein 3 (nac-alpha-like protein 3) (alpha-nac-like protein 3)
  misc_feature (1)..(206): NCBI GI: 71151999 NCBI Desc: nascent polypeptide-associated complex alpha subunit-like protein (nac-alpha-like protein) (alpha-nac-like protein)
MTAQAAEELAAQIEQQKLEEQKTEAEEVVVEDEDDDDEDDDDDDKDDDELDGHEGDASGKSKQSRSEKKSRKAMLKLGMKPITGVSRVTVKKSKNMLFVISKPDVFKSPNSDTYVIFGEAKIEDLSSQLQTQAAEQFKAPDLSQMISKPETSGLGQEDNEEEVDETGVEAKDIELVMTQATVSRAKAVKALKASNGDIVTAIMELTN

SEQ ID NO: 12493 - DNA, 669 bp, Sorghum bicolor
  misc_feature: Ceres ANNOT ID no. 6091692
  misc_feature: Encodes the peptide sequence at SEQ ID NO 12494
atggctcagcagaagaacgcgcacgtgcccaagttcggcaactgggacaacgacggcaacgtgccgtacacgctctacttcgacaacgcgcgcaagggcaagggcgccggcggcaagatgatcaaccccaacgaccccgccgagaacccggaggccttctccatggccgcgccgtcgccggcgcagacgcctccgcggcacgagcgccggcccagcgacgcgccgccgccggcgcccgtgtcgcccaacccctacgccgggtcgccgtaccatcaccgccacggcggaagaggcggcgggcgggccgccgccggcgggtacagcgtcgagcagtcgcccgtgcacccttacagcacctccgagagcgccgggtacggcctcgtggccaactccgtcgaccggtcccgcgccaagggcggctcccgcggcaacgagacgccgacgaggggctcggcggtgcccaagttcggcgactgggactcgaacccggcgtcggcggaaggctacacgcacatcttcaacaaggtgagggaggagaagcagacgcaggcagggaagccggcggcgtacggcaaggacggcggcgcgcgtggcaacggcgccaagcagcaccacgacgacggctacgtctcatcgaaattctcgtgctttggatggtgcaagcagtag

SEQ ID NO: 12494 - protein, 222 aa, Sorghum bicolor
  misc_feature: Ceres ANNOT ID no. 6091692
  misc_feature (144)..(218): Pfam Id: NOI Pfam Desc: Nitrate-induced NOI protein
  misc_feature (54)..(221): NCBI GI: 115477405 NCBI Desc: os08g0526400 [oryza sativa (japonica cultivar-group)]
  misc_feature (1)..(219): NCBI GI: 146150661 NCBI Desc: resistance-gene-interacting protein [brassica juncea]
  misc_feature (6)..(216): NCBI GI: 92878919 NCBI Desc: nitrate-induced noi [medicago truncatula]
  misc_feature (6)..(216): NCBI GI: 92884327 NCBI Desc: nitrate-induced noi [medicago truncatula]
  misc_feature (1)..(53): NCBI GI: 19387536 NCBI Desc: nitrate-induced noi-like protein [elaeis oleifera]
MAQQKNAHVPKFGNWDNDGNVPYTLYFDNARKGKGAGGKMINPNDPAENPEAFSMAAPSPAQTPPRHERRPSDAPPPAPVSPNPYAGSPYHHRHGGRGGGRAAAGGYSVEQSPVHPYSTSESAGYGLVANSVDRSRAKGGSRGNETPTRGSAVPKFGDWDSNPASAEGYTHIFNKVREEKQTQAGKPAAYGKDGGARGNGAKQHHDDGYVSSKFSCFGWCKQ

SEQ ID NO: 12495 - DNA, 1926 bp, Sorghum bicolor
  misc_feature: Ceres ANNOT ID no. 6091772
  misc_feature: Encodes the peptide sequence at SEQ ID NO 12496
atgatcctccgcagcgcactaagggccggtcgcggcctcaggcgggttcccctggttcatctcattgtggagcacggtgagccgtcccgagcaccaccccggtgtgctactgatacccgggatgttgaagaaccatcagctgtgttgaattggtggggggtcagtccaattggtcatcggtatcagttgcgggcttactcggctgcagctgcacacgttaggggtgagaaaccgttggattgtgctaatgaggtggtaatgatggatggggaggtcaagcgaatgaagaagatgcgggtgttctggaccgctcagcggactttcatggagtacctccatgtcacacgggggctgagctttttggatgccgagcatataagcaagcactcacctgcctttgtgagcaagctgctgaaccaggtgaaggatgctatcaaggaccctgtggaagggggtgaggcagtgttcaggtcaaaggtgaagacaagggagatgagggatgagagggccactactgcgttgcagcgtctgttcaggtatcatccgatcaatgagtttgagccattcttcgagagcatgggcttaaagccgagtgagtatgaatcctttctgcctcaggatctcatgtttctatccgatgacgaggcattgctggagaactaccgtgttctttgcaattatggggttatgcgcactaagattggggggatatacagggatgctggggaggttttcagttttggtgatggtgtgcttgcgtctaagctaagagctattgaggatctagggttcagtaagaccactgtgataaaacttgtgacctgttgccctgcggtattgacacgtggcccgcatgctgaattgaagatcataaagtggctagatgacactggcattcagagagactggattggtcaattcttatctataaagaagtcgtataattggagaaagatggtcgaagttcctcaattttttactgaattaggatttgataaggagggtattggtaaattgatcagacaacacccagatttcttgttggatggttctggaaaggcactgtttagggcagttgccatcatgctgaaagcagggtctggaaaagaagatctatttgatcttttcctggacttcccagatgtacaggccaggagtttcgcaaggaacatacagagtcttatactattcttaactgaaattgatgtaagcgaggaggatattaagaagtttgtggtagcaaatgcatcaatgcttggttctgctcgagtgaagaaggcaaacagcattcttacatatctcaatgtggggaagaggcgtttgtggaggattataatggaagagccacacgaactgatgaaatatgcattagggttaaaggtcaaccgcctaccgccttatgacaggactgagaaatcactgaaggagaaggtgaaatttttgaaaaacataggatttgaggaaggctctgatgatatgaacaaggcactgaaaactttccgtggtaagggtgatcagctacaagatcggtttgactttttggtgaagactggatttgaacccaaggatgtatcgaaaatgatcaaagtagcaccgcaggttctgaatcagaagatacatgtccttgagtccaagatagcattccttttaaatgagacatcatatcctctaagtgctctggttggataccctgcatacttgtcgttcactatagagagaaccaaagctaggtttctaatgtacaattggctgcgagaaaaagggctggttcctcctaatcttgctctatccaccttattagcttgttcagagaagcggtttcttaaatatctggtcctaaaacatgaaaagggtccagaagtctgggagaagttgaagaaagaggtagttgcagacaaaaacatgcactgtactgcagatgattag

SEQ ID NO: 12496 - protein, 641 aa, Sorghum bicolor
  misc_feature: Ceres ANNOT ID no. 6091772
  misc_feature (323)..(609): Pfam Id: mTERF Pfam Desc: mTERF
  misc_feature (217)..(627): NCBI GI: 22327586 NCBI Desc: mitochondrial transcription termination factor-related / mterf-related [arabidopsis thaliana]
  misc_feature (279)..(617): NCBI GI: 92885872 NCBI Desc: mterf [medicago truncatula]
  misc_feature (470)..(616): NCBI GI: 3367528 NCBI Desc: strong similarity to gi2160138 f19k23.6 gene product from a. thaliana bac gbac000375. [arabidopsis thaliana]
  misc_feature (279)..(617): NCBI GI: 140044566 NCBI Desc: mitochodrial transcription termination factor-related [medicago truncatula]
  misc_feature (254)..(621): NCBI GI: 3367526 NCBI Desc: strong similarity to gi2160136 f19k23.4 gene product from a. thaliana bac gbac000375. [arabidopsis thaliana]
MILRSALRAGRGLRRVPLVHLIVEHGEPSRAPPRCATDTRDVEEPSAVLNWWGVSPIGHRYQLRAYSAAAAHVRGEKPLDCANEVVMMDGEVKRMKKMRVFWTAQRTFMEYLHVTRGLSFLDAEHISKHSPAFVSKLLNQVKDAIKDPVEGGEAVFRSKVKTREMRDERATTALQRLFRYHPINEFEPFFESMGLKPSEYESFLPQDLMFLSDDEALLENYRVLCNYGVMRTKIGGIYRDAGEVFSFGDGVLASKLRAIEDLGFSKTTVIKLVTCCPAVLTRGPHAELKIIKWLDDTGIQRDWIGQFLSIKKSYNWRKMVEVPQFFTELGFDKEGIGKLIRQHPDFLLDGSGKALFRAVAIMLKAGSGKEDLFDLFLDFPDVQARSFARNIQSLILFLTEIDVSEEDIKKFVVANASMLGSARVKKANSILTYLNVGKRRLWRIIMEEPHELMKYALGLKVNRLPPYDRTEKSLKEKVKFLKNIGFEEGSDDMNKALKTFRGKGDQLQDRFDFLVKTGFEPKDVSKMIKVAPQVLNQKIHVLESKIAFLLNETSYPLSALVGYPAYLSFTIERTKARFLMYNWLREKGLVPPNLALSTLLACSEKRFLKYLVLKHEKGPEVWEKLKKEVVADKNMHCTADD

SEQ ID NO: 12497 - DNA, 1197 bp, Sorghum bicolor
  misc_feature: Ceres ANNOT ID no. 6091907
  misc_feature: Encodes the peptide sequence at SEQ ID NO 12498
atggccaccggcggggagaagcgggcggcgctgctgcggcagataacggaggagggcgggttcgcgttcgtggcctcggcggagaaggcggccgcgggggacctccgcgcggccgaggcggcgcgggagatggcgtgggagcagctgcactcggcgccccgtgccgaggccggcgccgccgcgtggcgggacgcctacgcgctcgcctgcctccacgtcgccggcctccgcgccgccgccggcgaccgcagcgccgcgctccgggcgctcgacatggggctcatcatgggtgggggcctcctacgcgccgagctcgacgacgccatcgcggggctcggccgcggcgaggcggccgcggtcccggtcgccgatggggatgtgcagaggtgggaggaagggatcgcgcggggccgagaccttgccgatgtactgaaacttctgccagtgaattccctatcttgtaagcaaattgagaggcgatcatgcatttcattggaggcatttatacgtgattactttttatgtgagtcccctgttatactcagtggatgcattgagcattggcctgcaaggacaaagtggaaggacataaagtacctacagagtatagctggagatcggactattcctgttcaggttggaaaaaattatgcatgtactgagttgaaacaggagcttatcacattttctcaatttcttgagaggatgtggtcaagtgattctgcaaacttggcttgtttagcgcagcatcaattgtttgaccagataaaggagctccacgaagacatttctgttcctgagtactgtttagctggcggtggcaaactccagtcacttaatgcttggttcggtcctcatgggacaataactccattgcatcatgacccacatcacaaccacctttttgctcaggttttgggaaggaagtatgttagactctatcctgcctctatatccgtgggcctataccctaacccagaaagcatgctaagcaatactagtcaggtagatcttgacaacattgatgaaaaagagcacccgaagactgcagctcttgaattcatggattgcatattggaggaaggtgacctgctttacattcccccaaaatggtggcattacgtgagatctctttctattagcttttctgttagcttttggtggcgaacgtcagatcttccttcaggaagttcataa

SEQ ID NO: 12498 - protein, 398 aa, Sorghum bicolor
  misc_feature: Ceres ANNOT ID no. 6091907
  misc_feature (280)..(388): Pfam Id: JmjC Pfam Desc: JmjC domain
  misc_feature (2)..(213): NCBI GI: 42409345 NCBI Desc: n-acetyltransferase and transcription factor-like protein [oryza sativa (japonica cultivar-group)]
  misc_feature (2)..(305): NCBI GI: 115479879 NCBI Desc: os09g0489200 [oryza sativa (japonica cultivar-group)]
  misc_feature (11)..(398): NCBI GI: 21928039 NCBI Desc: at3g20810/moe17_10 [arabidopsis thaliana]
  misc_feature (2)..(213): NCBI GI: 115477200 NCBI Desc: os08g0508500 [oryza sativa (japonica cultivar-group)]
  misc_feature (11)..(376): NCBI GI: 79313307 NCBI Desc: transcription factor [arabidopsis thaliana]
  misc_feature: The sequence is a functional homolog of SEQ ID NO. 293 in the 11/188,298 US application
MATGGEKRAALLRQITEEGGFAFVASAEKAAAGDLRAAEAAREMAWEQLHSAPRAEAGAAAWRDAYALACLHVAGLRAAAGDRSAALRALDMGLIMGGGLLRAELDDAIAGLGRGEAAAVPVADGDVQRWEEGIARGRDLADVLKLLPVNSLSCKQIERRSCISLEAFIRDYFLCESPVILSGCIEHWPARTKWKDIKYLQSIAGDRTIPVQVGKNYACTELKQELITFSQFLERMWSSDSANLACLAQHQLFDQIKELHEDISVPEYCLAGGGKLQSLNAWFGPHGTITPLHHDPHHNHLFAQVLGRKYVRLYPASISVGLYPNPESMLSNTSQVDLDNIDEKEHPKTAALEFMDCILEEGDLLYIPPKWWHYVRSLSISFSVSFWWRTSDLPSGSS

SEQ ID NO: 12499 - DNA, 1281 bp, Sorghum bicolor
  misc_feature: Ceres ANNOT ID no. 6091953
  misc_feature: Encodes the peptide sequence at SEQ ID NO 12500
atgttgtccgaccaggagctggcccagtacgtggagtccttcgtgcagcacaccgccgcgcagggcggcaccgggatatcggcggatgccgtggtgcgccagctcggggcgcagctcggcgtcgacctctcccccaaggcgcacctcatccgcagcgtcctcgtcgcgctcctaggccccgctgccgcgccggcgccggaccccgccgcctcgcggaaggaccatttcgaccccgcgaccgccgccggcgggggcgcccgcgccgaggctcctgcgcagcagcagctgcccttctccacctccaccgccgccgcgtcgtcggcccccgccccggcgcccgccgttccccacttcttcccgcagcagcaccagcaccagatgcagtctttcctctccgccccgcagcagtaccagcaccagcagcagcaacgcgccggcgggcctccctctccgttcgacgtccccgcgtcgtaccgctacgggcaccagcccttcgcccaggctgaccaggcccagctgcagaggctcgtccagctacagcagcatcagcagcaacagcagttggctgccgcggcgagagctgcggctgcagcggcacccactccggcggagagcccccgtgcgcgggcgccggcaacggcgccggctggctccaagaaggacagtgctagtgctggagcaaaacgaagaggtggtcctggagggttaaacaaagtctgcggtgtgtctccagagctgcaagctattgttggtgaaccagccatggctagaactgagattgttaagcagctttgggcgtacattcgcaggaacaatttgcaagatcctaacaataagagaaagattatatgcaatgatgagctccgattagtttttgagactgatagcacagacatgttccagatgaataagcttctgtctaagcatatacgtcctctggagagtaaaaatgattcaaaacgagaagcaaaaaaattgaagccagagggtggtgaacaaattcctaaagttgaaactgatgttaaccaacttccccttacggtttctgatgctcttgctaccttttttggtacgggagaaagagaaatggtccattctgaggctgttaagcgtgtctgggagcacattaaaagcaataatttagaggatccagagaatcctacagtgatactgtgtgactccaaacttaaacaactctttggatgtgaaagtcttgctgctcatggtgtctcagagttgctttcagaccacctttacaagcagcaatctaccaagatctga

SEQ ID NO: 12500 - protein, 426 aa, Sorghum bicolor
  misc_feature: Ceres ANNOT ID no. 6091953
  misc_feature (236)..(311): Pfam Id: SWIB Pfam Desc: SWIB/MDM2 domain
  misc_feature (342)..(419): Pfam Id: SWIB Pfam Desc: SWIB/MDM2 domain
  misc_feature (90)..(421): NCBI GI: 42408131 NCBI Desc: parathymosin-like [oryza sativa (japonica cultivar-group)]
  misc_feature (91)..(421): NCBI GI: 32488657 NCBI Desc: osjnba0087o24.7 [oryza sativa (japonica cultivar-group)]
  misc_feature (91)..(421): NCBI GI: 116308843 NCBI Desc: h1005f08.9 [oryza sativa (indica cultivar-group)]
  misc_feature (219)..(422): NCBI GI: 15230276 NCBI Desc: swib complex baf60b domain-containing protein [arabidopsis thaliana]
  misc_feature (219)..(340): NCBI GI: 42562626 NCBI Desc: swib complex baf60b domain-containing protein [arabidopsis thaliana]
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
  misc_feature: Useful for making plants with modulated drought sensitivity
  misc_feature: GREAT-hit functional homolog of the protein sequence given in SEQ ID NO 12918
  misc_feature: Useful for making plants with modulated biomass
  misc_feature: Useful for making plants with modulated drought sensitivity
  misc_feature: Useful for making plants with modulated flowering time
  misc_feature: Functional homolog of the protein sequence given in SEQ ID NO 12918
MLSDQELAQYVESFVQHTAAQGGTGISADAVVRQLGAQLGVDLSPKAHLIRSVLVALLGPAAAPAPDPAASRKDHFDPATAAGGGARAEAPAQQQLPFSTSTAAASSAPAPAPAVPHFFPQQHQHQMQSFLSAPQQYQHQQQQRAGGPPSPFDVPASYRYGHQPFAQADQAQLQRLVQLQQHQQQQQLAAAARAAAAAAPTPAESPRARAPATAPAGSKKDSASAGAKRRGGPGGLNKVCGVSPELQAIVGEPAMARTEIVKQLWAYIRRNNLQDPNNKRKIICNDELRLVFETDSTDMFQMNKLLSKHIRPLESKNDSKREAKKLKPEGGEQIPKVETDVNQLPLTVSDALATFFGTGEREMVHSEAVKRVWEHIKSNNLEDPENPTVILCDSKLKQLFGCESLAAHGVSELLSDHLYKQQSTKI

SEQ ID NO: 12501 - DNA, 810 bp, Sorghum bicolor
  misc_feature: Ceres ANNOT ID no. 6092029
  misc_feature: Encodes the peptide sequence at SEQ ID NO 12502
atgcagcacgccgccgcggtctctaacaaccttcaccctgccgtcgccaccacatcgtcccctgctcctcgtcgtgcgagctggcccaatgctcgaccctcgtcgtcggtaagggtacgttcctcctcctcctcctccatgaggaacggcggcggcggcaatggctctgcctccacggatagcctggaccacctgcagagggcgtccatggccaggcagcgtcagcagcagcagcagcagccgaggcctagaagggtcatccacaccacaccgttcgggctgtgggacagcttcccggaagcgaggacgctggaccagatggtgcggaccatggagcgcctcatggacggcgacgacgacgtccgcttcggcgtcgtcgtgccggcagcggacgcggcggcggcgggggctcccaccgccgtgccgcgcgccgaccacgggcggcgggggcggacgccgtgggaggtcagggatcgcgcgggggagtacctggtccggttcgacatgccggggatggcgcgggacgacgtgcgcgtcagcgtgcaggaccggacgctcgtcgtggtcgccgagaagaagcaacctgctgctggcgctgatgagaagcaggaagcggctggcagtggctacgaggaggaggagggggaggcgtggccggcggcgagcttcgggcggtacaggacgcgggtggagctgccggagaacgtggacgtggagaggatcgccgccgaggtgaaggacggcgtgctgtacctcaccatacccaagctgtcggcgggcggcaaggtcgtcaacatccaggtgcactga

SEQ ID NO: 12502 - protein, 269 aa, Sorghum bicolor
  misc_feature: Ceres ANNOT ID no. 6092029
  misc_feature (155)..(269): Pfam Id: HSP20 Pfam Desc: Hsp20/alpha crystallin family
  misc_feature (118)..(268): NCBI GI: 86439765 NCBI Desc: hsp20 protein [triticum aestivum]
  misc_feature (60)..(268): NCBI GI: 92877537 NCBI Desc: heat shock protein hsp20 [medicago truncatula]
  misc_feature (151)..(268): NCBI GI: 14158 NCBI Desc: heat shock protein [petunia x hybrida]
  misc_feature (143)..(268): NCBI GI: 88766401 NCBI Desc: heat shock protein 22 [metarhizium anisopliae]
  misc_feature (60)..(231): NCBI GI: 134103862 NCBI Desc: chloroplast small heat shock protein [epilobium amurense]
  misc_feature: Useful for making plants with modulated heat sensitivity
  misc_feature: Functional homolog of the protein sequence encoded by LOCUS at4g27670
  misc_feature: The sequence is a functional homolog of SEQ ID NO. 374 in the 11/188,298 US application
MQHAAAVSNNLHPAVATTSSPAPRRASWPNARPSSSVRVRSSSSSSMRNGGGGNGSASTDSLDHLQRASMARQRQQQQQQPRPRRVIHTTPFGLWDSFPEARTLDQMVRTMERLMDGDDDVRFGVVVPAADAAAAGAPTAVPRADHGRRGRTPWEVRDRAGEYLVRFDMPGMARDDVRVSVQDRTLVVVAEKKQPAAGADEKQEAAGSGYEEEEGEAWPAASFGRYRTRVELPENVDVERIAAEVKDGVLYLTIPKLSAGGKVVNIQVH

SEQ ID NO: 12503 - DNA, 969 bp, Sorghum bicolor
  misc_feature: Ceres ANNOT ID no. 6092600
  misc_feature: Encodes the peptide sequence at SEQ ID NO 12504
atgagtctgcagattccggtgagatcaggcgccctccgccgcctcctccttctaggtggcgctgggggtctcccgcgcccctactccaccgacgaccggcggaggcgggtgatccgcgaggcaaggcaagaggaggaggacgaggcgttcctccgcaccctcaacttcggcgccgaccccgagaacaacccccttcccccgccgccgaggcgtggcaggggattatctgacgcctccgccgggaagcagcagcagcagcccgagcgaagcgcgcagaaggtcgtcggggagacgctgctgcagaagcttaagctgggcgatggtccctccgccgccgctgccgccgctacgggaggcggcgatgagctgcggcagcctgaggacgagcctgcgcccgcgcagccggtggacgtggatgagatcttccgaaagatgaaggagaccgggctgatccccaacgccgtggccatgcttgacgggctgtgcaagaacggcctggtccaggacgccatgaagctgttcggcctgatgcgagagaagggagccatcccggaggtggttatctacacagctgtcgtcgaggcattctgcaaggcagccaagctcgacgacgccgtgaggattttcaggaagatgcaagggaatggagtcatccccaacgcattcagctactggctcctgatacaggggctgtacaaggggggcaggctggatgatgctgttgggttctgtgtggagatgtttgaggctgggcttgcgccgaatgctgagacgtttgtaggcttgcttgatgcagtgtgcaagacaaaaggggtggatgatggtgagaagcttgtgaggagcttccaggacaggaactttgctattgatgagaagtcaatcagggagcacctggacaagaaaggcccattctcaccagtggtgtgggaggtgatctttggcaaaagaaaatcaggccgacctttataa

SEQ ID NO: 12504 - protein, 322 aa, Sorghum bicolor
  misc_feature: Ceres ANNOT ID no. 6092600
  misc_feature (152)..(186): Pfam Id: PPR Pfam Desc: PPR repeat
  misc_feature (187)..(221): Pfam Id: PPR Pfam Desc: PPR repeat
  misc_feature (222)..(256): Pfam Id: PPR Pfam Desc: PPR repeat
  misc_feature (64)..(321): NCBI GI: 20146451 NCBI Desc: osjnba0026j14.18 [oryza sativa (japonica cultivar-group)]
  misc_feature (50)..(321): NCBI GI: 23505863 NCBI Desc: at4g38150/f20d10_270 [arabidopsis thaliana]
  misc_feature (128)..(316): NCBI GI: 140062526 NCBI Desc: pentatricopeptide repeat [medicago truncatula]
  misc_feature (141)..(278): NCBI GI: 30677982 NCBI Desc: pentatricopeptide (ppr) repeat-containing protein [arabidopsis thaliana]
  misc_feature (136)..(279): NCBI GI: 144923591 NCBI Desc: tetratricopeptide-like helical [medicago truncatula]
MSLQIPVRSGALRRLLLLGGAGGLPRPYSTDDRRRRVIREARQEEEDEAFLRTLNFGADPENNPLPPPPRRGRGLSDASAGKQQQQPERSAQKVVGETLLQKLKLGDGPSAAAAAATGGGDELRQPEDEPAPAQPVDVDEIFRKMKETGLIPNAVAMLDGLCKNGLVQDAMKLFGLMREKGAIPEVVIYTAVVEAFCKAAKLDDAVRIFRKMQGNGVIPNAFSYWLLIQGLYKGGRLDDAVGFCVEMFEAGLAPNAETFVGLLDAVCKTKGVDDGEKLVRSFQDRNFAIDEKSIREHLDKKGPFSPVVWEVIFGKRKSGRPL

SEQ ID NO: 12505 - DNA, 2559 bp, Sorghum bicolor
  misc_feature: Ceres ANNOT ID no. 6092641
  misc_feature: Encodes the peptide sequence at SEQ ID NO 12506
atggcctctaacggcggcggcagctccccaccctccatatcgtcgccggatggtcgaccgtcgagcccactcccggtcaccaactcgtccccatcgcagcccacccgccgctccggtgggcggcgccgccgcggttccgccagcccttatgcttcgtccccttccctcgggggattcgagacgccgccgcaccccggccgccgcacgccgtccggtgccggggctggcgccgccaggcagcagcgtcagaactggactggccggttcccgccgacgccctccaccccaatgtccaccgatgacatcccgccgtcctccgaagccggggacgacgagaccgacggtggtggcggcggcggcgtcgacgccaccccggtcttcgtttggggcaccaacatcagcgtgcaggacgtcaacgccgccatcctccggttcctgcgccacttccgcgacccgcgtgacgccggccgcgtcgacccggtcatggatgagggcaagtacatgcgcgccatccaccgcatcctcgagctcgagggcggagagtcgctcgacgtcgatgcgcacgacgtgtttgaccacgacccagacctctacagcaagatggttcgctatccgctcgaggtgctcgccatcttcgacatcgtgctcatggacctcgtcgcacgcatcgagccgctcttcgagaagcacatccagaccaggatctacaacctcaagtcgtccatttgcttgaggaatctcaacccatctgatattgagaagatggtatctatcaagggtatgataattagatgcagctcggtcataccggagctcaaggaggctgttttccgctgccttgtttgtggtttctactcagaacctgtcatggttgatagagggagagtaactgagccacacgtttgtcagaaagaacaatgcaaagccacaaattctatgactctagtgcacaaccgatgcagattttcagacaaacagatcataaagttgcaggaaacaccagatgagataccagaaggtggcactccacatacagttagtgtcttgatgcatgataagctcgttgatgctggaaagcctggagacagggttgagataactggaatatacagggctatgagtattagagttggaccaactcaaaggacagtgaagtctatattcaagacatatattgattgccttcacataaagaagacagacaagtctaggcttcatgtggaggacaccatggatattgataattcgaatgctagcaaatctactgaagaggattttcttagtgataaggttgagaaactaaaagagctttcaaagttgcctgatatctatgacagattgactagatcattagctccaaacatatgggagttggatgatgttaaaagaggtctcctttgccagcttttcggcggcaatcctttgaagcttccttctggggctagcttccggggtgacataaatattttacttgtgggtgatcctgggacgagtaaatcccagcttctccagtacatgcataaactgtctcctcgtggtatctatacaagtggtagaggaagttctgctgttggtcttactgcttatgttaccaaagatcctgagactggcgaaactgttctagaaagtggagcacttgttttgagtgacaaaggtgtttgttgcatagatgagtttgataagatgtctgataatgcccgaagcatgttacacgaggtgatggaacagcagacagtatccattgcgaaggctggaataattgcatctttaaatgcgaggacatctgtcctcgcatgtgccaatcctaccgaatcacgttacaacccaagactttctgtaattgacaacatacacttagccccaacactactttcaagattcgacctgatttatcttatcttggacaaggcggatgaacaaactgataggcgcctggcaaagcatattgtttcgttgcattttgagaatccaaatttagaggagctcgaggtcttggacttgcagacattagtttcctacataagctatgcaaggaagtatattcagccacagttatctgatgaagctgcagaagagctaactcgtggctatgttgagatgaggaaaagagggaatagccctgggagcagaaagaaggtcataacagcaactgctagacaaatagagagtttgattcgtctcagtgaagcattagcccgaatgcggttctctgaagtggttgaggtgcgagatgttgtggaggccttcaggcttcttgaagttgccatgcagcagtctgcaacggatcatgcaactgggacgattgatatggatctaatcatgacggggatatctgcaagtgaaaggcagagacgggagaaccttgtttctgcaacccgtaaccttatcgtggagaaaatgcagcttggaggcccctcaatgcgtatgattgagttgctggaagaacttaggaagcagagctcaatggaaattcatctgcacgaactccgcggtgctcttggcaccctgatgactgaaggtgcagtggttatccatggagacaacgtgaagagagtttga

SEQ ID NO: 12506 - protein, 852 aa, Sorghum bicolor
  misc_feature: Ceres ANNOT ID no. 6092641
  misc_feature (430)..(757): Pfam Id: MCM Pfam Desc: MCM2/3/5 family
  misc_feature (488)..(635): Pfam Id: AAA_5 Pfam Desc: ATPase family associated with various cellular activities(AAA)
  misc_feature (12)..(851): NCBI GI: 92886515 NCBI Desc: mcm; nucleic acid-binding, ob-fold [medicago truncatula]
  misc_feature (218)..(851): NCBI GI: 119480751 NCBI Desc: dna replication licensing factor mcm4 [neosartorya fischeri nrrl 181]
  misc_feature (218)..(851): NCBI GI: 119395971 NCBI Desc: dna replication licensing factor mcm4 [aspergillus clavatus nrrl 1]
  misc_feature (217)..(851): NCBI GI: 115443376 NCBI Desc: dna replication licensing factor mcm4 [aspergillus terreus nih2624]
  misc_feature (231)..(846): NCBI GI: 28829641 NCBI Desc: similar to essential for initiation of dna replication; homolog of s. pombe cdc21; cdc54p [saccharomyces cerevisiae] [dictyostelium discoideum]
  misc_feature: The sequence is a functional homolog of SEQ ID NO 8 in US patent 7189893
MASNGGGSSPPSISSPDGRPSSPLPVTNSSPSQPTRRSGGRRRRGSASPYASSPSLGGFETPPHPGRRTPSGAGAGAARQQRQNWTGRFPPTPSTPMSTDDIPPSSEAGDDETDGGGGGGVDATPVFVWGTNISVQDVNAAILRFLRHFRDPRDAGRVDPVMDEGKYMRAIHRILELEGGESLDVDAHDVFDHDPDLYSKMVRYPLEVLAIFDIVLMDLVARIEPLFEKHIQTRIYNLKSSICLRNLNPSDIEKMVSIKGMIIRCSSVIPELKEAVFRCLVCGFYSEPVMVDRGRVTEPHVCQKEQCKATNSMTLVHNRCRFSDKQIIKLQETPDEIPEGGTPHTVSVLMHDKLVDAGKPGDRVEITGIYRAMSIRVGPTQRTVKSIFKTYIDCLHIKKTDKSRLHVEDTMDIDNSNASKSTEEDFLSDKVEKLKELSKLPDIYDRLTRSLAPNIWELDDVKRGLLCQLFGGNPLKLPSGASFRGDINILLVGDPGTSKSQLLQYMHKLSPRGIYTSGRGSSAVGLTAYVTKDPETGETVLESGALVLSDKGVCCIDEFDKMSDNARSMLHEVMEQQTVSIAKAGIIASLNARTSVLACANPTESRYNPRLSVIDNIHLAPTLLSRFDLIYLILDKADEQTDRRLAKHIVSLHFENPNLEELEVLDLQTLVSYISYARKYIQPQLSDEAAEELTRGYVEMRKRGNSPGSRKKVITATARQIESLIRLSEALARMRFSEVVEVRDVVEAFRLLEVAMQQSATDHATGTIDMDLIMTGISASERQRRENLVSATRNLIVEKMQLGGPSMRMIELLEELRKQSSMEIHLHELRGALGTLMTEGAVVIHGDNVKRV

SEQ ID NO: 12507 - DNA, 1065 bp, Sorghum bicolor
  misc_feature: Ceres ANNOT ID no. 6092786
  misc_feature: Encodes the peptide sequence at SEQ ID NO 12508
atggccggagccgaggactacgacaccgcggccgcggtggccgtgttccatgagtcccgagccggcgtctgcgggctcgtccagtccggcgtcaaggccataccaccaattttcctcatgcccacctcgccatcgccgcggtcacccacgacgaccaccgcgttcgccatcccatccgtcgacctctccctcccgcgccgggacactgtagcgctcgtccgcgccgcggcatgttcgtgcggcttcttccacgtcaccaaccacggcgtcccggccggcgtcgtcgactccgcagtgtccgcggtgagggcgttccacgacgagcagccccgcgccgcccgctcggcgttctactcaatcgagcccgccgtcggcggtgccggtgctgtcacctactcgaccatccccatcgcgccgccgcggggcgctcctagtcctagtcctctgctcccctggcgcgacacgctccgtgtccgcttcggccccggggagcccgaccttggtcgccgcctacccgcggcttgccgggacgtgctgcaggagtaccagcggtcgctgacggcgttcgggaaggagatggccgggctgctgtcggaggcgctcggcgtcgggacagagcggctggagcgggcgatgcaggtggaagggtggctcatggcgtgccactactatccgccgtgtccggagccggagcgggtggtcggcagcctcgagcacaccgaccccagcttgttcacggtgctggcacaggacggagttggtgggctgcaggtccgccgcgacgacggagatgagtgggtcgacgtggtgccggtcaccggcgcgtttctggtcaacatcgggtggtcatcaaattccacacaaaatgcccgggtgtcaattgccctcttcttcaatcctggtaaacgtgagaattccgaccgttttgggcctctcccggagctggtgacagcagaaaagcctgcacggtaccggagtttcacggtgccagagttcatgagttcaaggaaagaatatggccataacagatcgtccattgatctattcaaggtaagctccagctaa

SEQ ID NO: 12508 - protein, 354 aa, Sorghum bicolor
  misc_feature: Ceres ANNOT ID no. 6092786
  misc_feature (215)..(300): Pfam Id: 2OG-FeII_Oxy Pfam Desc: 2OG-Fe(II) oxygenase superfamily
  misc_feature (1)..(292): NCBI GI: 115454701 NCBI Desc: os03g0690500 [oryza sativa (japonica cultivar-group)]
  misc_feature (16)..(281): NCBI GI: 29123084 NCBI Desc: 2-oxoglutarate-dependent oxygenase [zea mays]
  misc_feature (7)..(351): NCBI GI: 15721876 NCBI Desc: cme8 [cucumis melo]
  misc_feature (7)..(281): NCBI GI: 92877084 NCBI Desc: 2og-fe(ii) oxygenase [medicago truncatula]
  misc_feature (2)..(332): NCBI GI: 38346894 NCBI Desc: osjnbb0006l01.1 [oryza sativa (japonica cultivar-group)]
  misc_feature: The sequence is a functional homolog of SEQ ID NO. 278 in the 11/188,298 US application
  misc_feature: The sequence is a functional homolog of SEQ ID NO. 513 in the 11/188,298 US application
MAGAEDYDTAAAVAVFHESRAGVCGLVQSGVKAIPPIFLMPTSPSPRSPTTTTAFAIPSVDLSLPRRDTVALVRAAACSCGFFHVTNHGVPAGVVDSAVSAVRAFHDEQPRAARSAFYSIEPAVGGAGAVTYSTIPIAPPRGAPSPSPLLPWRDTLRVRFGPGEPDLGRRLPAACRDVLQEYQRSLTAFGKEMAGLLSEALGVGTERLERAMQVEGWLMACHYYPPCPEPERVVGSLEHTDPSLFTVLAQDGVGGLQVRRDDGDEWVDVVPVTGAFLVNIGWSSNSTQNARVSIALFFNPGKRENSDRFGPLPELVTAEKPARYRSFTVPEFMSSRKEYGHNRSSIDLFKVSSS

SEQ ID NO: 12509 - DNA, 1065 bp, Sorghum bicolor; identical to SEQ ID NO: 12507
  misc_feature: Ceres ANNOT ID no. 6092788
  misc_feature: Encodes the peptide sequence at SEQ ID NO 12510

SEQ ID NO: 12510 - protein, 354 aa, Sorghum bicolor; identical to SEQ ID NO: 12508
  misc_feature: Ceres ANNOT ID no. 6092788
  misc_feature (215)..(300): Pfam Id: 2OG-FeII_Oxy Pfam Desc: 2OG-Fe(II) oxygenase superfamily
  misc_feature (1)..(292): NCBI GI: 115454701 NCBI Desc: os03g0690500 [oryza sativa (japonica cultivar-group)]
  misc_feature (16)..(281): NCBI GI: 29123084 NCBI Desc: 2-oxoglutarate-dependent oxygenase [zea mays]
  misc_feature (7)..(351): NCBI GI: 15721876 NCBI Desc: cme8 [cucumis melo]
  misc_feature (7)..(281): NCBI GI: 92877084 NCBI Desc: 2og-fe(ii) oxygenase [medicago truncatula]
  misc_feature (2)..(332): NCBI GI: 38346894 NCBI Desc: osjnbb0006l01.1 [oryza sativa (japonica cultivar-group)]
  misc_feature: The sequence is a functional homolog of SEQ ID NO. 278 in the 11/188,298 US application
  misc_feature: The sequence is a functional homolog of SEQ ID NO. 513 in the 11/188,298 US application

SEQ ID NO: 12511 - DNA, 1020 bp, Sorghum bicolor
  misc_feature: Ceres ANNOT ID no. 6094522
  misc_feature: Encodes the peptide sequence at SEQ ID NO 12512
atgccgccgctgaccgccgccgacgatttcctcattctcgagttcatcgcaggcaaccgccgcatcccctacgccgtgttcgactccctcctcgcctgcctatcctcaccctccgccatccaccgcacctcacagcgcctccgacaagccctagtgctccgcgccctcgacgcagccctcctcaccgagggagcctccagcctcgtcctctacaaggcgcggaaggtcctcgccgaccccgacgcagccgcctgcttcccccaccagatctctgttacagacaatgaagagaacgacgaggctagggccgcggccgcggtggccgatctcaagcgcctcctcgaccttgagtgggccaacctcccgccctccacgctagagcgcgccgccgacaggatcgccggggacggggctcaccagacgtgggccgccgccgaccacatcaaactaggggagtcgacggagcatgagattttatctaaggctgtgcaggatggatctgcttctcatcaaccaattgtgacggaagttgctgacaatgtgagcaatgccaatgatgctgatggtgctcaacgagatgatgaggcccattcttctaatgaaaacagtgaggctgatcgtggtcaagaaggtatggctgggcaccaaaatgcatcagttaaaggaggagagggtcaagtttcagagaagtctgtcccagcttctaaaaggtgcagtcttatggagagaaatcccaatgcaagtacttatgagtgggatagttctgatgatgatcagccagtacggaagcgcaaattacatcgttttgagagaacttctacatgtgcacataagatcagaaagaagtggagtgagatagaggaaaaaaccttgctggaaggggtgaagaagtatggcaaaggcaattggaaagatatcaaattagcttaccctgatgtctttgaggagagatcaacggtagatctgaaggacaagttcagaaatttggaaaggcaccaccatgaatcggcatcggcttga

SEQ ID NO: 12512 - protein, 339 aa, Sorghum bicolor
  misc_feature: Ceres ANNOT ID no. 6094522
  misc_feature (280)..(330): Pfam Id: Myb_DNA-binding Pfam Desc: Myb-like DNA-binding domain
  misc_feature (239)..(329): NCBI GI: 54111435 NCBI Desc: terminal acidic sant 1 [zea mays]
  misc_feature (194)..(331): NCBI GI: 40388419 NCBI Desc: anther indehiscence1 [oryza sativa (japonica cultivar-group)]
  misc_feature (281)..(329): NCBI GI: 56404263 NCBI Desc: terminal acidic sant 1 [zea mays]
  misc_feature (198)..(331): NCBI GI: 71897464 NCBI Desc: telomeric repeat binding factor 2 [xenopus laevis]
  misc_feature (217)..(335): NCBI GI: 22329375 NCBI Desc: myb family transcription factor [arabidopsis thaliana]
  misc_feature: The sequence is a functional homolog of SEQ ID NO. 514 in the 11/188,298 US application
MPPLTAADDFLILEFIAGNRRIPYAVFDSLLACLSSPSAIHRTSQRLRQALVLRALDAALLTEGASSLVLYKARKVLADPDAAACFPHQISVTDNEENDEARAAAAVADLKRLLDLEWANLPPSTLERAADRIAGDGAHQTWAAADHIKLGESTEHEILSKAVQDGSASHQPIVTEVADNVSNANDADGAQRDDEAHSSNENSEADRGQEGMAGHQNASVKGGEGQVSEKSVPASKRCSLMERNPNASTYEWDSSDDDQPVRKRKLHRFERTSTCAHKIRKKWSEIEEKTLLEGVKKYGKGNWKDIKLAYPDVFEERSTVDLKDKFRNLERHHHESASA

SEQ ID NO: 12513 - DNA, 435 bp, Sorghum bicolor
  misc_feature: Ceres ANNOT ID no. 6094796
  misc_feature: Encodes the peptide sequence at SEQ ID NO 12514
atggcgattggttctctcatcgcctcgaggttcgccaggtctagccatgccctcctccccgccgccgccgcggccatctctcaggctcccagggcccagaacgtcgcatctcctctactttctggccttggagccgcagcgcgtgctttcagctcaagggctctatggaagggagcattcgttgatgctttcctggctagaataaagaagaacagagaaaacatgaatggcaagaagatttggtctcgtagatcttctattttgccggaattcgtcggttcctctgtgctcatttacaatggaaaaactcatgtccggtgcaagatcacggaagggaaggttggccataaatttggagagtttgcttttacacggagacgaaggccccatcgagcaataattgcaaagggaaatcaaggaaagggcagaaagtaa

SEQ ID NO: 12514 - protein, 144 aa, Sorghum bicolor
  misc_feature: Ceres ANNOT ID no. 6094796
  misc_feature (53)..(130): Pfam Id: Ribosomal_S19 Pfam Desc: Ribosomal protein S19
  misc_feature (53)..(141): NCBI GI: 60498747 NCBI Desc: ribosomal protein s19 [oryza sativa (japonica cultivar-group)]
  misc_feature (53)..(141): NCBI GI: 74100101 NCBI Desc: ribosomal protein s19 [oryza sativa (indica cultivar-group)]
  misc_feature (53)..(141): NCBI GI: 1877026 NCBI Desc: ribosomal protein s19 [oryza sativa (japonica cultivar-group)]
  misc_feature (53)..(141): NCBI GI: 78322188 NCBI Desc: ribosomal protein s19 [stellilabium pogonostalix]
  misc_feature (53)..(141): NCBI GI: 78322176 NCBI Desc: ribosomal protein s19 [cymbidium sp. cq-2003]
MAIGSLIASRFARSSHALLPAAAAAISQAPRAQNVASPLLSGLGAAARAFSSRALWKGAFVDAFLARIKKNRENMNGKKIWSRRSSILPEFVGSSVLIYNGKTHVRCKITEGKVGHKFGEFAFTRRRRPHRAIIAKGNQGKGRK

SEQ ID NO: 12515 - DNA, 1803 bp, Sorghum bicolor
  misc_feature: Ceres ANNOT ID no. 6094818
  misc_feature: Encodes the peptide sequence at SEQ ID NO 12516
atggtgaagagaagcaagaagagcaagagcaagcgcgtgacgctgaagcagaagcacaaggtgctgcgcaaggtgaaggagcaccaccgcaagaagcgcaaggaggccaagaaggagggaaaggccggccagcggaagaaggtcgagaaggaccccgggatccccaacgagtggcccttcaaggagcaggagctcaaggcgctagaggcccggcgagcgcaggcgctccaggagctcgagctcaagaaggaggcgcgcaaggagagggctcggaagaggaagctaggattgcttgaggatgaggacattgctaatttggcatctgcagcttccgcgcagggcagtgagtttgcagcaaaggatgcagctaaggagaatgctcctttagcagtggcaaagagcaatgatcattcagagaggtctttctacaaggagcttgttaaagtaattgaagcttctgatgtgattcttgaggttcttgatgcaagggatccactaggcacccgttgccttgacatggaaatgatggttaagaaggctgatccaagtaaacggattgtactacttctcaacaagatagatcttgttcccaaggaggcggttgagaagtggcttacatatctaagagaagaaatgccaacagttgcatttaagtgcaatacccaagagcagaggacaaagctgggatggaaatcttcaaaacttgataaaacaagtaacatcccacaaagcagtgattgtcttggtgctgagaatctaatcagattgctcaagaattattccagaagccatgagctcaaactggcaattacggtgggtattgttggacttcctaatgttggcaagagtagtctgatcaacagcctgaagaggtcccgagtggttaatgtcggttccactccaggggttactagggcaatgcaagaagttcaattagacaagaaggtgaagttgttggattgccctggtgttgttatgctcaaatcttccagcagtggtgtgtctgtagcccttcgaaactgcaaaagagttgagaaaatggaagatccagtcactcctgttaaggagatcctaagtatttgcccgcatgagaagttgttatctctgtacaaggttccaaacttcagttcagttgatgatttccttcagaaagtagcaactgtacgggggaagttgaaaaagggtggtgtagtggatgttgaagctgctgcgagaattgtgcttcatgactggaatgaaggtaaaataccatattttacactgccacctaaaagagatgctggggaggactcaaatgcagtgattataacacaagatgggaaagaatttaatattgatgaaatttacaaagctgagtcttcatatattggtggtttgaagtccattgaggagtttcatcacattgagattcctcctaatgctccaccagggattgatgaagagatgctagaggaaggcaagaaaccaagtgagcctgcccaggaaagccgggaggagcaaatgtctgacgtgaatgatcgggaaggaagcaaggcagccagtgctagcacacagaatgacaagttgtacaccgccgagggcatactcgaccctcgcaagaggaaagcagagaagaaacgacgcaaggcgaacaagttcagcgtgctgaacgacatggatgcggactatgatttcaaggtggattatcagatggaggacgcatcggccgccaatgaggacgatgggggtgcacaagcggatgatgaagatggcggggatgaagccaaggataatgagccgatgactggtgttgatgatgcgtga

SEQ ID NO: 12516 - protein, 600 aa, Sorghum bicolor
  misc_feature: Ceres ANNOT ID no. 6094818
  misc_feature (16)..(96): Pfam Id: GN3L_Grn1 Pfam Desc: GNL3L/Grn1 putative GTPase
  misc_feature (270)..(373): Pfam Id: MMR_HSR1 Pfam Desc: GTPase of unknown function
  misc_feature (2)..(552): NCBI GI: 21428328 NCBI Desc: at23067p [drosophila melanogaster]
  misc_feature (2)..(552): NCBI GI: 28572990 NCBI Desc: cg3983-pa, isoform a [drosophila melanogaster]
  misc_feature (21)..(508): NCBI GI: 50417944 NCBI Desc: flj10613l protein [danio rerio]
  misc_feature (2)..(583): NCBI GI: 108872457 NCBI Desc: gtp-binding protein-invertebrate [aedes aegypti]
  misc_feature (2)..(475): NCBI GI: 116128573 NCBI Desc: ensangp00000012225 [anopheles gambiae str. pest]
MVKRSKKSKSKRVTLKQKHKVLRKVKEHHRKKRKEAKKEGKAGQRKKVEKDPGIPNEWPFKEQELKALEARRAQALQELELKKEARKERARKRKLGLLEDEDIANLASAASAQGSEFAAKDAAKENAPLAVAKSNDHSERSFYKELVKVIEASDVILEVLDARDPLGTRCLDMEMMVKKADPSKRIVLLLNKIDLVPKEAVEKWLTYLREEMPTVAFKCNTQEQRTKLGWKSSKLDKTSNIPQSSDCLGAENLIRLLKNYSRSHELKLAITVGIVGLPNVGKSSLINSLKRSRVVNVGSTPGVTRAMQEVQLDKKVKLLDCPGVVMLKSSSSGVSVALRNCKRVEKMEDPVTPVKEILSICPHEKLLSLYKVPNFSSVDDFLQKVATVRGKLKKGGVVDVEAAARIVLHDWNEGKIPYFTLPPKRDAGEDSNAVIITQDGKEFNIDEIYKAESSYIGGLKSIEEFHHIEIPPNAPPGIDEEMLEEGKKPSEPAQESREEQMSDVNDREGSKAASASTQNDKLYTAEGILDPRKRKAEKKRRKANKFSVLNDMDADYDFKVDYQMEDASAANEDDGGAQADDEDGGDEAKDNEPMTGVDDA

SEQ ID NO: 12517 - DNA, 654 bp, Sorghum bicolor
  misc_feature: Ceres ANNOT ID no. 6094876
  misc_feature: Encodes the peptide sequence at SEQ ID NO 12518
atggcttcagacactggcaagaagctcattcagatcgatgtgagctcggatacagtgtgcccttggtgcttcgtcggtaaaaagaaccttgagaaagcaatggagcaaagcaaggacaagtttgatttcgaggtccgttggcatccgttctttctgaaccctgatgcgcctaaggagggcgtcaggaaaactgacttcttcagggcgaagtttggtcctgttcaatatgagcgtgcaatttctcgcatgactgagatatttcgaggactcgggcttgaatatgacatgtcggggctgacagggaatacaatggatagtcataggctcataacacttgctggacaccaaggctatgacaagcaaaatgctcttgttgaagaattattcctcaattacttttgccaaggaaagtatattggtgacaagcaggttttgctggatgctgcaagaaaggtgggcatagaaggggccgaagaacttcttgaagatcccagcaaaggagtcgacgaggttcaggaagaacttaagaagtactcatctggcatctccggggtcccgcattttgtgatcaataataaatatcaactcagtggtggccagcctccaaatgtattcatgagggcgtttgagatggctgcaaaagatggagcttaa

SEQ ID NO: 12518 - protein, 217 aa, Sorghum bicolor
  misc_feature: Ceres ANNOT ID no. 6094876
  misc_feature (11)..(210): Pfam Id: DSBA Pfam Desc: DSBA-like thioredoxin domain
  misc_feature (7)..(212): NCBI GI: 92889902 NCBI Desc: dsba oxidoreductase [medicago truncatula]
  misc_feature (9)..(205): NCBI GI: 118737636 NCBI Desc: dsba oxidoreductase [dinoroseobacter shibae dfl 12]
  misc_feature (10)..(210): NCBI GI: 86138337 NCBI Desc: dsba-like thioredoxin family protein [roseobacter sp. med193]
  misc_feature (4)..(214): NCBI GI: 15889078 NCBI Desc: agr_c_3262p [agrobacterium tumefaciens str. c58]
  misc_feature (7)..(208): NCBI GI: 110634052 NCBI Desc: dsba oxidoreductase [mesorhizobium sp. bnc1]
  misc_feature: Useful for making plants with modulated water use efficiency
  misc_feature: Functional homolog of the protein sequence given in SEQ ID NO 13719
MASDTGKKLIQIDVSSDTVCPWCFVGKKNLEKAMEQSKDKFDFEVRWHPFFLNPDAPKEGVRKTDFFRAKFGPVQYERAISRMTEIFRGLGLEYDMSGLTGNTMDSHRLITLAGHQGYDKQNALVEELFLNYFCQGKYIGDKQVLLDAARKVGIEGAEELLEDPSKGVDEVQEELKKYSSGISGVPHFVINNKYQLSGGQPPNVFMRAFEMAAKDGA

SEQ ID NO: 12519 - DNA, 777 bp, Sorghum bicolor
  misc_feature: Ceres ANNOT ID no. 6094933
  misc_feature: Encodes the peptide sequence at SEQ ID NO 12520
atggagcaaacggacgaggcgtcgtcggtgaacgagcagagcgcggagcggcggcagccgtccgtggtggccggcggcggcgccatggcgtggctcgacctcacgctggccgtgaacgcctcttctcgcgacgagttcccggcgccagacggcggcgactcctcgtccgccggttcagacggcgagccgccgccggccaagcccgacgcgtctgcgtctgcgtctccttctcctcctcctcctgccaatcccacgccgcacaaggtgttctcgtgcaacttctgcatgcgcaagttcttcagctcgcaggcgctgggcgggcaccagaacgcgcacaagcgggagcgcagcgcggccaagcgctccacgtcggcgtaccaccaccacctccacgcgcagcagcggatggtcatggcgggcctgccgctggaggcgcacgccgccctggtgcgcgccgcgctgcgggtcagcccggccagcacggtcatccacaaggccgccagcgccagccaggacctcgccgcggcgcgggcgtctgctgccgctgccgctgccggtgccgtcgccacgagcacggcgcccaggttccacgacggcgacagcagcaacgcttccacggctgccacaccgtgggcgaccgcgctgctctacgaggagccggtcagctccacgtggcccgggagcttccggatgagagcgcagcctgagccgccgagctcggagcagcagcaggcgtcggagcagagtaagaagatcgacttggatctcaggctgtga

SEQ ID NO: 12520 - protein, 258 aa, Sorghum bicolor
  misc_feature: Ceres ANNOT ID no. 6094933
  misc_feature (39)..(194): NCBI GI: 100801742 NCBI Desc: cys2-his2 zinc finger protein [glycine max]
  misc_feature (80)..(131): NCBI GI: 124360460 NCBI Desc: histone h4; zinc finger, c2h2-type [medicago truncatula]
  misc_feature (71)..(257): NCBI GI: 790679 NCBI Desc: zinc finger protein
  misc_feature (88)..(165): NCBI GI: 6503285 NCBI Desc: identical to gis55881 zinc finger protein 1 from arabidopsis thaliana
  misc_feature (67)..(126): NCBI GI: 9758313 NCBI Desc: cchh finger protein 2-like protein [arabidopsis thaliana]
  misc_feature: The plant is abnormally small.
  misc_feature: The plant produces a reduced number of seeds.
  misc_feature: The sequence is a functional homolog of SEQ ID NO 10 in the 10/412,699US patent application
  misc_feature: The sequence is a functional homolog of SEQ ID NO 1091 in the 10/412,699US patent application
  misc_feature: The sequence is a functional homolog of SEQ ID NO 1092 in the 10/412,699US patent application
  misc_feature: The sequence is a functional homolog of SEQ ID NO 1093 in the 10/412,699US patent application
  misc_feature: The sequence is a functional homolog of SEQ ID NO 1094 in the 10/412,699US patent application
  misc_feature: The sequence is a functional homolog of SEQ ID NO 124 in the 11/479,226US patent application
  misc_feature: The sequence is a functional homolog of SEQ ID NO 1279 in the 10/666,642US patent application
  misc_feature: The sequence is a functional homolog of SEQ ID NO 505 in the 11/479,226US patent application
  misc_feature: The sequence is a functional homolog of SEQ ID NO 636 in the 10/374,780US patent application
  misc_feature: The sequence is a functional homolog of SEQ ID NO 637 in the 10/374,780US patent application
  misc_feature: The sequence is a functional homolog of SEQ ID NO 638 in the 10/374,780US patent application
  misc_feature: The sequence is a functional homolog of SEQ ID NO 639 in the 10/374,780US patent application
  misc_feature: The sequence is a functional homolog of SEQ ID NO 761 in the 10/666,642US patent application
  misc_feature: The sequence is a functional homolog of SEQ ID NO 762 in the 10/666,642US patent application
  misc_feature: The sequence is a functional homolog of SEQ ID NO 763 in the 10/666,642US patent application
  misc_feature: The sequence is a functional homolog of SEQ ID NO 82 in the 10/666,642US patent application
  misc_feature: Useful for biocontainment applications
  misc_feature: Useful for making plants with modulated biomass
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1091 in the 20040045049 US patent application
  misc_feature: The sequence is a functional homolog of SEQ ID NO 1092 in the 20040045049 US patent application
  misc_feature: The sequence is a functional homolog of SEQ ID NO 1093 in the 20040045049 US patent application
  misc_feature: The sequence is a functional homolog of SEQ ID NO 1094 in the 20040045049 US patent application
  misc_feature: The sequence is a functional homolog of SEQ ID NO 505 in the 20070022495 US patent application
  misc_feature: The sequence is a functional homolog of SEQ ID NO 82 in the 20070033671 US patent application
  misc_feature: Functional homolog of the protein sequence given in SEQ ID NO 13581
  misc_feature: The sequence is a functional homolog of SEQ ID NO. 351 in the 11/188,298 US application
MEQTDEASSVNEQSAERRQPSVVAGGGAMAWLDLTLAVNASSRDEFPAPDGGDSSSAGSDGEPPPAKPDASASASPSPPPPANPTPHKVFSCNFCMRKFFSSQALGGHQNAHKRERSAAKRSTSAYHHHLHAQQRMVMAGLPLEAHAALVRAALRVSPASTVIHKAASASQDLAAARASAAAAAAGAVATSTAPRFHDGDSSNASTAATPWATALLYEEPVSSTWPGSFRMRAQPEPPSSEQQQASEQSKKIDLDLRL

SEQ ID NO: 12521 - DNA, 1485 bp, Sorghum bicolor
  misc_feature: Ceres ANNOT ID no. 6094958
  misc_feature: Encodes the peptide sequence at SEQ ID NO 12522
atggagctgggtggcggcggcggcggcggcggcggcggcgagagcgccgccaagcgcgcaaggctctcctccggcgatgccgattcggccgccgccacaggagaggaccggctcagcgcgctccccgaggacgtcctcgtctgcatcctcctccacctcaccaccagcgccgccgcacggaccagtgtcctctcccgccactggcgccgcatctgggccctcctcccggtgctctgcttccgctaccccccagatccccgccagatcggccgcgcactcgaggctcacgaggcggccctcctgcgcctctacgtctgcacccaggacgcggaccccgactccatgtcggcctggctccccgtcgccgcgcgacgcctctccggcggcctcttgtttcacaacgttgttgtgcgggagaggggcgcccaggaaggcgacgaggaggaggccgcgcagagcggcgcctttgagctcccctgcctggagcgcgccacagaggtcttgcttcacctaggattcctcggcctcgccgtgcctcctgccggcgtctttgctcggctcaccaggctgtgcctggttcgcgttcggctcacgaagctcaccgtcagtgacgccagggggctggacaaccttgccatccattcagattctctctggcaagtggaactcatcgatctgcgtggcttgcagcagctcaacattgtggcaccggctcttaaggaattgaaagttaaacactgtttcttctacagtccaagcaagccggttgccagcatcacagcgcctcagctggcaacccttcggtggatggatccatatgatccaagctctgtccatcttggcgagatgagccatcttcgattactgaggcctttcttctttgttgtttatgggaatgacagctacgcacacaatcagtcttgtttaagtctcttgcggcctttcaaggtcatcaaacatcttatactcacactggcctatctgtgggacatagatgactatcaatatgtgatggaagatatgacaatgctcccagacatcacgattttgcacctgaatatattggcaaacaaacatgcttttggggccagcgcatttcatgctctcagaatgtgttctggtataaggaagctaatgctggaatttcttgctcctacagtggtggaggcacaaactacatgcccaccgggttgcatttgcggtgagcaccaaaactgggaaaccgagcacctggtgttgaatcacctcaaagaagtagaaatcactcggatgagagggtctgaacatgaagttacttttgtgaagcatctattcatttgggggacagccttggaaaagatgatggtgtttttcgacaaatcggttactgaaagcgcagccaaggagttgtcccaggtgctacgaagctttgctaggccggaaatacgcatggaaatccacacgtatctggacatggtgatgatgatgtatgaacccgaagactaa

SEQ ID NO: 12522 - protein, 494 aa, Sorghum bicolor
  misc_feature: Ceres ANNOT ID no. 6094958
  misc_feature (36)..(83): Pfam Id: F-box Pfam Desc: F-box domain
  misc_feature (197)..(464): NCBI GI: 115470335 NCBI Desc: os07g0118800 [oryza sativa (japonica cultivar-group)]
  misc_feature (23)..(478): NCBI GI: 115472677 NCBI Desc: os07g0550300 [oryza sativa (japonica cultivar-group)]
  misc_feature (27)..(197): NCBI GI: 115471251 NCBI Desc: os07g0228900 [oryza sativa (japonica cultivar-group)]
  misc_feature (335)..(494): NCBI GI: 115471243 NCBI Desc: os07g0228000 [oryza sativa (japonica cultivar-group)]
  misc_feature (14)..(276): NCBI GI: 116309809 NCBI Desc: h0525c06.11 [oryza sativa (indica cultivar-group)]
MELGGGGGGGGGGESAAKRARLSSGDADSAAATGEDRLSALPEDVLVCILLHLTTSAAARTSVLSRHWRRIWALLPVLCFRYPPDPRQIGRALEAHEAALLRLYVCTQDADPDSMSAWLPVAARRLSGGLLFHNVVVRERGAQEGDEEEAAQSGAFELPCLERATEVLLHLGFLGLAVPPAGVFARLTRLCLVRVRLTKLTVSDARGLDNLAIHSDSLWQVELIDLRGLQQLNIVAPALKELKVKHCFFYSPSKPVASITAPQLATLRWMDPYDPSSVHLGEMSHLRLLRPFFFVVYGNDSYAHNQSCLSLLRPFKVIKHLILTLAYLWDIDDYQYVMEDMTMLPDITILHLNILANKHAFGASAFHALRMCSGIRKLMLEFLAPTVVEAQTTCPPGCICGEHQNWETEHLVLNHLKEVEITRMRGSEHEVTFVKHLFIWGTALEKMMVFFDKSVTESAAKELSQVLRSFARPEIRMEIHTYLDMVMMMYEPED

SEQ ID NO: 12523 - DNA, 1032 bp, Sorghum bicolor
  misc_feature: Ceres ANNOT ID no. 6094978
  misc_feature: Encodes the peptide sequence at SEQ ID NO 12524
atgggcgggctcaccatggagccggccttcgtgcaggcccccgagcaccgccccaagcccaccgtcaccgaggccaccggcatcccggtcaccgacgtggacgcgctggcggccgaggtgggcgcggcgagccgggactggggcttcttcgtggtcgtaggccacggcgtgcccgcggggaccgtggcgcgcgcgacggcggcgcagcgcgcgttcttcgcgctgccggcggagcggaaggccgccgtgcggaggagcgaggcggagccgctcgggtactacgagtcggagcacaccaagaacgtcagggactggaaggaggtgttcgacctcgtcccgcgcgatccgccgccgccagcagccgtggccgacggcgaggtcgtgtacaggaacaagtggcctgaggacctgccagggttcagagaggcgctggaggagtacacgaacgctcttgaagagctggcgttgaagctgctggagctgctggcccggagcctgaagctgaggcccgaccggctgcacggcttcttcaaggagcacacgtcgttcttccggctgaaccactaccctccgtgcccggcgccggaggtggtgctgggcgtggggcggcacaaggaccccggagcgctgaccgtcctgtaccaggacgacgtcggcgggctcgacgtccggcggcgatccgacggcgagtgggtccgcgtcaagtgcgttcccaactcgttcgtcatcaacgtcggcgacaccgtgcaggtgtggagcgacgacaggtacgagagcgcggagcaccgggtgtcggtgaactcggagaaggagaggttctccatgccctacttcttcaacccggcgagcggcgccattgtggagccgctggaggaggtggtgagcgaggagaagaagccgcccaggtacagcgcctacagctggggcgactacttcagcaccaagctcaacggcaacttcaagtggctggacgtggacaacctccagatcgcggatttcaggaagagctacagctccggagacgtgccgtga

SEQ ID NO: 12524 - protein, 343 aa, Sorghum bicolor
  misc_feature: Ceres ANNOT ID no. 6094978
  misc_feature (180)..(281): Pfam Id: 2OG-FeII_Oxy Pfam Desc: 2OG-Fe(II) oxygenase superfamily
  misc_feature (22)..(334): NCBI GI: 89574456 NCBI Desc: senescence-associated nodulin 1a [glycine max]
  misc_feature (22)..(334): NCBI GI: 89574458 NCBI Desc: senescence-associated nodulin 1a [glycine max]
  misc_feature (14)..(334): NCBI GI: 89574455 NCBI Desc: senescence-associated nodulin 1b [glycine max]
  misc_feature (6)..(251): NCBI GI: 30685157 NCBI Desc: oxidoreductase, 2og-fe(ii) oxygenase family protein [arabidopsis thaliana]
  misc_feature (32)..(259): NCBI GI: 42572483 NCBI Desc: oxidoreductase, 2og-fe(ii) oxygenase family protein [arabidopsis thaliana]
  misc_feature: The sequence is a functional homolog of SEQ ID NO. 278 in the 11/188,298 US application
  misc_feature: The sequence is a functional homolog of SEQ ID NO. 513 in the 11/188,298 US application
MGGLTMEPAFVQAPEHRPKPTVTEATGIPVTDVDALAAEVGAASRDWGFFVVVGHGVPAGTVARATAAQRAFFALPAERKAAVRRSEAEPLGYYESEHTKNVRDWKEVFDLVPRDPPPPAAVADGEVVYRNKWPEDLPGFREALEEYTNALEELALKLLELLARSLKLRPDRLHGFFKEHTSFFRLNHYPPCPAPEVVLGVGRHKDPGALTVLYQDDVGGLDVRRRSDGEWVRVKCVPNSFVINVGDTVQVWSDDRYESAEHRVSVNSEKERFSMPYFFNPASGAIVEPLEEVVSEEKKPPRYSAYSWGDYFSTKLNGNFKWLDVDNLQIADFRKSYSSGDVP

SEQ ID NO: 12525 - DNA, 999 bp, Sorghum bicolor
  misc_feature: Ceres ANNOT ID no. 6094993
  misc_feature: Encodes the peptide sequence at SEQ ID NO 12526
atgagaaaaccttccaagggatgcaataaggggaatgcgaactgccaatggagtgatcgcacagatgaccatggcaagcatttcttcaagattctgattggtgatttccataaaagattggtcataccgggtaaatttgctgaacatttcagagacaaaatagaaggaagtattacgcttgaatcacttggtggttatacttttgaggttcaagttgcaaagaattttggcagaatagtgcttcagtctggctggaagtcatttgttagtgcccatgacctgaaaaagatggacttcctggtattcaagtacaatgggatgtctcgaatgaaggttctgatatttgatcctagtggttgcgagaaagtaccaccctgttttgtcacgaaaaatgctattaatggtggaaagaagagagaagaagccattgtaattgcaagtggcgatgctaataatcatcccatgagagcaccagaaactaaaaagaaagcattgaagcaaagggacaggagtaggatcattatcagttcatcaagatccctatccaagtcatcaggaggaatgacatcttcagaggacgacgaagcatgttctgctccgagttacatgctcccacaaggtgccagccttgataatatccaacagaagaaagtgaaagagagaggccgagctatttgttctgaaatccccatctatgtgtgtgtcgtgaagaagtcaaacatttctggaagatctcaagctatggacttctccagaaaatattctgatgtatgtcttccattcaagagcaaaaggtggattcttcagtgtcatggcaagagctgggaagtgacatgccgcattaaggctgggaaatgtcaaggcaagttcaaaatgctttgcaacgggtgggcacagtttgcaggtgacaactatttgcagctgggagatatactcctctttgaacaactgaagaccaagaagtacaggatgaatgtgcatatcattcgcaatgagtga

SEQ ID NO: 12526 - protein, 332 aa, Sorghum bicolor
  misc_feature: Ceres ANNOT ID no. 6094993
  misc_feature (27)..(120): Pfam Id: B3 Pfam Desc: B3 DNA binding domain
  misc_feature (1)..(332): NCBI GI: 20145851 NCBI Desc: auxin response factor 36 [arabidopsis thaliana]
  misc_feature (17)..(130): NCBI GI: 140069091 NCBI Desc: hmg-i and hmg-y, dna-binding; transcriptional factor b3; cupredoxin [medicago truncatula]
  misc_feature (27)..(140): NCBI GI: 144924216 NCBI Desc: transcriptional factor b3; cupredoxin [medicago truncatula]
  misc_feature (27)..(159): NCBI GI: 92872624 NCBI Desc: transcriptional factor b3; cupredoxin [medicago truncatula]
  misc_feature (42)..(130): NCBI GI: 140069090 NCBI Desc: hmg-i and hmg-y, dna-binding; transcriptional factor b3; cupredoxin [medicago truncatula]
  misc_feature: The sequence is a functional homolog of SEQ ID NO. 467 in the 11/188,298 US application
MRKPSKGCNKGNANCQWSDRTDDHGKHFFKILIGDFHKRLVIPGKFAEHFRDKIEGSITLESLGGYTFEVQVAKNFGRIVLQSGWKSFVSAHDLKKMDFLVFKYNGMSRMKVLIFDPSGCEKVPPCFVTKNAINGGKKREEAIVIASGDANNHPMRAPETKKKALKQRDRSRIIISSSRSLSKSSGGMTSSEDDEACSAPSYMLPQGASLDNIQQKKVKERGRAICSEIPIYVCVVKKSNISGRSQAMDFSRKYSDVCLPFKSKRWILQCHGKSWEVTCRIKAGKCQGKFKMLCNGWAQFAGDNYLQLGDILLFEQLKTKKYRMNVHIIRNE

SEQ ID NO: 12527 - DNA, 1029 bp, Sorghum bicolor
  misc_feature: Ceres ANNOT ID no. 6094995
  misc_feature: Encodes the peptide sequence at SEQ ID NO 12528
atgagaaaaccttcaaagggatgcaaggagacggatgcaaattaccaccggaattatcacacatatgaccatggcaaacattttttcaaggttttgattggtgatttccataaaagattggtcataccgggtaaatttgccaaacatttcagagacaaaatagaaagaaatattactcttgaatcatttggaggtttaacctttgatgttcaagttgcaaagaatttgggcagaatagtgcttcagtctggctggaagtcatttgttagtgcccatgacctgaaaaagatggacttcctggtattcaagtacaatgggatgtctcggatgaaggttctgatatttgatcctagtggttgcgagaaagtaccaccatgttttgtcgcaaaaaatgctattagtggtgagttagtgaaaacaccagtaactaaaaagaaagcatggaagcaaagggacaggagtaggatcagtatcacttcatcaagatccctattcaactcatcaggtagagtctcaatgtcgtcaaacctagtggcatctatgtatatctacaagatcatgacatcattgttttgtttggttataggaggaatgacatcttcagaagatgatgaagcacattctgttccgagttacatgctcccacaaggcaccagccttgatagtatgcaaaagaagaaactgaaagagagactccgatctatgtgttctgaaatccccatctatgtgtgtgtcatgaagaagtataacatttctggaagttctaaatctatggtcttctccaaaaaatattctgatgtatgtcttccaatcaagagcacaaggtggattcttcagtgtcatggcaagagctgggaaatgacgtgccgcattctggttcggaaggatcaaggcgaaatgaaaaggcttcgaaatgggtgggcgcggtttgcaggtgacaacaatttgcagctgggagatatctgcgtctttgagcaactgaagaccaagaagtacatgatgaatgtccatatcattcgcaaagattga

SEQ ID NO: 12528 - protein, 342 aa, Sorghum bicolor
  misc_feature: Ceres ANNOT ID no. 6094995
  misc_feature (27)..(120): Pfam Id: B3 Pfam Desc: B3 DNA binding domain
  misc_feature (246)..(342): Pfam Id: B3 Pfam Desc: B3 DNA binding domain
  misc_feature (7)..(338): NCBI GI: 140069091 NCBI Desc: hmg-i and hmg-y, dna-binding; transcriptional factor b3; cupredoxin [medicago truncatula]
  misc_feature (19)..(164): NCBI GI: 20145851 NCBI Desc: auxin response factor 36 [arabidopsis thaliana]
  misc_feature (19)..(130): NCBI GI: 92872624 NCBI Desc: transcriptional factor b3; cupredoxin [medicago truncatula]
  misc_feature (4)..(130): NCBI GI: 144924216 NCBI Desc: transcriptional factor b3; cupredoxin [medicago truncatula]
  misc_feature (7)..(130): NCBI GI: 140069093 NCBI Desc: hmg-i and hmg-y, dna-binding; transcriptional factor b3; cupredoxin [medicago truncatula]
  misc_feature: The sequence is a functional homolog of SEQ ID NO. 467 in the 11/188,298 US application
MRKPSKGCKETDANYHRNYHTYDHGKHFFKVLIGDFHKRLVIPGKFAKHFRDKIERNITLESFGGLTFDVQVAKNLGRIVLQSGWKSFVSAHDLKKMDFLVFKYNGMSRMKVLIFDPSGCEKVPPCFVAKNAISGELVKTPVTKKKAWKQRDRSRISITSSRSLFNSSGRVSMSSNLVASMYIYKIMTSLFCLVIGGMTSSEDDEAHSVPSYMLPQGTSLDSMQKKKLKERLRSMCSEIPIYVCVMKKYNISGSSKSMVFSKKYSDVCLPIKSTRWILQCHGKSWEMTCRILVRKDQGEMKRLRNGWARFAGDNNLQLGDICVFEQLKTKKYMMNVHIIRKD

SEQ ID NO: 12529 - DNA, 939 bp, Sorghum bicolor
  misc_feature: Ceres ANNOT ID no. 6095005
  misc_feature: Encodes the peptide sequence at SEQ ID NO 12530
atgagaaagcctggtaagagaagcagggagagggatgcatatttctattcggatcacaatgatgagaaggacaagtatttcttcaaggttctggttggtgattttcgtgaacgattggccgtgcctgagaaattcgagcaacatttcagagggctaataggaaacagagttaagctagaatcacgctgtggacacacttttgatgttgaagtagctaagaatctgggcaaagtagtccttcaaacaggatggaaggagtttgttactgcccatgacttgaacatgggggacttcttggttttcaagtgcgacaagacttctcgattcaaggttttcatatttgatcttagttgttgcgagaaagtgcctccatgccttgtcaagagaaatcatatctgtggcagagaaacaagggaaatgcacattgaaatttcaagcagttgtggagatcttcccatgaatgtcaccactaattcatcaacctccctatctgactcatcaggagattctgtacgtccagaagatcagaaatcacattgtgttccaggttacatcctcccacgaggaacctgtctaacctgtgtgcagatgaagaaactgaaagagagagtccgagctagtagttctaggatccccatctatggatgcatcatcaacaacggcaatgttcatggaagatctcaggctttgaacataccaagagtatatgctgatgtatatctaccatttgaggaccaaacactgatgcttcgatgccgtggcaagagttgggaagtgcggtgtgtgattaagaaggacaaaaaaagagtcaaaaggcttatgaaagggtggaaacagtttgctcgtgacaacaagttgcggctgggagatctctgcctctttgagctacttgagaatacgaagtacacgatgaatgtgcatgtcattcgtgcaaaatga

SEQ ID NO: 12530 - protein, 312 aa, Sorghum bicolor
  misc_feature: Ceres ANNOT ID no. 6095005
  misc_feature (26)..(119): Pfam Id: B3 Pfam Desc: B3 DNA binding domain
  misc_feature (214)..(312): Pfam Id: B3 Pfam Desc: B3 DNA binding domain
  misc_feature (201)..(308): NCBI GI: 140069091 NCBI Desc: hmg-i and hmg-y, dna-binding; transcriptional factor b3; cupredoxin [medicago truncatula]
  misc_feature (155)..(306): NCBI GI: 92872624 NCBI Desc: transcriptional factor b3; cupredoxin [medicago truncatula]
  misc_feature (1)..(172): NCBI GI: 140069093 NCBI Desc: hmg-i and hmg-y, dna-binding; transcriptional factor b3; cupredoxin [medicago truncatula]
  misc_feature (23)..(310): NCBI GI: 140060064 NCBI Desc: transcriptional factor b3; cupredoxin [medicago truncatula]
  misc_feature (193)..(308): NCBI GI: 140069090 NCBI Desc: hmg-i and hmg-y, dna-binding; transcriptional factor b3; cupredoxin [medicago truncatula]
  misc_feature: The sequence is a functional homolog of SEQ ID NO. 467 in the 11/188,298 US application
MRKPGKRSRERDAYFYSDHNDEKDKYFFKVLVGDFRERLAVPEKFEQHFRGLIGNRVKLESRCGHTFDVEVAKNLGKVVLQTGWKEFVTAHDLNMGDFLVFKCDKTSRFKVFIFDLSCCEKVPPCLVKRNHICGRETREMHIEISSSCGDLPMNVTTNSSTSLSDSSGDSVRPEDQKSHCVPGYILPRGTCLTCVQMKKLKERVRASSSRIPIYGCIINNGNVHGRSQALNIPRVYADVYLPFEDQTLMLRCRGKSWEVRCVIKKDKKRVKRLMKGWKQFARDNKLRLGDLCLFELLENTKYTMNVHVIRAK

SEQ ID NO: 12531 - DNA, 1518 bp, Sorghum bicolor
  misc_feature: Ceres ANNOT ID no. 6095042
  misc_feature: Encodes the peptide sequence at SEQ ID NO 12532
atgggttggttgagtaaaatatttaaaggtccagtaaatagagtttcaagaggacactacaacgggaactcccatgaaggctattcaactcagcacactaaatcatatggtgcacatggaaatgaggatgaagacatggatcatgctattgccttatccttatcagaggaagatcaaaggaagggaaagaccattgataccgggcatcatttagatgaagatgaacagcttgcacgggctctgcaagaaaatactggtcatgacctagatgaagatgaacagcttgcacgggctctgcaagaaagtatgaatgatggacctcctcgtcaggacattccaattgaagatgttcacccagaaagtgctccagcaagtagcttgccctcaaatattttcccctcaagtggcttgagggtttgtgctggatgcaaaagtccaattggtcgtggtcggtttctcagttgtatggactctgtctggcaccccgagtgctttaggtgttatgcttgcgatagaccaatatcagagtatgagtttgctgttcatgaaaaccatgcgtaccacaggccttgctacaaggagtgtttccatcctaaatgtgatgtttgcagtagctttattcccacaaataaaagtggcctcattgaataccgggcccatcctttctggatgcagaagtattgtccttcccatgaaaacgatggtacacctaggtgctgcagttgtgaacgaatggagccaaaggacagtcaatacataacattagatgatggccggagactctgcttggagtgtctgcatactgctattatggagaccaatgaatgccagccactatacattgatattcaagaattttatgagggtatgaacatgaaagtagaacaacaagttcccttgcttttggtagagcgacaagctttaaatgaagccatggaagcagagaaatctgtgcaccaccttcctgaaaccagaggcctctgcctatctgaggagcagattgtcagaactatattaaaaaggccaataattggaccaggcaacagaatcatagatatgatcacaggaccatacaaactcgttcgacggtgtgaagtgactgcaattcttatactgtacgggctgccaaggctgttaactggctcgattttggctcatgagatgatgcatgcttacctccgacttaaaggataccgaaccctgagtccagaggttgaagaaggcatctgtcaggttctagctcatctttggcttgagtcagaaatcacatcaggttctggtaccatggcaaccacctcagatgcatcgtcatcatcgtcttcaacatcttcttcatcgaaaaagggtgcaaagacggaatttgaaaaaagacttggcgagttcttcaagcaccaaattgaaacagattcttctgtggcttatggagatgggtttcgagcaggcatgcgagccgttgagcgttacggcttgagaagcactcttgatcatatcaagatgacggggtcttttccatactga

SEQ ID NO: 12532 - protein, 505 aa, Sorghum bicolor
  misc_feature: Ceres ANNOT ID no. 6095042
  misc_feature (140)..(196): Pfam Id: LIM Pfam Desc: LIM domain
  misc_feature (1)..(504): NCBI GI: 115454203 NCBI Desc: os03g0626600 [oryza sativa (japonica cultivar-group)]
  misc_feature (1)..(505): NCBI GI: 55771369 NCBI Desc: lim domain containing protein-like [oryza sativa (japonica cultivar-group)]
  misc_feature (41)..(504): NCBI GI: 140063803 NCBI Desc: lim, zinc-binding; ubiquitin interacting motif; peptidase m, neutral zinc metallopeptidases, zinc-binding site [medicago truncatula]
  misc_feature (138)..(504): NCBI GI: 15221983 NCBI Desc: ubiquitin interaction motif-containing protein / lim domain-containing protein [arabidopsis thaliana]
  misc_feature (128)..(502): NCBI GI: 8954064 NCBI Desc: contains a weak similarity to an actin-binding lim protein, isoform a, from homo sapiens gi4504999 and contains multiple lim proteins pf00412 and ppr repeats pf01535. est
  misc_feature (128)..(502): NCBI GI: 8954064 (continued) gbn96780 comes from this gene. [arabidopsis thaliana]
MGWLSKIFKGPVNRVSRGHYNGNSHEGYSTQHTKSYGAHGNEDEDMDHAIALSLSEEDQRKGKTIDTGHHLDEDEQLARALQENTGHDLDEDEQLARALQESMNDGPPRQDIPIEDVHPESAPASSLPSNIFPSSGLRVCAGCKSPIGRGRFLSCMDSVWHPECFRCYACDRPISEYEFAVHENHAYHRPCYKECFHPKCDVCSSFIPTNKSGLIEYRAHPFWMQKYCPSHENDGTPRCCSCERMEPKDSQYITLDDGRRLCLECLHTAIMETNECQPLYIDIQEFYEGMNMKVEQQVPLLLVERQALNEAMEAEKSVHHLPETRGLCLSEEQIVRTILKRPIIGPGNRIIDMITGPYKLVRRCEVTAILILYGLPRLLTGSILAHEMMHAYLRLKGYRTLSPEVEEGICQVLAHLWLESEITSGSGTMATTSDASSSSSSTSSSSKKGAKTEFEKRLGEFFKHQIETDSSVAYGDGFRAGMRAVERYGLRSTLDHIKMTGSFPY

SEQ ID NO: 12533 - DNA, 1440 bp, Sorghum bicolor
  misc_feature: Ceres ANNOT ID no. 6095089
  misc_feature: Encodes the peptide sequence at SEQ ID NO 12534
atggaaacatacaccaccgatgacgctcttaccctcatcgggtttggaaagttccaagcacttgtccttgcgtatgcaggaatgggttggcttacagaagccatggaggttatgctattatcatttcttggaccagtggtgcgggaagagtggaatgtctctcccgaagatgagagcctgctatccagtgttgtgtttgctggcatgctaattggagcttgtgcctggggctttatttccgacagatatggaagaaagactgttctattgctttcaactctgcttactagtggaatgggttttctaagtgctttatctcctaactacttgtgcttgctggttcttcggttttttgtcggcataggagtgggcagtggccatgtatttacatcttggttcttggagttcgttccagcaggaaatcgtggcacttggatggttattttttcctttttctggactattggcacagtcttggaggcttcacttgcatgggctgtactatccgcattaagttggaggtggttgctggcattgaccgccctgccatgcttcctcttgcttcctttcttcagaattacacctgagtcaccacgctatctttgtgcacaaaatagaatgactgatgcaaggcttgtcctggaaagaatagccattgcaaaccaagcagctcttcctttgggagttctcacataccatcaagaaacaaaaactgactacatcactcatgtttctgaggatgaacaccttattccagtcagagagaaggaacatacagttaggaatgctattagatccaaatctggtgctattgctgcattgcgcgagctattatcacataacttgctcagatcaactcttcttctttggtttgtttactatgcatgttccttcgcttattatgggatagcattgctgtcatcacaactaagtgatgtgaatagaagctgtaaatctggtctgatctttgaagtgcaccaaaacgatggcaatctttataaagatacttttatcactagtttagcagagattccaggcttaattttgtccgctctgcttgttgatcggtttggccggaaagctactatgtggagcctgatgtttgcatgctgtgctttccttgggccactcgtacttcatcagaatgagttgttgacaactactcttctattcggagctcgtgcttgtggcaccggtaccacaacgattttatgtctatatgccccagaggtgtatccgacatctgtacgctcaacgggggtcggaatcgcaaccgccattggtaagatcggcggggttatttgcccactcgtcgccgtgggcatgctgcggaactgccaccagatggaagcagtgctggtgtttgagctggtgctgttcctcgctggagttgcgtgcattctcttccctgtagagaccaagggccgagaaatggactga

SEQ ID NO: 12534 - protein, 479 aa, Sorghum bicolor
  misc_feature: Ceres ANNOT ID no. 6095089
  misc_feature (25)..(436): Pfam Id: MFS_1 Pfam Desc: Major Facilitator Superfamily
  misc_feature (19)..(480): Pfam Id: Sugar_tr Pfam Desc: Sugar (and other) transporter
  misc_feature (3)..(475): NCBI GI: 90265074 NCBI Desc: h0702g05.6 [oryza sativa (indica cultivar-group)]
  misc_feature (85)..(475): NCBI GI: 38567900 NCBI Desc: osjnba0060n03.20 [oryza sativa (japonica cultivar-group)]
  misc_feature (3)..(478): NCBI GI: 92892063 NCBI Desc: major facilitator superfamily [medicago truncatula]
  misc_feature (4)..(478): NCBI GI: 28416475 NCBI Desc: at3g13050/mgh6_16 [arabidopsis thaliana]
  misc_feature (4)..(239): NCBI GI: 15795137 NCBI Desc: transporter-like protein [arabidopsis thaliana]
  misc_feature: The sequence is a functional homolog of SEQ ID NO. 296 in the 11/188,298 US application
  misc_feature: The sequence is a functional homolog of SEQ ID NO. 331 in the 11/188,298 US application
  misc_feature: The sequence is a functional homolog of SEQ ID NO. 449 in the 11/188,298 US application
METYTTDDALTLIGFGKFQALVLAYAGMGWLTEAMEVMLLSFLGPVVREEWNVSPEDESLLSSVVFAGMLIGACAWGFISDRYGRKTVLLLSTLLTSGMGFLSALSPNYLCLLVLRFFVGIGVGSGHVFTSWFLEFVPAGNRGTWMVIFSFFWTIGTVLEASLAWAVLSALSWRWLLALTALPCFLLLPFFRITPESPRYLCAQNRMTDARLVLERIAIANQAALPLGVLTYHQETKTDYITHVSEDEHLIPVREKEHTVRNAIRSKSGAIAALRELLSHNLLRSTLLLWFVYYACSFAYYGIALLSSQLSDVNRSCKSGLIFEVHQNDGNLYKDTFITSLAEIPGLILSALLVDRFGRKATMWSLMFACCAFLGPLVLHQNELLTTTLLFGARACGTGTTTILCLYAPEVYPTSVRSTGVGIATAIGKIGGVICPLVAVGMLRNCHQMEAVLVFELVLFLAGVACILFPVETKGREMD

SEQ ID NO: 12535 - DNA, 1440 bp, Sorghum bicolor
  misc_feature: Ceres ANNOT ID no. 6095090
  misc_feature: Encodes the peptide sequence at SEQ ID NO 12536
atggagacgtatactacagatgacgcacttaccatgatggggtttgggaaattccaagcgcttgttctgttctacgctgggatgggctgggtcgcagaagccatggagctcatgctcttgtcgtttcttggtccgttcattcgagaggaatggaacgtctccccggagaacgagagcctcctttcaagtgttgtctttgctggcatgctgttaggtgcatgtgcttggggctttgtttccgacaaatatggacggaggactggtttaatcttttcaactctgtttactagtggaatgggttttctaagtgctttatctcctaactacttatgcttggtggctcttcggtttctcgttggagtaggagtgggtggcagccatgtgtttatatcttggtttttggaatttgttcctgcacaaaatcgtggcacttggatggttattttttcccttttctggactctcggcacaatcttggaagcttcacttgcatgggttgtattaccagcattgaattggaggtggctgctagtattcaccgcccttccatgcttcctcttgcttcctttctttggactaacacctgagtctccgcgctacctttgtgcacaaaatagaatgtctgatgccactgctgtcctggagagaatggccaatgcaaaccaatcagctcttcctccaggaattctcacatacaatagacaaacaaaatttgatgacgacgctcttgcttctgagagtgaatgtcttcttcctgtcagagagaaggaatgcacagttgacaatgccaagagctccgaatctggctgtcttgcttcattgcgcatactattatcacgcaaactgctcagatcaactcttcttctttggtttgttttctatgcaaattcctttgcttattacgggttagtattgctgacatcacagttgagtgatgcaaataaaaactgtgcatctggtgtaaatgttggtctgcaccaaaaggttaccaatctttacaaagacactttcatcactagtttagcagaaatcccaggtttatttttgtctgctgttcttgttgattggtttggtcgaaaagcttcgatgtggtctatgatgtttgcatgctgtgctttccttggaccacttgtacttcaacagaatgagctgttgacaactattcttctatttggtgcccgtgcgtgtgccatggggagctttacagttttgtgtctttatgctccagaggtatatccaacagttgtccgctcaaccggtgcaggaattgcaaccgccgttggtagaattggtggggttgtttgccctcttgttgctgtcgctatgctgcggagctgccaccagatggaagcactcattgtgtttgaggtgatattatgccttgctgcagttgcctgcatattcttccctgtagagaccaagggccgtggaatggattga

SEQ ID NO: 12536 - protein, 479 aa, Sorghum bicolor
  misc_feature: Ceres ANNOT ID no. 6095090
  misc_feature (25)..(436): Pfam Id: MFS_1 Pfam Desc: Major Facilitator Superfamily
  misc_feature (16)..(480): Pfam Id: Sugar_tr Pfam Desc: Sugar (and other) transporter
  misc_feature (3)..(475): NCBI GI: 90265074 NCBI Desc: h0702g05.6 [oryza sativa (indica cultivar-group)]
  misc_feature (85)..(475): NCBI GI: 38567900 NCBI Desc: osjnba0060n03.20 [oryza sativa (japonica cultivar-group)]
  misc_feature (4)..(478): NCBI GI: 28416475 NCBI Desc: at3g13050/mgh6_16 [arabidopsis thaliana]
  misc_feature (3)..(476): NCBI GI: 92892063 NCBI Desc: major facilitator superfamily [medicago truncatula]
  misc_feature (78)..(475): NCBI GI: 115460440 NCBI Desc: os04g0609200 [oryza sativa (japonica cultivar-group)]
  misc_feature: The sequence is a functional homolog of SEQ ID NO. 296 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 488 in the 11/188,298 US application
METYTTDDALTMMGFGKFQALVLFYAGMGWVAEAMELMLLSFLGPFIREEWNVSPENESLLSSVVFAGMLLGACAWGFVSDKYGRRTGLIFSTLFTSGMGFLSALSPNYLCLVALRFLVGVGVGGSHVFISWFLEFVPAQNRGTWMVIFSLFWTLGTILEASLAWVVLPALNWRWLLVFTALPCFLLLPFFGLTPESPRYLCAQNRMSDATAVLERMANANQSALPPGILTYNRQTKFDDDALASESECLLPVREKECTVDNAKSSESGCLASLRILLSRKLLRSTLLLWFVFYANSFAYYGLVLLTSQLSDANKNCASGVNVGLHQKVTNLYKDTFITSLAEIPGLFLSAVLVDWFGRKASMWSMMFACCAFLGPLVLQQNELLTTILLFGARACAMGSFTVLCLYAPEVYPTVVRSTGAGIATAVGRIGGVVCPLVAVAMLRSCHQMEALIVFEVILCLAAVACIFFPVETKGRGMD

SEQ ID NO: 12537 - DNA, 1020 bp, Sorghum bicolor
  misc_feature: Ceres ANNOT ID no. 6095131
  misc_feature: Encodes the peptide sequence at SEQ ID NO 12538
atggcgccgctcgtgccgatgtcgcagccatgggtggagaaataccggccgaggcaggtcaaggatgtggctcaccaggaggaggtgattcgggtgctcaccaataccctccagaccgccgacctgccgcacatgctgttctacggcccgccgggaacaggaaagaccaccaccgcactcgccatcgcctaccagctctacggtccagagctgtataagtcaagagttttggagctcaatgctagtgatgatcgtggaattaatgttgtgaggacgaaaatcaaggactttgctgctgttgccgttggtactgcacggaaagctggttatccctgtccaccttacaagattattatacttgatgaagcagattcaatgacagaagatgcccagaatgctttgaggcgtaccatggagacttactccaaagtgactagattcttttttatatgcaactatatcagcaggataatagaaccacttgtgtcgagatgtgcaaagtttaggttcaagcctctttcagaagaagtgatgagcaaccgcattatgcacatatgcaatgaagaaggtctcaatcttgatgctcaggcactgtccacactgagtgccatttctcaaggtgatcttcgtcgtgctataacctatcttcagagtgcagctcgcttatttggatcttctatctcttccagtgacttgatcagtgtttcgggggttatccctgaagatgttgtcaagtcactgcttgcagcttgcagatctggtgaatttgacgtggcaaacaaggaagttagcaacattatagcagatggatatccagtctcacagctgatggcacagtttctagatgtcattgttggcgcggatgatattccagatgatcaaaaggcaaggatatgtaaaaagcttggggaaactgacaagtgcttggttgatggggcagatgagtatctacagctgttggatgtcgccagcgagactattcgtgctcttttcaacatgccacaaacgctggtcttctaa

SEQ ID NO: 12538 - protein, 339 aa, Sorghum bicolor
  misc_feature: Ceres ANNOT ID no. 6095131
  misc_feature (237)..(326): Pfam Id: Rep_fac_C Pfam Desc: Replication factor C
  misc_feature (44)..(226): Pfam Id: AAA Pfam Desc: ATPase family associated with various cellular activities(AAA)
  misc_feature (1)..(339): NCBI GI: 115487618 NCBI Desc: os12g0176500 [oryza sativa (japonica cultivar-group)]
  misc_feature (1)..(335): NCBI GI: 92870525 NCBI Desc: chaperonin clpa/b; checkpoint protein rad24; dead/deah box helicase, n-terminal [medicago truncatula]
  misc_feature (1)..(217): NCBI GI: 5263320 NCBI Desc: similar to gbm87339 replication factor c, 37-kda subunit from homo sapiens and is a member of pf00004 atpases associated with various cellular activities. [arabidopsis
  misc_feature (1)..(217): NCBI GI: 5263320 (continued) thaliana]
  misc_feature (10)..(320): NCBI GI: 62858553 NCBI Desc: rfc4 [xenopus tropicalis]
  misc_feature (10)..(320): NCBI GI: 120537910 NCBI Desc: rfc2 protein [xenopus laevis]
MAPLVPMSQPWVEKYRPRQVKDVAHQEEVIRVLTNTLQTADLPHMLFYGPPGTGKTTTALAIAYQLYGPELYKSRVLELNASDDRGINVVRTKIKDFAAVAVGTARKAGYPCPPYKIIILDEADSMTEDAQNALRRTMETYSKVTRFFFICNYISRIIEPLVSRCAKFRFKPLSEEVMSNRIMHICNEEGLNLDAQALSTLSAISQGDLRRAITYLQSAARLFGSSISSSDLISVSGVIPEDVVKSLLAACRSGEFDVANKEVSNIIADGYPVSQLMAQFLDVIVGADDIPDDQKARICKKLGETDKCLVDGADEYLQLLDVASETIRALFNMPQTLVF

SEQ ID NO: 12539 - DNA, 1377 bp, Sorghum bicolor
  misc_feature: Ceres ANNOT ID no. 6095212
  misc_feature: Encodes the peptide sequence at SEQ ID NO 12540
atggccggcctcctcaacctccagtcgacgcttctcccctcggcgtccgcgctgcgccgccgcgcgggcgcgccggggccgtcctcgtcccgccgccgatgccgtgtcgaggccaagatccgggagatcttcatgccggcgctcagctccaccatgaccgagggcaagatcgtctcctggaccgccgccgagggcgaccgactcgccaagggcgaccccgtcgtcgtcgtcgagtccgacaaggccgacatggacgtcgagaccttccacgacggcttcctcgccgccgtcctcgtccccgccggcgagtccgcgcccgtcggctccgccatcgcgctcctcgccgagtccgaggaggagatcccggtcgcccagtcgcaggccgcctccttctcctccagctccccctcgccgccgcctccgcaagaaactgctgctcaagaagagtcccttccgccgccgccacctcctaccccagcgccggtggcagtctctgctcccgcgccgccttcgccagcagcacaaggcggggggcgcgttgttgcttcgccctacgccaagaagctcgccaaggacctcggcgttgatcttttctcggtcacggggtcaggccccggcgggcgaattgtggccaaggatgtcgagtctgcgcttgctgcgcccaagaaggccgtaccagcgactgctgcacggccggatgtgccattgggatcgacggtaccattcacgacaatgcagggtgctgtcagcaagaacatggtggagagccttgccgtcccgacattcagggtcgggtacaccatcacgactgatgctcttgatcagctctacaaaaaaattaagtcaaagggggttacaatgtcagcactattggctaaggcgacggcaatggctctggttcagcatcctgtagtcaactccagctgcagggatgggaagagcttcacatacaacagtagtatcaacattgctgtggcagtggccatagatggtgggttgattacaccggttcttcaagatgctgataagcttgacatttattcattgtcaaggaaatggaaggagttggttgataaggcacgagcaaagcagttgcagcctcatgagtacaactctggcacgtttactctttcgaatcttggtatgtttggagttgataggtttgatgcaatactgccacctggaactggagcaatcatggccgttggggcatcagaaccgaccattgttggtacaaaagatggtagaattgggatcaagaaccaaatgcaggtaaatgttaccgctgatcatcggattatttatggagctgaccttgctgcttttctgcaaacacttgccaagataattgaggatcccaaggatcttacattttaa

SEQ ID NO: 12540 - protein, 458 aa, Sorghum bicolor
  misc_feature: Ceres ANNOT ID no. 6095212
  misc_feature (234)..(458): Pfam Id: 2-oxoacid_dh Pfam Desc: 2-oxoacid dehydrogenases acyltransferase (catalytic domain)
  misc_feature (178)..(216): Pfam Id: E3_binding Pfam Desc: e3 binding domain
  misc_feature (41)..(114): Pfam Id: Biotin_lipoyl Pfam Desc: Biotin-requiring enzyme
  misc_feature (1)..(458): NCBI GI: 115487664 NCBI Desc: os12g0182200 [oryza sativa (japonica cultivar-group)]
  misc_feature (7)..(458): NCBI GI: 8778253 NCBI Desc: f12k21.24 [arabidopsis thaliana]
  misc_feature (36)..(457): NCBI GI: 9279589 NCBI Desc: dihydrolipoamide s-acetyltransferase [arabidopsis thaliana]
  misc_feature (40)..(452): NCBI GI: 16331208 NCBI Desc: dihydrolipoamide acetyltransferase component (e2) of pyruvate dehydrogenase complex [synechocystis sp. pcc 6803]
  misc_feature (40)..(452): NCBI GI: 67923053 NCBI Desc: biotin/lipoyl attachment:catalytic domain of components of various dehydrogenase complexes:e3 binding [crocosphaera watsonii wh 8501]
  misc_feature: Useful for making plants with modulated nitrogen use efficiency
  misc_feature: GREAT-hit functional homolog of the protein sequence given in SEQ ID NO 12881
  misc_feature: Useful for making plants with modulated nitrogen use efficiency
  misc_feature: Functional homolog of the protein sequence given in SEQ ID NO 13720
MAGLLNLQSTLLPSASALRRRAGAPGPSSSRRRCRVEAKIREIFMPALSSTMTEGKIVSWTAAEGDRLAKGDPVVVVESDKADMDVETFHDGFLAAVLVPAGESAPVGSAIALLAESEEEIPVAQSQAASFSSSSPSPPPPQETAAQEESLPPPPPPTPAPVAVSAPAPPSPAAQGGGRVVASPYAKKLAKDLGVDLFSVTGSGPGGRIVAKDVESALAAPKKAVPATAARPDVPLGSTVPFTTMQGAVSKNMVESLAVPTFRVGYTITTDALDQLYKKIKSKGVTMSALLAKATAMALVQHPVVNSSCRDGKSFTYNSSINIAVAVAIDGGLITPVLQDADKLDIYSLSRKWKELVDKARAKQLQPHEYNSGTFTLSNLGMFGVDRFDAILPPGTGAIMAVGASEPTIVGTKDGRIGIKNQMQVNVTADHRIIYGADLAAFLQTLAKIIEDPKDLTF

SEQ ID NO: 12541 - DNA, 645 bp, Sorghum bicolor
  misc_feature: Ceres ANNOT ID no. 6095337
  misc_feature: Encodes the peptide sequence at SEQ ID NO 12542
atgaaaagggagatggtgccttcatggctagagatattactcgcaacacaattctttactacttgtgccaaccatcttcttgcttgccgcaatgagtgtaacctgttttgcactcagtgcgaggctacaccagctgctttctgcaactactgtcgttcaatcaatcattccactcatcgtgtaatccagataaggcgatcatcctatcatgatgttgtgagagtttcagagatcgaggacatccttgatattagtgatgtgcagacttatgtaatcaatagtgcaagggtggtattcttgaatgagcgcccacaactgcgtgcttctggtgtccccatctgtaaggcaccttcgtcatcaacacatagctgcgagacatgcaatcgtgctctacttgatgcatttcgcttctgctctcttggatgcaatcttaaaggcttaaatatggaaatgagtacgccatccatggttgaaaacagtcctcaatccaatggtaaggatcatgtcactatgattgacgatgttggttcaagtactacaagtgacaaagacagctgcaatgacaagaacaatgaagaaccaccaccaaaaagggttgctcgtcaccgacgcaagggaattccccaacgtgcgccattcttctaa

SEQ ID NO: 12542 - protein, 214 aa, Sorghum bicolor
  misc_feature: Ceres ANNOT ID no. 6095337
  misc_feature (22)..(144): Pfam Id: PLATZ Pfam Desc: PLATZ transcription factor
  misc_feature (6)..(144): NCBI GI: 115477823 NCBI Desc: os08g0560300 [oryza sativa (japonica cultivar-group)]
  misc_feature (7)..(186): NCBI GI: 18411153 NCBI Desc: zinc-binding family protein [arabidopsis thaliana]
  misc_feature (7)..(147): NCBI GI: 22136542 NCBI Desc: at1g21000/f9h16_1 [arabidopsis thaliana]
  misc_feature (7)..(213): NCBI GI: 115460222 NCBI Desc: os04g0591100 [oryza sativa (japonica cultivar-group)]
  misc_feature (7)..(213): NCBI GI: 6714272 NCBI Desc: f6n18.8 [arabidopsis thaliana]
MKREMVPSWLEILLATQFFTTCANHLLACRNECNLFCTQCEATPAAFCNYCRSINHSTHRVIQIRRSSYHDVVRVSEIEDILDISDVQTYVINSARVVFLNERPQLRASGVPICKAPSSSTHSCETCNRALLDAFRFCSLGCNLKGLNMEMSTPSMVENSPQSNGKDHVTMIDDVGSSTTSDKDSCNDKNNEEPPPKRVARHRRKGIPQRAPFF

SEQ ID NO: 12543 - DNA, 642 bp, Sorghum bicolor
  misc_feature: Ceres ANNOT ID no. 6095416
  misc_feature: Encodes the peptide sequence at SEQ ID NO 12544
atgaaaagggagacagtgccttcatggctagaactgttgcttgcggcacaattctttacgacttgtgcaaaccatcttcttgttagtcgcaatgagtgtaacctattttgcactcagtgcgaggctacaccaactgctttatgcaaccattgccgttcaagtgatcattccactcatcatgtaatccagataaggcgatcatcctaccatgacgttgtgagggtttcagagattgaggacatccttgatattagcgatgtgcaaacatatgtaatcaatagtgcaagggtcgtattcttgaatgagcgcccacaactgcgtgcttctggtgtccctatttgtaaagcaccttcatcatcaacacatagctgcgagacatgcaatcgtgctctacttggtgcttttcgcttctgttctcttggatgcaatcttagaggcataaatatggaaaggagtacgccagccatggttgaaaacaaccctcaatctgatattaagaatcatttgactattgacagtgttggttcaagtactacaagtgacaaagacagctgcaatgacaataacaacgaagaaccaccaccgaaaagggttgctcgtcaccgacgcaagggaattccccaacgtgcaccgttcttctaa

SEQ ID NO: 12544 - protein, 213 aa, Sorghum bicolor
  misc_feature: Ceres ANNOT ID no. 6095416
  misc_feature (22)..(144): Pfam Id: PLATZ Pfam Desc: PLATZ transcription factor
  misc_feature (6)..(144): NCBI GI: 115477823 NCBI Desc: os08g0560300 [oryza sativa (japonica cultivar-group)]
  misc_feature (4)..(212): NCBI GI: 6714272 NCBI Desc: f6n18.8 [arabidopsis thaliana]
  misc_feature (4)..(212): NCBI GI: 18398555 NCBI Desc: zinc-binding family protein [arabidopsis thaliana]
  misc_feature (7)..(212): NCBI GI: 115460222 NCBI Desc: os04g0591100 [oryza sativa (japonica cultivar-group)]
  misc_feature (62)..(213): NCBI GI: 56202052 NCBI Desc: zinc-binding protein-like [oryza sativa (japonica cultivar-group)]
  misc_feature: The sequence is a functional homolog of SEQ ID NO 668 in the 10/666,642 US patent application
MKRETVPSWLELLLAAQFFTTCANHLLVSRNECNLFCTQCEATPTALCNHCRSSDHSTHHVIQIRRSSYHDVVRVSEIEDILDISDVQTYVINSARVVFLNERPQLRASGVPICKAPSSSTHSCETCNRALLGAFRFCSLGCNLRGINMERSTPAMVENNPQSDIKNHLTIDSVGSSTTSDKDSCNDNNNEEPPPKRVARHRRKGIPQRAPFF

SEQ ID NO: 12545 - DNA, 1488 bp, Sorghum bicolor
  misc_feature: Ceres ANNOT ID no. 6096752
  misc_feature: Encodes the peptide sequence at SEQ ID NO 12546
atgcctccgtcgacaagcacgcggccgcagttgcattgcccggtgccattgctgacgacggtcgtttccatggcgctcctgtgctttcttgtcgttgtcggtgctgatgcaagcagatcgctgcactgccaccggaagcaccagaggcaccaccacggccaccaccgcacggagaactacagccacgtctccatgccccctgtcgcgccacctcctgacgttgatggcgactctccggccgaaccgccagggtggggcaacgtgttcgacgtgagggcgttcggggcgtctggcaacgcctcaggcaacgacacgcgcgcgttccgcgcggcgtggaaggcggcgtgctcgtccaacaccaccacggcgacgctgctggtgccgtcggacggcgtgttcaccatcagctccaccatcttcgccgggccgtgcaagtccgctctgaccttccaaatcgacggcgtgctgatgccgccagacgggccggcgagctggccggcgtcggatagccggaaacagtggatcgtcttctacaaagccgacggcatgacgctggcgggggaaggcacgatcgaaggcaacggtgaggagtggtgggacctcccgtgcaagcctcaccggggcccgaacggatcaacgctgcccgggccatgcgacagccctgcactggtacgattcttctcgagcaacgacgtggcggtgcgcggcctgcgaatcgagaacagcccgcagttccacctcaagttcgacgcctgcgaccgggtgcgcgtcgacggcctcttcgtcagctcgccggcgtccagccccaacacggacggcgtccacgtcgagaacaccacgtccgtccagatcctcaactccaggatctacaacggcgacgactgcgtctccatcggcgccggctgctccgacgtccacatcgagaacataacatgcggccatggccatggcataagcatcggcagcctgggcgtgcacaacacgcgcgcctgcgtgtccaacgtcacggtccggaacgcgcggatcgtcgactccgacaacggcgtacggatcaagacgtggcagggcggcacaggcgcggtgtcggcggtggagttcgccggcgtgcagatgcagaacgtgaagaactgcatcgtcatcgaccagtactactgcctcggaagcgggtgcgccaaccagacctcggcagtgcgcgttgccggcgtcacgtaccgggacatccgcggcacgtacaacccgcaggccgccggcgcgcccatccgcctcgcgtgcagcgacgccgtcgcctgcacggacatcaccatgtccggcgtcgagctgctgccggccagcggtggaggaggaggaggaggacgcgcaggagcgctgcttgcggacccctactgctggaacgcgtacggagtgatggagacgctcacgctgcctcctgtgtactgcttgcaggaaggacgcccggagtctctgcaagatcagctcaccagttgctga

SEQ ID NO: 12546 - protein, 495 aa, Sorghum bicolor
  misc_feature: Ceres ANNOT ID no. 6096752
  misc_feature (116)..(462): Pfam Id: Glyco_hydro_28 Pfam Desc: Glycosyl hydrolases family 28
  misc_feature (45)..(495): NCBI GI: 15294256 NCBI Desc: at1g48100/f21d18_17 [arabidopsis thaliana]
  misc_feature (16)..(488): NCBI GI: 92895433 NCBI Desc: ribosome-binding factor a; glycoside hydrolase, family 28 [medicago truncatula]
  misc_feature (45)..(495): NCBI GI: 8778527 NCBI Desc: f21d18.18 [arabidopsis thaliana]
  misc_feature (60)..(493): NCBI GI: 42566242 NCBI Desc: glycoside hydrolase family 28 protein / polygalacturonase (pectinase) family protein [arabidopsis thaliana]
  misc_feature (223)..(475): NCBI GI: 50313466 NCBI Desc: polygalacturonase [musa acuminata]
  misc_feature: Useful for making plants with altered cell wall content and/or composition
  misc_feature: Functional homolog of the protein sequence encoded by LOCUS at1g48100
  misc_feature: Useful for making plants with altered cell wall content and/or composition
  misc_feature: Functional homolog of the protein sequence given in SEQ ID NO 13718
  misc_feature: The sequence is a functional homolog of SEQ ID NO. 450 in the 11/188,298 US application
MPPSTSTRPQLHCPVPLLTTVVSMALLCFLVVVGADASRSLHCHRKHQRHHHGHHRTENYSHVSMPPVAPPPDVDGDSPAEPPGWGNVFDVRAFGASGNASGNDTRAFRAAWKAACSSNTTTATLLVPSDGVFTISSTIFAGPCKSALTFQIDGVLMPPDGPASWPASDSRKQWIVFYKADGMTLAGEGTIEGNGEEWWDLPCKPHRGPNGSTLPGPCDSPALVRFFSSNDVAVRGLRIENSPQFHLKFDACDRVRVDGLFVSSPASSPNTDGVHVENTTSVQILNSRIYNGDDCVSIGAGCSDVHIENITCGHGHGISIGSLGVHNTRACVSNVTVRNARIVDSDNGVRIKTWQGGTGAVSAVEFAGVQMQNVKNCIVIDQYYCLGSGCANQTSAVRVAGVTYRDIRGTYNPQAAGAPIRLACSDAVACTDITMSGVELLPASGGGGGGGRAGALLADPYCWNAYGVMETLTLPPVYCLQEGRPESLQDQLTSC

SEQ ID NO: 12547 - DNA, 1560 bp, Sorghum bicolor
  misc_feature: Ceres ANNOT ID no. 6096759
  misc_feature: Encodes the peptide sequence at SEQ ID NO 12548
atgaggccggcgccggagacaagcacgcggccgcagctgcgtcgtcgtcgtcgtcctcgtccagtgccattggtgacggtggtcgtgtccgtggcgctcgtctcgctactgtgcctccctgtcgccgcggacgcaagcagagcgctgcaccacaacaaccgggagcagcaccgggggcaccagaaccaccgtacgacggagaacaagaagaacagccacgtctcgctccctcccgacgccgacggcggcgattctccgcccgagcctccggaagctgacggcggtgcgccgccgccgccgctcccgccaccgcctcccgagggcgacgacgactgcggcgacgtgttcgacgtcagggcgttcggcgcgtcgggcggcgacggtggctcgtgcggcgacgacgacacgcccgcgttccgcgcggcgtggaaggcggcgtgctcctccgactccgccacggccacgctgctcgtgccgtccgacggcgtgttcaccatcacctccaccatcttctccgggccgtgcaagcccgacctcaccttccaaatcgacggcgtcctgatgccgcccgacgggccggcgagctggccggcgaccgacagccggaaacagtggatcgtcttctacaaggccgaccgcttgacgctggcgggggaaggcaccatcgaaggcaacggtgaggagtggtgggatctcccgtgcaaacctcacaggggtccaaacggatcgacgctgcccggaccttgcgacagccctgcgctcatacgattcttcttgagcaacgacgtgacggtgtgcggcctgcggatcgagaacagcccgcagttccacctcaggttcgacgactgcgagcgcgtgcgcgtcgacggcctcttcgtcagctcgccggcgtccagccccaacacggacggcgtccacgtcgagaacaccacgtccgtccagatcctcaactccaggatctacaacggcgacgactgcgtctccatcggcgccggatgctccgacgtccacgtcgagaacatcacatgcggccatggccacggcatcagcatcggcagcctgggcgtccacaacacgcacgcctgcgtgtccaacatcacggtccggaacgcgaggatcctcgactccgacaacggcctccggatcaagacgtggcagggcggcaccggcgcggtgacggcggtggagttcgccggcgtgcagatgcagaacgtgaagagctgcatcgtcatcgaccagtactactgcctcggccacgggtgcgccaaccagacctccgcggtgcgcgtggccggggtcacgtacagggacatccacggcacctacaacccgcaggccggcgcgcccatccgcctcgcgtgcagcgacgccgtcgcctgcacggacatcaccatgtccggcgtcgagctgctgccggccggcggagacgagggagcgctgctcgcggacccttactgctggaacgcctacggagtcatggagacgctcacgctgccaccagtctactgcttgctggaaggcagcccggagtctctccaagacccgctcacgagttgctga

SEQ ID NO: 12548 - protein, 519 aa, Sorghum bicolor
  misc_feature: Ceres ANNOT ID no. 6096759
  misc_feature (147)..(486): Pfam Id: Glyco_hydro_28 Pfam Desc: Glycosyl hydrolases family 28
  misc_feature (86)..(519): NCBI GI: 15294256 NCBI Desc: at1g48100/f21d18_17 [arabidopsis thaliana]
  misc_feature (23)..(512): NCBI GI: 92895433 NCBI Desc: ribosome-binding factor a; glycoside hydrolase, family 28 [medicago truncatula]
  misc_feature (88)..(517): NCBI GI: 42566242 NCBI Desc: glycoside hydrolase family 28 protein / polygalacturonase (pectinase) family protein [arabidopsis thaliana]
  misc_feature (254)..(507): NCBI GI: 50313466 NCBI Desc: polygalacturonase [musa acuminata]
  misc_feature (248)..(509): NCBI GI: 23308417 NCBI Desc: at1g60590/f8a5_12 [arabidopsis thaliana]
  misc_feature: Useful for making plants with altered cell wall content and/or composition
  misc_feature: GREAT-hit functional homolog of the protein sequence encoded by LOCUS at1g48100
  misc_feature: Useful for making plants with altered cell wall content and/or composition
  misc_feature: Functional homolog of the protein sequence given in SEQ ID NO 13718
  misc_feature: The sequence is a functional homolog of SEQ ID NO. 450 in the 11/188,298 US application
MRPAPETSTRPQLRRRRRPRPVPLVTVVVSVALVSLLCLPVAADASRALHHNNREQHRGHQNHRTTENKKNSHVSLPPDADGGDSPPEPPEADGGAPPPPLPPPPPEGDDDCGDVFDVRAFGASGGDGGSCGDDDTPAFRAAWKAACSSDSATATLLVPSDGVFTITSTIFSGPCKPDLTFQIDGVLMPPDGPASWPATDSRKQWIVFYKADRLTLAGEGTIEGNGEEWWDLPCKPHRGPNGSTLPGPCDSPALIRFFLSNDVTVCGLRIENSPQFHLRFDDCERVRVDGLFVSSPASSPNTDGVHVENTTSVQILNSRIYNGDDCVSIGAGCSDVHVENITCGHGHGISIGSLGVHNTHACVSNITVRNARILDSDNGLRIKTWQGGTGAVTAVEFAGVQMQNVKSCIVIDQYYCLGHGCANQTSAVRVAGVTYRDIHGTYNPQAGAPIRLACSDAVACTDITMSGVELLPAGGDEGALLADPYCWNAYGVMETLTLPPVYCLLEGSPESLQDPLTSC

SEQ ID NO: 12549 - DNA, 1140 bp, Sorghum bicolor
  misc_feature: Ceres ANNOT ID no. 6096767
  misc_feature: Encodes the peptide sequence at SEQ ID NO 12550
atgtcggcggcgggcggcagccgcgccaccttctcgctgcccgcggcggcagcgacgctgctgctggcgctggcactggcagcagcagcagcagtgtcggcggcggcggcgagcgggttcagctgccgtcctggctcccggccggtgctcttcaacttcggggactccaactccgacacgggcggcatggcggcggccagggggtggcacctcacgcgcccggagggccgcgccttcttcccgcgccccaccggccgcttctgcgacggccgcctcaccatcgacttcctctgtgaaagcttgaacatcagctatttgagcccatttctgaaggcattgggttccaattacagcaacggtgcaaattttgccattgctggtgcagcaacactaccacgagatgttccatttgcgttgcacatacaagtgcaagagttcttgtacttcagagatagatccttggaactcagcgatcaaggtctgagtggtccaatcgatgcacaagggttccaaaatgctctatatatgatagacatagggcagaatgatgtaaacgctcttctgtccaacttgccctatgatcaagttattgccaagttcccaccaattcttgctgagattaaggatgctgtccagactctatatagcaatgctagcaaaaacttttggatacatgggacgggggctctcggttgcctgccacagaagcttgccataccgcggaaaaacgacagcgatcttgatcagtatggctgtctcaagacctataacagagctgcagttgcgttcaacacagcactgggcagcctctgcgatgagctaagcgtgcagatgaaggatgcaacgattgtatacacggatctgttccccatcaagtatgatcttattgccaaccacactaaatatggttttgacaagccgctgatgacatgctgtgggtatggagggcctccctacaactacgatttcaacaagggttgccagtctaaggatgtgacggcctgcgatgacggctcaaagttcgtcagctgggatggcgtgcacctaacagaggcggccaatgcagttgtggccaaagcgatactgagctcacaatactccaagcccaatctcaagtttgatcagttctgcagagtctga

SEQ ID NO: 12550 - protein, 379 aa, Sorghum bicolor
  misc_feature: Ceres ANNOT ID no. 6096767
  misc_feature (50)..(361): Pfam Id: Lipase_GDSL Pfam Desc: GDSL-like Lipase/Acylhydrolase
  misc_feature (99)..(379): NCBI GI: 115436334 NCBI Desc: os01g0330100 [oryza sativa (japonica cultivar-group)]
  misc_feature (21)..(378): NCBI GI: 15223585 NCBI Desc: gdsl-motif lipase/hydrolase family protein [arabidopsis thaliana]
  misc_feature (54)..(350): NCBI GI: 3220021 NCBI Desc: lipase homolog [arabidopsis thaliana]
  misc_feature (46)..(371): NCBI GI: 140071480 NCBI Desc: lipolytic enzyme, g-d-s-l [medicago truncatula]
  misc_feature (48)..(369): NCBI GI: 87240518 NCBI Desc: lipolytic enzyme, g-d-s-l [medicago truncatula]
MSAAGGSRATFSLPAAAATLLLALALAAAAAVSAAAASGFSCRPGSRPVLFNFGDSNSDTGGMAAARGWHLTRPEGRAFFPRPTGRFCDGRLTIDFLCESLNISYLSPFLKALGSNYSNGANFAIAGAATLPRDVPFALHIQVQEFLYFRDRSLELSDQGLSGPIDAQGFQNALYMIDIGQNDVNALLSNLPYDQVIAKFPPILAEIKDAVQTLYSNASKNFWIHGTGALGCLPQKLAIPRKNDSDLDQYGCLKTYNRAAVAFNTALGSLCDELSVQMKDATIVYTDLFPIKYDLIANHTKYGFDKPLMTCCGYGGPPYNYDFNKGCQSKDVTACDDGSKFVSWDGVHLTEAANAVVAKAILSSQYSKPNLKFDQFCRV

SEQ ID NO: 12551 - DNA, 783 bp, Sorghum bicolor
  misc_feature: Ceres ANNOT ID no. 6096924
  misc_feature: Encodes the peptide sequence at SEQ ID NO 12552
atgtctccggcgcccagcggcggcaagcgcgggagggtccccgacccggaggaggacgtctacgtcgacaacctccactcccacaagcgctacctcaccgagataatggcatccagcatgaatggcttgtccgttggagattcagttgctgacagtgtcatggggtccccaatgagactggagaatgtttcttgcattagggatgagataagcatgcagtactcacgtgtgtcagaagagtcagatgattacagatactatgagactcaagtaaacaccaatgggaatcaaacagatgtactgggtaattcgtcaactagtccagcttcatctccacgccgtgtccagaagctacacaactggttctcttctgcatgttcatacactctcccaagctgctccctcccagcagtggtctgctcgcctgctccccgtggttgtggcactgaacaggaaggccggatcccatcctcacctaatgacatgtgccatggtggagatctgaggcgagctgcacttttgagatcggtgcaaatgagggctcagagcccccatccatgtgatgtgctacccagcggtggacatgaacaagaacaagggctttctgatgtacatgctgacgagcttgaacaggatcagaaagaagctgtgggtgtacagttggatcaaaggcctctctcttgtccaaagtcaacccaggatgctgagtaccagagccctataaaccgagaccaacatcctcaccatgacgttgattttgtcaaggatcagattacggtgtga

SEQ ID NO: 12552 - protein, 260 aa, Sorghum bicolor
  misc_feature: Ceres ANNOT ID no. 6096924
  misc_feature (2)..(196): NCBI GI: 61611694 NCBI Desc: early flowering 3 [pisum sativum]
  misc_feature (2)..(196): NCBI GI: 61611694 NCBI Desc: early flowering 3 [pisum sativum]
  misc_feature: Useful for making plants with modulated oxidative stress sensitivity
  misc_feature: Functional homolog of the protein sequence given in SEQ ID NO 13295
MSPAPSGGKRGRVPDPEEDVYVDNLHSHKRYLTEIMASSMNGLSVGDSVADSVMGSPMRLENVSCIRDEISMQYSRVSEESDDYRYYETQVNTNGNQTDVLGNSSTSPASSPRRVQKLHNWFSSACSYTLPSCSLPAVVCSPAPRGCGTEQEGRIPSSPNDMCHGGDLRRAALLRSVQMRAQSPHPCDVLPSGGHEQEQGLSDVHADELEQDQKEAVGVQLDQRPLSCPKSTQDAEYQSPINRDQHPHHDVDFVKDQITV

SEQ ID NO: 12553 - DNA, 1350 bp, Sorghum bicolor
  misc_feature: Ceres ANNOT ID no. 6098347
  misc_feature: Encodes the peptide sequence at SEQ ID NO 12554
  misc_feature: Down-regulated in root tissues in response to aminocyclopropane carboxylic treatment
atggcgtccccgccgccgccagaggccgcaccggctgaggcggggctcgagagtatggagggcctcgtcctggacacggtcatctcaagggccggcgcgcgccccgcagcggcgctcgcctgcgccagcacgcgcctccgcaccgccgtcgccgacgactccctctggcgcagattctgcgctgaggacctggggctcgacgcgcccgtcgatccggagggtcagcctctcccctcgttccaggttgcatataaggtttggttggagtcttttggcatgtaccctctacctatggtaaagagagtgaaacaattttggacttcaatgaaaacttggttgtctgaaaactttcccgaggcatacaaaacgttgtgcaaaggtgtttctgaagctcaattaaagtcggcagaggatgatcttggtttcaagctccctatgcccacaaagctgttgtatcgcttttgcaatgctcaactgccttttagtgaagaccatgatgcaaacaaaagcatttccactcatggattgattgggggctatgcattttatgatcattgggtgaatgtgcatttgtcacctcttgagcaaatagttgaagagacaaaggacttctatcgggagttccctgatgtctttaatgggcgcaacttcattgtagtggcgacttcatggtttcgtccgaaaacgtttcttctagattgctcaaatggtgaactttatgttggtacatacaacttacctataggaggaatgcttccctgtgtccctaaagcattgataaagccagcagagaatgatctagcccaagatggactacttctgtggttagaagagcatcttaggcgtttacagaatggcatgatcaagacccgtatgctgatgacatcgagatatatcagcttatatccagaagcacctccatcatgcagttcagctgttacaaatggcattaaggtacgctcgtctgctgtctttgtgccagaacatcctggggggcctggggaaaaatttatgttcacttactcgattcgcatgtcagttccagaggcatgcatgctaggtggtgtgtactattcttgctgccagctttcctcccgccactggaccatcagatcgtgtgacagggttgtttctgatgtgagcggaggaggtgttattggacagtatcctgtactgttacctggtgaggatgagtttgtctacgagagttgcacgccactgcccaaagtacctggatctgtggagggttctttctcgtttgtgcctggcaagttgatccgacctgaagggaagcctttcgaagtcatggtggcgccattccctcttgaggtgccagaatacatcttctga

SEQ ID NO: 12554 - protein, 449 aa, Sorghum bicolor
  misc_feature: Ceres ANNOT ID no. 6098347
  misc_feature (1)..(449): NCBI GI: 115485029 NCBI Desc: os11g0265200 [oryza sativa (japonica cultivar-group)]
  misc_feature (254)..(447): NCBI GI: 10181216 NCBI Desc: f-box only protein 3 isoform 2 [mus musculus]
  misc_feature (254)..(447): NCBI GI: 50415529 NCBI Desc: fbxo3-prov protein [xenopus laevis]
  misc_feature (254)..(447): NCBI GI: 123229942 NCBI Desc: f-box only protein 3 [mus musculus]
  misc_feature (254)..(447): NCBI GI: 6103643 NCBI Desc: f-box protein fbx3 [homo sapiens]
  misc_feature: Useful for making plants with modulated biomass
  misc_feature: Useful for making plants with modulated heat sensitivity
  misc_feature: Useful for making plants with modulated light quality response
  misc_feature: GREAT-hit functional homolog of the protein sequence given in SEQ ID NO 13434
  misc_feature: GREAT-hit functional homolog of the protein sequence given in SEQ ID NO 13471
  misc_feature: Down-regulated in root tissues in response to aminocyclopropane carboxylic treatment
MASPPPPEAAPAEAGLESMEGLVLDTVISRAGARPAAALACASTRLRTAVADDSLWRRFCAEDLGLDAPVDPEGQPLPSFQVAYKVWLESFGMYPLPMVKRVKQFWTSMKTWLSENFPEAYKTLCKGVSEAQLKSAEDDLGFKLPMPTKLLYRFCNAQLPFSEDHDANKSISTHGLIGGYAFYDHWVNVHLSPLEQIVEETKDFYREFPDVFNGRNFIVVATSWFRPKTFLLDCSNGELYVGTYNLPIGGMLPCVPKALIKPAENDLAQDGLLLWLEEHLRRLQNGMIKTRMLMTSRYISLYPEAPPSCSSAVTNGIKVRSSAVFVPEHPGGPGEKFMFTYSIRMSVPEACMLGGVYYSCCQLSSRHWTIRSCDRVVSDVSGGGVIGQYPVLLPGEDEFVYESCTPLPKVPGSVEGSFSFVPGKLIRPEGKPFEVMVAPFPLEVPEYIF

SEQ ID NO: 12555 - DNA, 1677 bp, Sorghum bicolor
  misc_feature: Ceres ANNOT ID no. 6098591
  misc_feature: Encodes the peptide sequence at SEQ ID NO 12556
atgcccaagccaagatccttgcttctccaccttctcctaacctacacctgctgctttcccaacgccggcgccgatgacgatgccccgccgtcgtcgtcgtcgtcgttccagggagaatggcagctcctccacgcgagcatcggcgtgtcggcgatgcacatgcagctgctcccgggtgacttcgtcctcatgttcgaccgcaccgacacgggtccttccaacatctccctcgccgcgcaggcgccgtgcgcggccaccgccgacgacggcggcgccgccgactgcacggcgcactcggtgctcctggacctccgctccaacgtgctccacccgtacccgctcgccaccaacccgtggtgctcctcgggtgccctgctccccaacggcacgctcctccagaccggcggcttctccagcggcgaccgcgtcgcgcggctcttctccccggccacgggctgggtcgagctcccctcgttcctcgccgcgcggcggtggtacgccaccgacatgatcctccccgacggccgcgtcctcatcctcggcggccgccggcagttcaacctcgagtacttcccgcacgacgacgcgccgccgctgacgctcttcccgttcctggacgagacgacggagcccgacgccgagaacaacctgtacccgttcctccacctcctccccgacggcaccgtcttcgtcttcgccaacgaccgcgccgtcgtcttcgacccctacaaccgcgccccgctccgccgcctcccggccgtccccggcggcgtgccgaggaactacccgtcgtcgggctcgtccgtgctcctccccctccgccccgacgcgcccgcgcacgccgaggtgctggtctgcggcggcgcgccgcggggcgcgtaccacctcgcgctgcggaacggcacgttcgtcgccgccgaccggacctgcgcccgcgtcgcgcccacggacccggaccccgtcgtgtgggcgatcgaggagatgccgacggcgagggtgatgggcgacatggtgctgctgcccacgggcgacgtgctgatcgtgaacggcgccgcggcgggcaccgccgggtgggagctggggcgggagccggtgacgcgtcccgtgctgtacaggccggacgcgccgctgggggagcggttcgacgaggcgtcgctggcggcgtcggcggtggcgaggatgtaccactcgtcggcggcgctggacacgtacggccgcgtgctggtgggcggaagcaacccgcacgtcgggtacgtgttcgccaacgtgacgtacccgacggagctgagcctggaggcgttcctgccgccgtacatggaccggcggcacgacggggcgcggccgcggctgctgtgggcgccggccgaggtcgggtacggcgaggcgacggccgtgaagttcgtggtaccggcgggcgggggggaggtgcgggtggtggcggtggctccggcgttcgcgacgcactcgttcgggatgaaccagcgggcggtggagctcgccgtggggagcgtggcgcagctggaggtcggggtttacgaggccgtggtcgccgcgccgccgacgcccggggtggcgccgcccgggtactacatgtggttcgtggtgcacgccggcgtgcccagcagcagcgccgcgtgggtgcgcatgcggccgctcggacctgcacctgccccctga

SEQ ID NO: 12556 - protein, 558 aa, Sorghum bicolor
  misc_feature: Ceres ANNOT ID no. 6098591
  misc_feature (52)..(288): Pfam Id: Glyoxal_oxid_N Pfam Desc: Glyoxal oxidase N-terminus
  misc_feature (38)..(549): NCBI GI: 7262685 NCBI Desc: weak similarity to glyoxal oxidase (glx2) from phanerochaete chrysosporium gbl47287. [arabidopsis thaliana]
  misc_feature (38)..(546): NCBI GI: 15223754 NCBI Desc: glyoxal oxidase-related [arabidopsis thaliana]
  misc_feature (33)..(550): NCBI GI: 15222300 NCBI Desc: glyoxal oxidase-related [arabidopsis thaliana]
  misc_feature (33)..(549): NCBI GI: 16604507 NCBI Desc: at1g19900/f6f9_4 [arabidopsis thaliana]
  misc_feature (29)..(549): NCBI GI: 20161084 NCBI Desc: glyoxal oxidase precursor-like [oryza sativa (japonica cultivar-group)]
MPKPRSLLLHLLLTYTCCFPNAGADDDAPPSSSSSFQGEWQLLHASIGVSAMHMQLLPGDFVLMFDRTDTGPSNISLAAQAPCAATADDGGAADCTAHSVLLDLRSNVLHPYPLATNPWCSSGALLPNGTLLQTGGFSSGDRVARLFSPATGWVELPSFLAARRWYATDMILPDGRVLILGGRRQFNLEYFPHDDAPPLTLFPFLDETTEPDAENNLYPFLHLLPDGTVFVFANDRAVVFDPYNRAPLRRLPAVPGGVPRNYPSSGSSVLLPLRPDAPAHAEVLVCGGAPRGAYHLALRNGTFVAADRTCARVAPTDPDPVVWAIEEMPTARVMGDMVLLPTGDVLIVNGAAAGTAGWELGREPVTRPVLYRPDAPLGERFDEASLAASAVARMYHSSAALDTYGRVLVGGSNPHVGYVFANVTYPTELSLEAFLPPYMDRRHDGARPRLLWAPAEVGYGEATAVKFVVPAGGGEVRVVAVAPAFATHSFGMNQRAVELAVGSVAQLEVGVYEAVVAAPPTPGVAPPGYYMWFVVHAGVPSSSAAWVRMRPLGPAPAP

SEQ ID NO: 12557 - DNA, 225 bp, Sorghum bicolor
  misc_feature: Ceres ANNOT ID no. 6098782
  misc_feature: Encodes the peptide sequence at SEQ ID NO 12558
atgttgctctatctcagggaggacgaggaacttgttgatcagaagaaatatcttgaggaacgatgcaagccacagtgtgtaaaatcgctttatgagtatgagaaatgtgtcaagagagttgagagtgatgagactggtcacaaacactgcactgggcaatattttgattactggtcatgcattgacaaatgtgtagcaccaaagctctttaagaagctcaaatga

SEQ ID NO: 12558 - protein, 74 aa, Sorghum bicolor
  misc_feature: Ceres ANNOT ID no. 6098782
  misc_feature (12)..(74): Pfam Id: UCR_hinge Pfam Desc: Ubiquinol-cytochrome C reductase hinge protein
  misc_feature (8)..(74): NCBI GI: 115484331 NCBI Desc: os11g0162200 [oryza sativa (japonica cultivar-group)]
  misc_feature (8)..(74): NCBI GI: 488712 NCBI Desc: ubiquinol--cytochrome c reductase [solanum tuberosum]
  misc_feature (8)..(66): NCBI GI: 5103810 NCBI Desc: similar to gbx79273 cytochrome c reductase hinge protein subunit from solanum tuberosum. ests gbt45282 and gbt21596 come from this gene. [arabidopsis thaliana]
  misc_feature (7)..(74): NCBI GI: 66849324 NCBI Desc: ubiquinol-cytochrome c reductase complex 17 kd protein [aspergillus fumigatus af293]
  misc_feature (7)..(73): NCBI GI: 82794475 NCBI Desc: ubiquinol-cytochrome c reductase complex 7.8 kda protein [plasmodium yoelii yoelii str. 17xnl]
  misc_feature (8)..(74): SWISSPROT Homolog: EC 1.10.2.2 Ubiquinol-cytochrome c reductase complex 7.8 kDa protein
MLLYLREDEELVDQKKYLEERCKPQCVKSLYEYEKCVKRVESDETGHKHCTGQYFDYWSCIDKCVAPKLFKKLK

SEQ ID NO: 12559 - DNA, 1407 bp, Sorghum bicolor
  misc_feature: Ceres ANNOT ID no. 6098797
  misc_feature: Encodes the peptide sequence at SEQ ID NO 12560
atggagaccatttcatatccttgttctcctctcctgttctttcctgcacatgaagagagtacctgttcactatggtctcctcaactcaccctccatgagaatgccgccatacctgctaatccttctcctgttgtgagagaagattgtgagttctttgacaccattgctattgattctagtgattcccatgaccaacatgcctttgatgttgatgtattcacccattgtgatgagaggtttctgtgccaagagagtgctaacctgtcggctatccaagatgagctcatggaggagaacagtttgagtgatctccttctcactggtgcagatgcggttgaggctggggattcaagccttgccttggcagtgctctcaaaacttaatagcctcctggctgacacctgtgagaatgctgcaaccagctctttcggtcgcttggcctaccactttgcccaaggcctgcaatcccggatgtctggtacatgctctccatgctacccaccagcggatccagtgcagtctggtatcatgtcggcgcaccagatgatacaagagctatcgccgtatgtcaagtttgcacacttcaccgccaatcaagccattctagatgccaccatcagcgacatggatattcatgtcgtcgacttcaaccttggcgacggcatacagtggccatcgctcatgtcagaccttgctcgccttggcggcaagtcattccaccttacagcaatcataacagatgctggttacagtgacgacactcatcaggcagctgcacggcggctttcagagtttgctgagtccttgaaccttcccttccagtacagctctctctgcatacgccatgaggaggacctggaggacttctccaggaactgtggaggctcagtggttgtctcatgtgacacaacgaatctgtgttacagatcaggtagcaagttacagatgctactacttggctgtgtcaggaagttgcaacccaagtcagtggtggtcatagaagaggagctggtcaggattgggaaagaggcctgtttgtcccaggcctcctttgtggagttcttcttcgaggcattgcaccatttcaccatggtgtttgagtccctgtcgagctgtttcagcagtaacagggcgtgcctgaggcttgtggagaaggaaatgatggggccaaaaatacaggacttcgtggggcagtacgggtctgtgacactggagggcgccgctggtgatccaaaggctttggaagggtttaaatcttgtgagctgagtgcttgcaatgttgctcaggctaggatgctggttgcgctgttcaacaggagctttgggaccgcgcatcagaagggcaggcttcagctgtgctggaagtccagacctttgatctctgtgtctgtttggactcctgtctga

SEQ ID NO: 12560 - protein, 468 aa, Sorghum bicolor
  misc_feature: Ceres ANNOT ID no. 6098797
  misc_feature (75)..(381): Pfam Id: GRAS Pfam Desc: GRAS family transcription factor
  misc_feature (101)..(466): NCBI GI: 84570613 NCBI Desc: transcription initiator for nodulation [lotus corniculatus var. japonicus]
  misc_feature (101)..(466): NCBI GI: 56691734 NCBI Desc: gras family protein [pisum sativum]
  misc_feature (101)..(466): NCBI GI: 56691732 NCBI Desc: gras family protein [medicago truncatula]
  misc_feature (83)..(467): NCBI GI: 112012486 NCBI Desc: scarecrow [pinus sylvestris]
  misc_feature (101)..(468): NCBI GI: 48290382 NCBI Desc: scarecrow [oryza sativa (japonica cultivar-group)]
  misc_feature: The sequence is a functional homolog of SEQ ID NO 438 in the 11/435,388US patent application
  misc_feature: Useful for making plants with modulated growth and phenotype characteristics
  misc_feature: The sequence is a functional homolog of SEQ ID NO 438 in the 20060272060 US patent application
METISYPCSPLLFFPAHEESTCSLWSPQLTLHENAAIPANPSPVVREDCEFFDTIAIDSSDSHDQHAFDVDVFTHCDERFLCQESANLSAIQDELMEENSLSDLLLTGADAVEAGDSSLALAVLSKLNSLLADTCENAATSSFGRLAYHFAQGLQSRMSGTCSPCYPPADPVQSGIMSAHQMIQELSPYVKFAHFTANQAILDATISDMDIHVVDFNLGDGIQWPSLMSDLARLGGKSFHLTAIITDAGYSDDTHQAAARRLSEFAESLNLPFQYSSLCIRHEEDLEDFSRNCGGSVVVSCDTTNLCYRSGSKLQMLLLGCVRKLQPKSVVVIEEELVRIGKEACLSQASFVEFFFEALHHFTMVFESLSSCFSSNRACLRLVEKEMMGPKIQDFVGQYGSVTLEGAAGDPKALEGFKSCELSACNVAQARMLVALFNRSFGTAHQKGRLQLCWKSRPLISVSVWTPV

SEQ ID NO: 12561 - DNA, 426 bp, Sorghum bicolor
  misc_feature: Ceres ANNOT ID no. 6099058
  misc_feature: Encodes the peptide sequence at SEQ ID NO 12562
atggcatccaacaactccattgcttcccctgcgctcctgctgtccgtagccatggcactcgtgttgttcacggctacgacttcagtgcgcgctcagtcaccggccccgacgcctgccgtgatgcctgctgcgccgccaccgccggcaccgacgacgccgccgcctgcaccggcggcaccatcccaaaactcatcatgcccttccggctttcctaactcagcctcattcgctcgaggcgtgagagagtatcttcgccgtggcatcattctcatcttgtccgctgtcaaggtcaccccaggcaccagcaccacaagatgcttttgctatttctctaccaacatcaccatccccgttcccttctcgccgcccattatggtgcccaaccccaatggacccctcgcatgcgtgccaggccgccaaatatga

SEQ ID NO: 12562 - protein, 141 aa, Sorghum bicolor
  misc_feature: Ceres ANNOT ID no. 6099058
  misc_feature (1)..(68): NCBI GI: 4725948 NCBI Desc: pearli 1-like protein [arabidopsis thaliana]
  misc_feature (10)..(67): NCBI GI: 119593699 NCBI Desc: hcg1987685 [homo sapiens]
  misc_feature (17)..(71): NCBI GI: 115377133 NCBI Desc: adventurous gliding motility protein x [stigmatella aurantiaca dw4/3-1]
  misc_feature (12)..(85): NCBI GI: 3745913 NCBI Desc: acmnpv orf91 [bombyx mori nuclear polyhedrosis virus]
  misc_feature (5)..(61): NCBI GI: 115430297 NCBI Desc: cell wall glycoprotein gp3 precursor [chlamydomonas reinhardtii]
MASNNSIASPALLLSVAMALVLFTATTSVRAQSPAPTPAVMPAAPPPPAPTTPPPAPAAPSQNSSCPSGFPNSASFARGVREYLRRGIILILSAVKVTPGTSTTRCFCYFSTNITIPVPFSPPIMVPNPNGPLACVPGRQI

SEQ ID NO: 12563 - DNA, 573 bp, Sorghum bicolor
  misc_feature: Ceres ANNOT ID no. 6099158
  misc_feature: Encodes the peptide sequence at SEQ ID NO 12564
atgggggagcgcaacggcggcgtgagcacgtcatcgacgaccatgagggcggcggcgcaccggggaacgatgccgccgccaccgcagatgcggcccaagataaagatcatccacatcatcgcgccggagatcatcaagaccgacgtcgcccacttccgggacctcgtgcagcagctcaccggcaagcctgctgcctgcgccatcagcagctcggccaactacaccgcaccggtagaagaggagatagagacgacgaccaacaagaggaggctgaggccggcaccagctccggctccggtggcggctgacgagatgagcgatttcatggtgcaagaagagccgatcaagaagaggaagatcaagtgcgaggtgaaggtggagcaagcaggaggcttcggcgattacgacctcgaccgtagcgacctgtggatggatctcaaccccggagggttcttgagcttcttggaggaggaaggcgtcttccagggcctggctgctgaccatgacttcttgcagcctgctgcttttgcctcgtccaggatggatttggttggtgaaatgtacgcatcttga

SEQ ID NO: 12564 - protein, 190 aa, Sorghum bicolor
  misc_feature: Ceres ANNOT ID no. 6099158
  misc_feature (38)..(68): Pfam Id: VQ Pfam Desc: VQ motif
MGERNGGVSTSSTTMRAAAHRGTMPPPPQMRPKIKIIHIIAPEIIKTDVAHFRDLVQQLTGKPAACAISSSANYTAPVEEEIETTTNKRRLRPAPAPAPVAADEMSDFMVQEEPIKKRKIKCEVKVEQAGGFGDYDLDRSDLWMDLNPGGFLSFLEEEGVFQGLAADHDFLQPAAFASSRMDLVGEMYAS

SEQ ID NO: 12565 - DNA, 597 bp, Sorghum bicolor
  misc_feature: Ceres ANNOT ID no. 6099246
  misc_feature: Encodes the peptide sequence at SEQ ID NO 12566
atgcagagagacgacatcgcgacgttggtgtgccagtgccacacgctcggtgcagctgcagctgcagcggacttcgcgagcttctacatgctgcagcacgggcacggatcgctcgcccacgagccgtcctactcctacccgccgggcaccgcggacggttcttggtgcgcgtacggcggcgccggccacggcactggcgccagcgccggcgccggcgcgagcatgggtggcgcgggcgagcagctggagcagcagcaggcgggcgcggcgcgcgacgagcggaaggcgagccggcaggcgtcgaaccgcgagtcggcccggcgcgcgcgcgcccggcggagggggcagctcgacgagctgtcgtcgcgcgtggccgcgctccgcgccgcgaacgcgcggctgaccgtggagctgaaccgcgtggcgaccgcgcgcgcgcgggaggcgcgggagcacgcgcggctcagcgcggaggctggcgcactgcgggagaggctcgcggccgccgaggccgccgctgctgtggcagcgggggccagggacgcggcggagaagggcgatgaggaagcggcaacgccggcggccgagctaagatga

SEQ ID NO: 12566 - protein, 198 aa, Sorghum bicolor
  misc_feature: Ceres ANNOT ID no. 6099246
  misc_feature (90)..(153): Pfam Id: bZIP_1 Pfam Desc: bZIP transcription factor
  misc_feature (56)..(181): NCBI GI: 113367166 NCBI Desc: bzip transcription factor bzip35 [glycine max]
  misc_feature (67)..(193): NCBI GI: 22535725 NCBI Desc: osjnba0062a24.22 [oryza sativa (japonica cultivar-group)]
  misc_feature (92)..(176): NCBI GI: 13430400 NCBI Desc: bzip transcription factor [phaseolus vulgaris]
  misc_feature (88)..(193): NCBI GI: 14289165 NCBI Desc: glip19 [oryza sativa]
  misc_feature (63)..(166): NCBI GI: 456755 NCBI Desc: g-box binding protein [lycopersicon esculentum]
  misc_feature: The sequence is a functional homolog of SEQ ID NO 1226 in the 10/412,699US patent application
  misc_feature: The sequence is a functional homolog of SEQ ID NO 1232 in the 10/412,699US patent application
  misc_feature: The sequence is a functional homolog of SEQ ID NO 1342 in the 10/374,780US patent application
  misc_feature: The sequence is a functional homolog of SEQ ID NO 1343 in the 10/374,780US patent application
  misc_feature: The sequence is a functional homolog of SEQ ID NO 923 in the 10/374,780US patent application
  misc_feature: The sequence is a functional homolog of SEQ ID NO 926 in the 10/374,780US patent application
  misc_feature: Useful for making plants with modulated growth and phenotype characteristics
  misc_feature: The sequence is a functional homolog of SEQ ID NO 1226 in the 20040045049 US patent application
  misc_feature: The sequence is a functional homolog of SEQ ID NO 1232 in the 20040045049 US patent application
  misc_feature: The sequence is a functional homolog of SEQ ID NO 1342 in the 20060162006 US patent application
  misc_feature: The sequence is a functional homolog of SEQ ID NO 1343 in the 20060162006 US patent application
MQRDDIATLVCQCHTLGAAAAAADFASFYMLQHGHGSLAHEPSYSYPPGTADGSWCAYGGAGHGTGASAGAGASMGGAGEQLEQQQAGAARDERKASRQASNRESARRARARRRGQLDELSSRVAALRAANARLTVELNRVATARAREAREHARLSAEAGALRERLAAAEAAAAVAAGARDAAEKGDEEAATPAAELR

SEQ ID NO: 12567 - DNA, 813 bp, Sorghum bicolor
  misc_feature: Ceres ANNOT ID no. 6099302
  misc_feature: Encodes the peptide sequence at SEQ ID NO 12568
atgtcaatccatgggctgatactcgaagtcagagtcaccgggtgccggaagctgcgggacacggagttcttcacccgccaggacccctacgtcgtcctcgagtacgccaccaccaagctccgcacccgcacctgcaccgatgggggaagaaacccaactttcgatgagaagttccatatacccctcattgaagggctccgcgagttgaatgttactgtatggaacagtaacacattaacccatgatgacttcatcggcaatggcagagtgtatctgcacaaggtgctcacaaatggctatgatgactcctcatggtcacttcaaacacgccacatgagatctgctggggaggtgaagctcattatgcatgttgatgtctcagcaatgaagaacaagatgggtaaaagtgttgccgcatcaagtgcacatcctgttcctgcactttcaatgcgagtcccaaccccagccccagccccagctcctgctcctgctcctgctcctgctccagcaccagcaccagcactagcatcagcgattccatacacaggagtcacaccttcatacccacccgtttcaccatatcctgctgcaaccgcataccctgcttacccaactcctagccatgcaccatataccactgcagaatatccaccacctccacagcaaccataccagcccccacctgctggataccctccatcctatccaccgcaaccatatgagcaatcttacccaccgcaaccatatgggcaacaaccatacccgcccccgccggcagcacagtccccgtatccacctgtgggtttggcttag

SEQ ID NO: 12568 - protein, 270 aa, Sorghum bicolor
  misc_feature: Ceres ANNOT ID no. 6099302
  misc_feature (8)..(89): Pfam Id: C2 Pfam Desc: C2 domain
  misc_feature (1)..(97): NCBI GI: 115469114 NCBI Desc: os06g0638900 [oryza sativa (japonica cultivar-group)]
  misc_feature (12)..(123): NCBI GI: 104294978 NCBI Desc: c2 domain-containing protein / protein kinase-related [musa acuminata]
  misc_feature (122)..(266): NCBI GI: 51535584 NCBI Desc: calcium-binding protein-like [oryza sativa (japonica cultivar-group)]
  misc_feature (3)..(249): NCBI GI: 89295985 NCBI Desc: xyppx repeat family protein [tetrahymena thermophila sb210]
  misc_feature (3)..(249): NCBI GI: 18913086 NCBI Desc: igr2p [tetrahymena thermophila]
  misc_feature: Useful for making plants with altered cell wall content and/or composition
  misc_feature: GREAT-hit functional homolog of the protein sequence encoded by LOCUS at4g34150
  misc_feature: Useful for making plants with altered carbohydrate content
  misc_feature: Functional homolog of the protein sequence given in SEQ ID NO 13721
  misc_feature: Useful for making plants with altered cell wall content and/or composition
  misc_feature: Functional homolog of the protein sequence given in SEQ ID NO 13722
MSIHGLILEVRVTGCRKLRDTEFFTRQDPYVVLEYATTKLRTRTCTDGGRNPTFDEKFHIPLIEGLRELNVTVWNSNTLTHDDFIGNGRVYLHKVLTNGYDDSSWSLQTRHMRSAGEVKLIMHVDVSAMKNKMGKSVAASSAHPVPALSMRVPTPAPAPAPAPAPAPAPAPAPALASAIPYTGVTPSYPPVSPYPAATAYPAYPTPSHAPYTTAEYPPPPQQPYQPPPAGYPPSYPPQPYEQSYPPQPYGQQPYPPPPAAQSPYPPVGLA

SEQ ID NO: 12569 - DNA, 930 bp, Sorghum bicolor
  misc_feature: Ceres ANNOT ID no. 6099333
  misc_feature: Encodes the peptide sequence at SEQ ID NO 12570
atggaggccagcggcaagaagctccggccgttcctcctcaccctgctgctggtgctctccaccgccgtgacgcccatcctctcgctgccagagccagacaacgaggtagactgcgactgcgacaagcccaaggcgcccaagccgtcgcactcgcacccgcccaagaccaagccctcccacccatcgccgtcgccgtcgccgaagcccaagaaccccaagccacccaaaggccccgcgtacccggcgccggggcaccagcaaccgcccaagagcccctcctacccgccggtcacgcgtccgccagtcgtcggcccgcccaagggccccgtcacgcgcccgccggtcacgcgtccgccggtcgtcggaccaccggtgacctacccgccgatcatcggcccaccggtcacgcgtccgccggtcgtcgggccaccggtgacctacccgccgattaccggccctccgacgacgccgccggtcgtcggcccaccggtcacctacccgccgatcaccggccctccgtcaaccacgcctccgatcaccggcccgccgtcgacgacgcccccagtcaccggtccgcccgtgacctacccgcccggcggaggcggcggcagctcgacgccgtgcccgccgccgccaccgccatctaccccgaccccgacgccgtcgtcgccgacgtgcccggcggactcgctgaagctgggcgcgtgcgtagacctgctgggcgggctggtgcacatcggcctgggcgacccggtggtgaacaagtgctgcccggtgctggaggggctggtggagctggaggcggccgtgtgcctgtgcaccaccatcaagctcaagctcctcaacatcaacctctacctgcccctggcgctccagctcctcctcacctgcggcaagacgccgccgccgggctacacctgtaccatctga

SEQ ID NO: 12570 - protein, 309 aa, Sorghum bicolor
  misc_feature: Ceres ANNOT ID no. 6099333
  misc_feature (226)..(307): Pfam Id: Tryp_alpha_amyl Pfam Desc: Protease inhibitor/seed storage/LTP family
  misc_feature (43)..(307): NCBI GI: 1155068 NCBI Desc: cell wall-plasma membrane linker protein [brassica napus]
  misc_feature (43)..(307): NCBI GI: 19521 NCBI Desc: proline rich protein [lycopersicon esculentum]
  misc_feature (43)..(307): NCBI GI: 19390 NCBI Desc: proline rich protein [lycopersicon esculentum]
  misc_feature (42)..(307): NCBI GI: 3818416 NCBI Desc: proline-rich cell wall protein [medicago sativa]
  misc_feature (43)..(307): NCBI GI: 2578444 NCBI Desc: ptxa [pisum sativum]
MEASGKKLRPFLLTLLLVLSTAVTPILSLPEPDNEVDCDCDKPKAPKPSHSHPPKTKPSHPSPSPSPKPKNPKPPKGPAYPAPGHQQPPKSPSYPPVTRPPVVGPPKGPVTRPPVTRPPVVGPPVTYPPIIGPPVTRPPVVGPPVTYPPITGPPTTPPVVGPPVTYPPITGPPSTTPPITGPPSTTPPVTGPPVTYPPGGGGGSSTPCPPPPPPSTPTPTPSSPTCPADSLKLGACVDLLGGLVHIGLGDPVVNKCCPVLEGLVELEAAVCLCTTIKLKLLNINLYLPLALQLLLTCGKTPPPGYTCTI

SEQ ID NO: 12571 - DNA, 1677 bp, Sorghum bicolor
  misc_feature: Ceres ANNOT ID no. 6099416
  misc_feature: Encodes the peptide sequence at SEQ ID NO 12572
  misc_feature: Up-regulated in shoot tissues in response to methyl jasmonate treatment
atgagcctcgcggaggcgccgtcgccgtccccgtcgtcgtcgagcgggagcgacgacttcgcggcgctcctcgactccgagctcgagctcgcctccggcgccgactcggccttccctggcgacccctcctccgctttccccgccgccaccgacgacgaggacgaggatgaggacgaggatgaggatccggaggttgaagccgtagagcaaaacggtaccaaaaggcgtagagtggaggaacagctccaagatcaaggaacatcagttaggcctgacaaaattcccactggtgcatctaaaaatgttcaggtcgaggcatgtccacatcctggatattttggtggactttgctttagatgtggcaagccacaagacgaggaaaatgtttcaggagttgcttttggttacatccacaagggcttgaggctaggtacctcagaaattgacagactacgtggtgctgatttgaagaatctgttgcgtgaaagaaaattagtactcattttggacttggatcacacactgatcaactcgaccaaactccaagatatttcttctgctgaaaaagatttgggtattcagactgctgcttcaaaagatgatccaaacagaagcatcttttcactagattcaatgcagatgctcacaaagttgagaccatttgtccgagaatttctgaaagaagcaagcaatatgtttgagatgtatatatacaccatgggtgacaaagcctatgcaattgaaattgcgaagcttcttgaccctagtaacatctattttccttcgaaagtgatttcaaactcagattgcactcagcgacaccagaaaggtcttgatgtgattcttggagctgaaagtgttgcagtgattcttgatgacactgagtatgtatggcagaagcataaagagaacctgattctgatggagagatatcatttctttgcttcaagctgccgacaatttggttttggtgttagatctttgtcagagtcgatgcaagatgaaagggagagtgatggtgctttggctactgttttagatgtcttgaagcgcatacactcgattttctttgacttggctgttgaaactgatctttcttcacaggatgtaagacaggtgatcaaggcggtacggaaggaaatactgcaaggttgcaaaatagtcttcagtcgggtgttcccaaacaatactcgcccacaggagcagatgctctggaagatggccgagcatctgggtgctgtttgctctacagatgtggattccagtgtcacccatgttgtaactgtggatctgggaacagagaaggctcgctggggtgttgccaacaagaagttcttggtccacccacgctggattgaagcagcaaatttccggtggcataggcagccggaggaagattttcctgtcactgccccgaaggaaaagagcagagatatagataatgctgtggctggcaagaaggaaaccagcaaggataaagagaaggaaacgatgaagggcaaggaagaaaatgctgcagctggccagaaggaaacgatgaaggacaaggaagaaaatactgtggctgaccagaaggaaacggggaacgatgaaacaaatgtagccggtcaggagaaagatggtgccaaagaaaatgctgtggccacatctactacaggttatcctactgactcgtaa

SEQ ID NO: 12572 - protein, 558 aa, Sorghum bicolor
  misc_feature: Ceres ANNOT ID no. 6099416
  misc_feature (377)..(456): Pfam Id: BRCT Pfam Desc: BRCA1 C Terminus (BRCT) domain
  misc_feature (156)..(367): Pfam Id: NIF Pfam Desc: NLI interacting factor-like phosphatase
  misc_feature (43)..(475): NCBI GI: 145334837 NCBI Desc: cpl4 (c-terminal domain phosphatase-like 4) [arabidopsis thaliana]
  misc_feature (102)..(469): NCBI GI: 140052388 NCBI Desc: brct; nli interacting factor [medicago truncatula]
  misc_feature (157)..(473): NCBI GI: 144923902 NCBI Desc: brct; nli interacting factor [medicago truncatula]
  misc_feature (149)..(469): NCBI GI: 30685744 NCBI Desc: ctd phosphatase-like protein 3 (cpl3) [arabidopsis thaliana]
  misc_feature (149)..(469): NCBI GI: 22212705 NCBI Desc: ctd phosphatase-like 3 [arabidopsis thaliana]
  misc_feature: Up-regulated in shoot tissues in response to methyl jasmonate treatment
  misc_feature: The sequence is a functional homolog of SEQ ID NO. 347 in the 11/188,298 US application
MSLAEAPSPSPSSSSGSDDFAALLDSELELASGADSAFPGDPSSAFPAATDDEDEDEDEDEDPEVEAVEQNGTKRRRVEEQLQDQGTSVRPDKIPTGASKNVQVEACPHPGYFGGLCFRCGKPQDEENVSGVAFGYIHKGLRLGTSEIDRLRGADLKNLLRERKLVLILDLDHTLINSTKLQDISSAEKDLGIQTAASKDDPNRSIFSLDSMQMLTKLRPFVREFLKEASNMFEMYIYTMGDKAYAIEIAKLLDPSNIYFPSKVISNSDCTQRHQKGLDVILGAESVAVILDDTEYVWQKHKENLILMERYHFFASSCRQFGFGVRSLSESMQDERESDGALATVLDVLKRIHSIFFDLAVETDLSSQDVRQVIKAVRKEILQGCKIVFSRVFPNNTRPQEQMLWKMAEHLGAVCSTDVDSSVTHVVTVDLGTEKARWGVANKKFLVHPRWIEAANFRWHRQPEEDFPVTAPKEKSRDIDNAVAGKKETSKDKEKETMKGKEENAAAGQKETMKDKEENTVADQKETGNDETNVAGQEKDGAKENAVATSTTGYPTDS

SEQ ID NO: 12573 - DNA, 759 bp, Sorghum bicolor
  misc_feature: Ceres ANNOT ID no. 6099546
  misc_feature: Encodes the peptide sequence at SEQ ID NO 12574
atggcaaccaatgagaacctcccaccaaatgtcatcaggcaattggctaaagaactgaagaatcttgatgagtcgcctccagaagggattaatgtgattatcaatgatgatgacttcactactatttttgctgatattgaaggccctgctggaactccatatgagaacggagtgttcaggatgaagctattattgtctcgcgacttccctcattctcccccaaaaggattcttcttgacaaaaattttccatccaaacatagctactagtggcgagatatgtgtaaacacactgaagaaggattggaatcctggccttggattaagacatgttcttctggtagtgagatgccttctgattgaaccatttcctgaatctgcacttaatgaacaagctgggaagatgttacttgaaaattatgaggaatatgcacggcatgcaaggttatacactggcatccatgcccttaaacctaagaataagtccaagactggagctatatctgagtcgaccacagctctgaatgtcgacaagtcgagtactgcttccagcgagaacacaccatcgatgccaccggccgtatcgacctccactgcatccagagcatttggtacgaatttgcaggatcagaaccctactgtttctgatcctgctgtaggagccgcggcggcgcgaaagaaggatggcccaatggcctccaaagttcctgttgataagaaaaagatggatgcgcggaagaagagcctgaagagattatag

SEQ ID NO: 12574 - protein, 252 aa, Sorghum bicolor
  misc_feature: Ceres ANNOT ID no. 6099546
  misc_feature (14)..(151): Pfam Id: UQ_con Pfam Desc: Ubiquitin-conjugating enzyme
  misc_feature (1)..(252): NCBI GI: 92893050 NCBI Desc: ubiquitin-conjugating enzyme, e2 [medicago truncatula]
  misc_feature (1)..(177): NCBI GI: 181916 NCBI Desc: ubiquitin carrier protein
  misc_feature (1)..(177): NCBI GI: 345829 NCBI Desc: ubiquitin carrier protein e2 - human
  misc_feature (1)..(177): NCBI GI: 41107527 NCBI Desc: ube2s protein [homo sapiens]
  misc_feature (5)..(170): NCBI GI: 85724838 NCBI Desc: cg8188-pb, isoform b [drosophila melanogaster]
  misc_feature (1)..(177): SWISSPROT Homolog: EC 6.3.2.19 Ubiquitin-conjugating enzyme E2 S
  misc_feature: The sequence is a functional homolog of SEQ ID NO. 431 in the 11/188,298 US application
MATNENLPPNVIRQLAKELKNLDESPPEGINVIINDDDFTTIFADIEGPAGTPYENGVFRMKLLLSRDFPHSPPKGFFLTKIFHPNIATSGEICVNTLKKDWNPGLGLRHVLLVVRCLLIEPFPESALNEQAGKMLLENYEEYARHARLYTGIHALKPKNKSKTGAISESTTALNVDKSSTASSENTPSMPPAVSTSTASRAFGTNLQDQNPTVSDPAVGAAAARKKDGPMASKVPVDKKKMDARKKSLKRL

SEQ ID NO: 12575 - DNA, 1062 bp, Sorghum bicolor
  misc_feature: Ceres ANNOT ID no. 6099587
  misc_feature: Encodes the peptide sequence at SEQ ID NO 12576
atgttcccttcttcctccaagaagcaggcggccagcactggcgcggcgagctcaaatgatcggcctactactatgtgcgggcaagccggcggcgactccggcggcctcgtcctcaccaccgaccccaagccccgcctccggtggacgcccgagctccatgaccgcttcgtcgatgccgtcgcccagctcggtggcccagacaaggcaacgccaaagaccatcatgagggttatgggagtcaagggcctcaccctctaccatctcaagagtcacctccagaaattcaggctagggaagcagcacaaggagttcggtgaccatacagcaatggagatgcaacgtagcgtggcctcttcttcaggcgtgatagcaagaagcatgaacgaccgcagcgtgaacgtgaacgaggcactaaggatccaaatggaagtccaaagaaggctccatggagaactagaggtgcagaagcacctccagatgagggttgaagcccaggggaagtacatgcagtccatcgtggagaaagcataccaagccctgggttccagcgactgcaccacgtggcccgcagggtacagatctctaggcagcagccaggcggtccttgacatcggcaccagttccacgagcttctcctccgtccaggacctgcagggcttctatggaggaagcagccacatggaccagctcctgcatcagatggagaggccaatggatggcttcctgacgttgggcgagagctgcttcattgggtcagcagacaacaagaagggccctaaccattgcagctccagtggcaagagctcgatgacgatgtgggctagcgaagagcagcagcagcagcaggcaaagagcggcaacgatcagctccagatggggtcgtcgtcgacgaggatggagggtgcaggcactgatgtaatggatccggtcaccggcctgtacgagggtgccatatcgggagactccatggacagcaagggctttgagggttcgagctccaggcttaagatgaagccgcctgcacaacaagcacctgtaggaagtcagaggatacgtatatag

SEQ ID NO: 12576 - protein, 353 aa, Sorghum bicolor
  misc_feature: Ceres ANNOT ID no. 6099587
  misc_feature (45)..(96): Pfam Id: Myb_DNA-binding Pfam Desc: Myb-like DNA-binding domain
  misc_feature (12)..(351): NCBI GI: 115469404 NCBI Desc: os06g0664800 [oryza sativa (japonica cultivar-group)]
  misc_feature (1)..(327): NCBI GI: 115444531 NCBI Desc: os02g0174000 [oryza sativa (japonica cultivar-group)]
  misc_feature (25)..(327): NCBI GI: 49388972 NCBI Desc: myb family transcription factor-like [oryza sativa (japonica cultivar-group)]
  misc_feature (17)..(351): NCBI GI: 56269839 NCBI Desc: myb family transcription factor-related protein [populus tomentosa]
  misc_feature (75)..(352): NCBI GI: 52076503 NCBI Desc: myb family transcription factor-like [oryza sativa (japonica cultivar-group)]
  misc_feature: The sequence is a functional homolog of SEQ ID NO 1097 in the 11/479,226US patent application
  misc_feature: The sequence is a functional homolog of SEQ ID NO 1233 in the 10/666,642US patent application
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 2402 in the 10/374,780US patent application
  misc_feature: The sequence is a functional homolog of SEQ ID NO 548 in the 10/225,066US patent application
  misc_feature: Useful for making plants with altered Lignin content
  misc_feature: Useful for making plants with altered alkaloid content
  misc_feature: Useful for making plants with modulated growth and phenotype characteristics
  misc_feature: GREAT-hit functional homolog of the protein sequence given in SEQ ID NO 13089
  misc_feature: The sequence is a functional homolog of SEQ ID NO 548 in the 20050160493 US patent application
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1233 in the 20070033671 US patent application
  misc_feature: Useful for making plants with altered alkaloid content
  misc_feature: Useful for making plants with altered lignin content
  misc_feature: Functional homolog of the protein sequence given in SEQ ID NO 13089
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: Useful for making plants with altered terpenoid content
  misc_feature: Functional homolog of the protein sequence given in SEQ ID NO 13070
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
MFPSSSKKQAASTGAASSNDRPTTMCGQAGGDSGGLVLTTDPKPRLRWTPELHDRFVDAVAQLGGPDKATPKTIMRVMGVKGLTLYHLKSHLQKFRLGKQHKEFGDHTAMEMQRSVASSSGVIARSMNDRSVNVNEALRIQMEVQRRLHGELEVQKHLQMRVEAQGKYMQSIVEKAYQALGSSDCTTWPAGYRSLGSSQAVLDIGTSSTSFSSVQDLQGFYGGSSHMDQLLHQMERPMDGFLTLGESCFIGSADNKKGPNHCSSSGKSSMTMWASEEQQQQQAKSGNDQLQMGSSSTRMEGAGTDVMDPVTGLYEGAISGDSMDSKGFEGSSSRLKMKPPAQQAPVGSQRIRI

SEQ ID NO: 12577 - DNA, 492 bp, Sorghum bicolor
  misc_feature: Ceres ANNOT ID no. 6099607
  misc_feature: Encodes the peptide sequence at SEQ ID NO 12578
atggctcgccgattgtgccgtctctatcgcctcgtctccgcatccgcctccgcctccgccgccccgagacctcaccacctccccttcgccgtgaaccctagccccgcgcccctcgccccctcctcgtcggcatcgtcgccgcccggtggttccagcatggtggtcgtgggctccgcggattccttcaacagcatcctttccaaggtgcaagatgagaagctaccagccgtgttctactacacggccgtgtggtgtggaccatgtagggcgattgcacctcttgtatctaaattgagcagccagtatcctaagatacctgtatacaaagttgacattgaattggaaggactgggaaacaaactccatggtctaaatatatgttcagtgcctacgtttcacttctatcacaaggggcagaagattgatgaaattgtgggtgctgatggaaagaaacttcaagctggcatggaaagtctccacaagcagcagtag

SEQ ID NO: 12578 - protein, 163 aa, Sorghum bicolor
  misc_feature: Ceres ANNOT ID no. 6099607
  misc_feature (53)..(159): Pfam Id: Thioredoxin Pfam Desc: Thioredoxin
  misc_feature (51)..(161): NCBI GI: 20147405 NCBI Desc: at2g20920/f5h14.11 [arabidopsis thaliana]
  misc_feature (55)..(161): NCBI GI: 9755396 NCBI Desc: f17f8.6 [arabidopsis thaliana]
  misc_feature (50)..(154): NCBI GI: 17943430 NCBI Desc: chain b, crystal structure of a mutated thioredoxin, d30a, from chlamydomonas reinhardtii
  misc_feature (50)..(154): NCBI GI: 840741 NCBI Desc: thioredoxin h [chlamydomonas reinhardtii]
  misc_feature (50)..(154): NCBI GI: 17943432 NCBI Desc: chain b, crystal structure of wt thioredoxin h from chlamydomonas reinhardtii
MARRLCRLYRLVSASASASAAPRPHHLPFAVNPSPAPLAPSSSASSPPGGSSMVVVGSADSFNSILSKVQDEKLPAVFYYTAVWCGPCRAIAPLVSKLSSQYPKIPVYKVDIELEGLGNKLHGLNICSVPTFHFYHKGQKIDEIVGADGKKLQAGMESLHKQQ

SEQ ID NO: 12579 - DNA, 2151 bp, Sorghum bicolor
  misc_feature: Ceres ANNOT ID no. 6099810
  misc_feature: Encodes the peptide sequence at SEQ ID NO 12580
atggcttcacgcatgacgccttccaagaggccgtttcagaaaaattcttcagactacaatggccggggcaagtggcagaagacaaagcattcttctccacacaagtctcagttcaaaattgagcctggtgttcccttttttcgtattctctgcccagcttcaaaatctggtaatgtaattggcaaaggaggtgccattattgcaaagatacgggaagaaaccaggatgagaatcagggttgatagagcagcccccggctgcgatgagagagttatttttataactgctgttgacaaggatgaagaagctagcagcgaacgaggcgtagagaatgaccgaggtgttgctgcttctactggtgctggccatgatagggatggagataacagcaaggagggaaatgatgatccagagggaaacaacagcaaggaacagaatgatgattcggagaaaggaaacggtaaggaagaagaagacggtttggagaaagaccacagtactgaagaaaaggatgattcagagaaagaccacattagggaagagaaggatcattcagagaaagaacatgataaggaagaaaaggatgatccttttgttgcaaaagttgcagagtcagaaccagagagggtaataccatcggcactaaaggccatttcgcttgtctttgataggatttttgcagctggagataataatgaaactgggaatgcgtctgctgcaagcactcctgtttctttgcgattgttggtgctgtacagccaagcaggttggctcttgggtaagggtggtagtgtgattaagcaaatgtcagctgataacggctgtgaaatccgtgttttgagagacaaccttccatcatgtgcattattgaatgacaaactttgccagatcactggagagattgactcagtaaggaaaggtctcaatgctgtatctgaattgctcttagctcatccacccaaggaaactgatgcagtttctggtgttcattcttctggatcatcatcacgttctttgttcaaccagtctgatggtcttccttcaggaatgcaatctaacttccatatccctttgcaaggaccatcccaagccaatggaccttttgatatcattgatcttcaacctccgatacatggccatgcctcagtgcctatagaatccctctcctttaggatgctgtgtccacaagacaaggttggcagtataataggcaagggtggaaatattgttaaaactattcaaaaggatacgggctgtgaaattaaagttcttgacactgttccaaaatcagaagatcgcatcataagtatatctggacctgcgcatccgagtgatggaatttcccctgcacagaatgccattctgcatgtgcagcgtaaaattatgttacctacctctgataagaaggaaggtcctgcaatatgtaggctgatcgtttcagcaaaccaagttggttgtgttctcggcaaaggtggtagtatcatagctgaaatgaggaagctgtcaggagcatttataatagtgttgagcaaagacaagattccaaggggtgtcccagagcatgatgaagttgttcagataagcgggagttgtgaagctattcaagaagctctaatgcagattactgctaggcttcgcaaccaccttttccgggtggacagaatgcctgcaatggggcctaatatgcggccaccttttggtttgttagattctcagtttggtccatttgcgggaaaccatgaatctccatccctgtttcataaagattttatgggacggccattggatgggatctctgctccttggacagtgaagggcatgcgtgatctcagcgatccattgtcaatatctgatatacctggagcagggcatagagaagctggtggattttctggtcctggtcagccatctatgatgccaaacttgactgcagaggtcttagttccaagattaattatccctgctctctgtagtgaggatggaggttgtttggataggattcgtgagttttctgaagctaagataactgttgctgaacctatagccgatgcaatggacattcctgttttgatatctggcacaccagaccagatgcatgcagcccgaagtcttgttcaagcatttgtcatgagcgaatcatttgccccataa

SEQ ID NO: 12580 - protein, 716 aa, Sorghum bicolor
  misc_feature: Ceres ANNOT ID no. 6099810
  misc_feature (46)..(109): Pfam Id: KH_1 Pfam Desc: KH domain
  misc_feature (245)..(311): Pfam Id: KH_1 Pfam Desc: KH domain
  misc_feature (389)..(454): Pfam Id: KH_1 Pfam Desc: KH domain
  misc_feature (474)..(541): Pfam Id: KH_1 Pfam Desc: KH domain
  misc_feature (250)..(716): NCBI GI: 115435534 NCBI Desc: os01g0235800 [oryza sativa (japonica cultivar-group)]
  misc_feature (269)..(716): NCBI GI: 56783855 NCBI Desc: hen4 -like [oryza sativa (japonica cultivar-group)]
  misc_feature (155)..(632): NCBI GI: 92896300 NCBI Desc: kh, type 1 [medicago truncatula]
  misc_feature (208)..(582): NCBI GI: 140064615 NCBI Desc: kh, type 1 [medicago truncatula]
  misc_feature (230)..(714): NCBI GI: 8809595 NCBI Desc: rna-binding protein-like [arabidopsis thaliana]
MASRMTPSKRPFQKNSSDYNGRGKWQKTKHSSPHKSQFKIEPGVPFFRILCPASKSGNVIGKGGAIIAKIREETRMRIRVDRAAPGCDERVIFITAVDKDEEASSERGVENDRGVAASTGAGHDRDGDNSKEGNDDPEGNNSKEQNDDSEKGNGKEEEDGLEKDHSTEEKDDSEKDHIREEKDHSEKEHDKEEKDDPFVAKVAESEPERVIPSALKAISLVFDRIFAAGDNNETGNASAASTPVSLRLLVLYSQAGWLLGKGGSVIKQMSADNGCEIRVLRDNLPSCALLNDKLCQITGEIDSVRKGLNAVSELLLAHPPKETDAVSGVHSSGSSSRSLFNQSDGLPSGMQSNFHIPLQGPSQANGPFDIIDLQPPIHGHASVPIESLSFRMLCPQDKVGSIIGKGGNIVKTIQKDTGCEIKVLDTVPKSEDRIISISGPAHPSDGISPAQNAILHVQRKIMLPTSDKKEGPAICRLIVSANQVGCVLGKGGSIIAEMRKLSGAFIIVLSKDKIPRGVPEHDEVVQISGSCEAIQEALMQITARLRNHLFRVDRMPAMGPNMRPPFGLLDSQFGPFAGNHESPSLFHKDFMGRPLDGISAPWTVKGMRDLSDPLSISDIPGAGHREAGGFSGPGQPSMMPNLTAEVLVPRLIIPALCSEDGGCLDRIREFSEAKITVAEPIADAMDIPVLISGTPDQMHAARSLVQAFVMSESFAP

SEQ ID NO: 12581 - DNA, 984 bp, Sorghum bicolor
  misc_feature: Ceres ANNOT ID no. 6099821
  misc_feature: Encodes the peptide sequence at SEQ ID NO 12582
atgcacccacccacagccacaggccgccgccgcgacctccccggcgccgccgccagaggaggtggggaattcaccaggcagcacccaccaccagcggggccgggccgcctcttcttcatgccgccgccggcgccggcgccaccggggcacaaccaccgcccacgaccaccggatcgcgaccgccccttcttcatgccgccgcccgcgccaccaggccgctcgcacagcaaccaaccgtcgccagcggacccgcccaccgccagcaccaggcctcctcctcctccgccgccgccgccacacccacacgcgtacgccaactacgaccccgccggcagcgccgccgacgagctcccccgccgtccccctcaccctccgccgccgccgctcccacccccacgccgcccgtcaacatccccgtgctcctccgcgctatcctcctgcctcgtcgcgacggcgttcctgcttctgtcagcgggcgtcgcaggcaccgcgctgttcctgctctaccgccctcggccccccgacatcgcggtggccgccgtgcgcctgccgtccttctcggcgtccaacggcaccgtcgccttcacgttcgagcagacggcggcggtgcgcaacccgaaccggtccccgctcgcgcacttcgacagctccctccgcgtcgcctacgcgggcggggaactcggcgccgtctacatccccgcgggcctcatcgatggtggaaccaccaagcacgtgtccgccgtcttcgacgtacccgccatccccgtcgccgcccagccgcccatgctcgggggggccgtcgacgcagcgtccgccgctcagtcacagcagcagccgccggcggtcatcgaggtccactcgttgctcgttgtcaagggcagagtcaacgtcctccgcgtcctcacgcaccgtgtccaggccgccaagctctgccgcgtcggcgtctcgccgctcgacggcaccgtgatcggcttccgctgctga

SEQ ID NO: 12582 - protein, 327 aa, Sorghum bicolor
  misc_feature: Ceres ANNOT ID no. 6099821
  misc_feature (166)..(311): Pfam Id: Hin1 Pfam Desc: Harpin-induced protein 1 (Hin1)
  misc_feature (66)..(327): NCBI GI: 115435516 NCBI Desc: os01g0234700 [oryza sativa (japonica cultivar-group)]
  misc_feature (137)..(327): NCBI GI: 92898073 NCBI Desc: harpin-induced 1 [medicago truncatula]
  misc_feature (14)..(139): NCBI GI: 115473145 NCBI Desc: os07g0596300 [oryza sativa (japonica cultivar-group)]
  misc_feature (23)..(135): NCBI GI: 56207762 NCBI Desc: wiskott-aldrich syndrome, like [danio rerio]
  misc_feature (23)..(135): NCBI GI: 28279905 NCBI Desc: wiskott-aldrich syndrome-like [danio rerio]
MHPPTATGRRRDLPGAAARGGGEFTRQHPPPAGPGRLFFMPPPAPAPPGHNHRPRPPDRDRPFFMPPPAPPGRSHSNQPSPADPPTASTRPPPPPPPPPHPHAYANYDPAGSAADELPRRPPHPPPPPLPPPRRPSTSPCSSALSSCLVATAFLLLSAGVAGTALFLLYRPRPPDIAVAAVRLPSFSASNGTVAFTFEQTAAVRNPNRSPLAHFDSSLRVAYAGGELGAVYIPAGLIDGGTTKHVSAVFDVPAIPVAAQPPMLGGAVDAASAAQSQQQPPAVIEVHSLLVVKGRVNVLRVLTHRVQAAKLCRVGVSPLDGTVIGFRC

SEQ ID NO: 12583 - DNA, 1107 bp, Sorghum bicolor
  misc_feature: Ceres ANNOT ID no. 6099824
  misc_feature: Encodes the peptide sequence at SEQ ID NO 12584
atggctctcaagaagttgctgcagctcttttgtgtcggcaagaaggattccaagaagaaaggcaaatccattgacccactctggcgagcctctgcttccctctcctctgtgagtgtcactgcaaacaagactcatttggatccctgttcaagtgggactggcactgtatgcgtgcaaaaccatgaacctgaatgctcaagtatggtttcctcatgggcaaggacagagcatggaactgagagtactgatcatatgtcttttaaacaatttgatgttgtccaagatttctcggatcaccactatgcaaagacttcagcaggaaaggtcaccaaagattgggtgaaggcaatccaaagtgaatggagtcttctacagaaaaacctacctgaatctatatatgttagagtttatgaggacaggactgatctgctcagggctgcaatagttgggccggctggaactccatatcatgatggcctgttcttcttcgatgtccgttttccttctgaatacccgaagtgcccaccaaaagtttactaccattcgggtggacttcggctaaacccaaacctgtatgagagtgggaaagtctgcctgagccttctgaacacctggtggggcaatggatgcgagaagtggggcaagtcgaattccaccatgctgcaagttttggtctccatccagggccttgtgctgaatgataagccatacttcaatgagccaggaaacaaaaattcagctcaaacaacagctggtgaaaggtattccttggcttacaatcagacgaccttcgtcagatcatgcaagacaatgctgtattcactccggaagcctccaaagcattttgagacccttgtaatgtgccacttcctcaagcatgagcgtgccatcctcgacgcctgcagcgcttacatgtctgggacaatcgtggggtcatctgttgggagcgaccttaaatatgcccgtgacaagtgctttgcagatttccacaagtcactgacgctctacactgaacatctcaggactgagtttgctgcaaacagaagacgcatgcttgagctggagagagaggtgtcacctgcgcaggagatcgtgcctagcagctag

SEQ ID NO: 12584 - protein, 368 aa, Sorghum bicolor
  misc_feature: Ceres ANNOT ID no. 6099824
  misc_feature (116)..(265): Pfam Id: UQ_con Pfam Desc: Ubiquitin-conjugating enzyme
  misc_feature (1)..(365): NCBI GI: 56783940 NCBI Desc: ubiquitin-conjugating enzyme -like [oryza sativa (japonica cultivar-group)]
  misc_feature (84)..(344): NCBI GI: 50726452 NCBI Desc: ubiquitin-conjugating enzyme-like protein [oryza sativa (japonica cultivar-group)]
  misc_feature (61)..(314): NCBI GI: 56783934 NCBI Desc: ubiquitin-conjugating enzyme -like [oryza sativa (japonica cultivar-group)]
  misc_feature (87)..(317): NCBI GI: 115462765 NCBI Desc: os05g0232500 [oryza sativa (japonica cultivar-group)]
  misc_feature (60)..(344): NCBI GI: 92881363 NCBI Desc: ubiquitin-conjugating enzyme, e2 [medicago truncatula]
MALKKLLQLFCVGKKDSKKKGKSIDPLWRASASLSSVSVTANKTHLDPCSSGTGTVCVQNHEPECSSMVSSWARTEHGTESTDHMSFKQFDVVQDFSDHHYAKTSAGKVTKDWVKAIQSEWSLLQKNLPESIYVRVYEDRTDLLRAAIVGPAGTPYHDGLFFFDVRFPSEYPKCPPKVYYHSGGLRLNPNLYESGKVCLSLLNTWWGNGCEKWGKSNSTMLQVLVSIQGLVLNDKPYFNEPGNKNSAQTTAGERYSLAYNQTTFVRSCKTMLYSLRKPPKHFETLVMCHFLKHERAILDACSAYMSGTIVGSSVGSDLKYARDKCFADFHKSLTLYTEHLRTEFAANRRRMLELEREVSPAQEIVPSS

SEQ ID NO: 12585 - DNA, 975 bp, Sorghum bicolor
  misc_feature: Ceres ANNOT ID no. 6099855
  misc_feature: Encodes the peptide sequence at SEQ ID NO 12586
atgggtggaggagaattcaggagctctttgctgcagcagatggtgtggaggagtagtggcggtggtacagacagcaagaatatgatgagtagtttgatgccttgtgctgaggaggaggaggagcaagaagaggtctccaacaagatgccccccttatcttctccttcttccatgctcctcccccagcacctccttcaaatctcctctggtggcctgcctctgcctctgcctccagatgtgctgaacgacagctctgctacttctgatctgcatgatgggcgggaaagcaacatgccggagtcatggagccagctgctgcttgggggattagtcggagatcatgagagatacaacgctgccacagctttactgtcaaaaggattagaggaggggcctgcagcttacaatttctatgggcatgggcatggtggtgacgagatccagacgtcggggaccaacagtaagtctcatcaggtgagccagacgctcttggcgtcgtcctctccaaggtcctgcatcaccacaagcctcggcagcaacatgttggacttctcaaacaccaccgtcccggcaccagagctgaagaatcatcactccgataactcttctgagggtaacagcgctgcaagtggttcggctccaaagaaggctagggttcagacctcttcttcagcacagtctactctaaaggtgagaaaggagaggcttggggatagaatcacagcacttcaccagatagtatccccatttggcaagactgacactgcctccgtcctacaggagactataggctatatcagattcctcctgagtcaaatcgagctcaggaaggatttacggagcagagggctgtgcctggtgccggtgtcgtgcacgtcccacctcgccgacgacaacggcgcctccgacttctgggccgtggccgcggcgccgcctcctccgccgccgccgctcgccggcatcatctggcgatag

SEQ ID NO: 12586 - protein, 324 aa, Sorghum bicolor
  misc_feature: Ceres ANNOT ID no. 6099855
  misc_feature (133)..(274): NCBI GI: 115462743 NCBI Desc: os05g0228400 [oryza sativa (japonica cultivar-group)]
  misc_feature (129)..(274): NCBI GI: 115435468 NCBI Desc: os01g0230200 [oryza sativa (japonica cultivar-group)]
  misc_feature (166)..(274): NCBI GI: 50252498 NCBI Desc: ethylene-responsive family protein-like [oryza sativa (japonica cultivar-group)]
  misc_feature (166)..(274): NCBI GI: 115445533 NCBI Desc: os02g0276900 [oryza sativa (japonica cultivar-group)]
  misc_feature (72)..(274): NCBI GI: 140051379 NCBI Desc: helix-loop-helix dna-binding [medicago truncatula]
  misc_feature: The sequence is a functional homolog of SEQ ID NO 562 in the 10/666,642US patent application
  misc_feature: The sequence is a functional homolog of SEQ ID NO 566 in the 10/666,642US patent application
  misc_feature: Useful for making plants with modulated growth and phenotype characteristics
  misc_feature: The sequence is a functional homolog of SEQ ID NO 562 in the 20070033671 US patent application
  misc_feature: The sequence is a functional homolog of SEQ ID NO 566 in the 20070033671 US patent application
MGGGEFRSSLLQQMVWRSSGGGTDSKNMMSSLMPCAEEEEEQEEVSNKMPPLSSPSSMLLPQHLLQISSGGLPLPLPPDVLNDSSATSDLHDGRESNMPESWSQLLLGGLVGDHERYNAATALLSKGLEEGPAAYNFYGHGHGGDEIQTSGTNSKSHQVSQTLLASSSPRSCITTSLGSNMLDFSNTTVPAPELKNHHSDNSSEGNSAASGSAPKKARVQTSSSAQSTLKVRKERLGDRITALHQIVSPFGKTDTASVLQETIGYIRFLLSQIELRKDLRSRGLCLVPVSCTSHLADDNGASDFWAVAAAPPPPPPPLAGIIWR

SEQ ID NO: 12587 - DNA, 252 bp, Sorghum bicolor
  misc_feature: Ceres ANNOT ID no. 6099861
  misc_feature: Encodes the peptide sequence at SEQ ID NO 12588
atgggcgccgcgctgcctgggagaggagcgggagcaggggggttgcggcgagcggtacccgtcgtggtgcgtgagccgggaggagatcgatcgagcgcggccaaggaggccgagctccgggccacctactgctccttcatccgcgacgtcctctttctcctccgccagtctcacgccaagaacgagtggcagccacagggcaccacattcctaaacccatcaagtcaagatcgttacaacccattttggtga

SEQ ID NO: 12588 - protein, 83 aa, Sorghum bicolor
  misc_feature: Ceres ANNOT ID no. 6099861
  misc_feature (29)..(50): NCBI GI: 115444041 NCBI Desc: os02g0133000 [oryza sativa (japonica cultivar-group)]
  misc_feature (29)..(50): NCBI GI: 115444041 NCBI Desc: os02g0133000 [oryza sativa (japonica cultivar-group)]
MGAALPGRGAGAGGLRRAVPVVVREPGGDRSSAAKEAELRATYCSFIRDVLFLLRQSHAKNEWQPQGTTFLNPSSQDRYNPFW

SEQ ID NO: 12589 - DNA, 1095 bp, Sorghum bicolor
  misc_feature: Ceres ANNOT ID no. 6099964
  misc_feature: Encodes the peptide sequence at SEQ ID NO 12590
atgggcgccggtggcgagctggacgccttcgacgccggccgctgcgcggacgggtacgcgctgggcctcgccgtgggccggcggttcgccgaggtcatcaggagccggatgcggcaggacctcgtgctccgggagcagctgctgccgttcgcgtcgacggcggaggcgcagccactcctcgccgcgctccagtccgccaacagggagaggtacccacggtactgggacgagctggtgggcaccgccgacggcagcggcgtcccgctcctccacgtcatcctggtcaacttcaggaaggaggtcctgccgttcatcccgaaggaggaggagggaggtgatcgcgcccgggaagaagaggaggcggaggccgacggcgactgctccgacgtcctcatcgtcagcgactccacggcgatcgccgcgcacaacgaggacgggaacgtcgcgctgctcggccacacgtaccttgtgcgggctacgctgccggacggcgcgtccttcaccgcctacacctacgccggcgagctcccgagctgcgccttcgggttcaacaccaacggagtggccttcacgctcgactcggttcctccggtgaacgacgagatcgtcgcgggcgccattgccaggaacttcgtgtcccgagacctgctagaagcgaagaacctcgaggatgcaatgcgcagggtctgttcaccgaccgtctcagtcggccacagctacaacctgatggacgtcagaggccggaggatcgtcaacgtcgagaccgcctccgggaaccggttcgccgtccgtgaggccggcgccgtgccgttcttccacgccaacatgtaccggcatctccaagtgaagcagaaggtgcaggatgagaactccatgagcagggagaagagagctgcgcagtgctcagtggactccaaagagacggcgctttcgctgctgggagatacagctgatgagaagtacccaatctatatgacaggtccgacattgtacactctatgcactgttttggttgacgtcgacgaggcaaccatgaccatatacaaaggaaacccgaagaatggagatgcagctcatgttcttcggatgttgtga

SEQ ID NO: 12590 - protein, 364 aa, Sorghum bicolor
  misc_feature: Ceres ANNOT ID no. 6099964
  misc_feature (132)..(360): Pfam Id: AAT Pfam Desc: Acyl-coenzyme A:6-aminopenicillanic acid acyl-transferase
  misc_feature (19)..(352): NCBI GI: 55243805 NCBI Desc: ensangp00000017373 [anopheles gambiae str. pest]
  misc_feature (59)..(328): NCBI GI: 121608675 NCBI Desc: peptidase c45, acyl-coenzyme a [verminephrobacter eiseniae ef01-2]
  misc_feature (19)..(324): NCBI GI: 24640775 NCBI Desc: cg12120-pa [drosophila melanogaster]
  misc_feature (19)..(344): NCBI GI: 54642899 NCBI Desc: ga11415-pa [drosophila pseudoobscura]
  misc_feature (134)..(347): NCBI GI: 115358245 NCBI Desc: peptidase c45, acyl-coenzyme a:6-aminopenicillanic acid acyl-transferase [burkholderia cepacia ammd]
MGAGGELDAFDAGRCADGYALGLAVGRRFAEVIRSRMRQDLVLREQLLPFASTAEAQPLLAALQSANRERYPRYWDELVGTADGSGVPLLHVILVNFRKEVLPFIPKEEEGGDRAREEEEAEADGDCSDVLIVSDSTAIAAHNEDGNVALLGHTYLVRATLPDGASFTAYTYAGELPSCAFGFNTNGVAFTLDSVPPVNDEIVAGAIARNFVSRDLLEAKNLEDAMRRVCSPTVSVGHSYNLMDVRGRRIVNVETASGNRFAVREAGAVPFFHANMYRHLQVKQKVQDENSMSREKRAAQCSVDSKETALSLLGDTADEKYPIYMTGPTLYTLCTVLVDVDEATMTIYKGNPKNGDAAHVLRML

SEQ ID NO: 12591 - DNA, 858 bp, Sorghum bicolor
  misc_feature: Ceres ANNOT ID no. 6099968
  misc_feature: Encodes the peptide sequence at SEQ ID NO 12592
atggctcagctgctgcacctgccggacctcgcggcggcgcggccgccggcggggaggaggaggggcgtggcgttggcgccggcgccggcgggaccgggtcgcttcaaacagggggaggcggggacggcgagggggcgggtgatcagggtcgccgatcccgtgcgggagggccggatgccggtcccgccgccgccgccgctcctcgccgcgccggccacgccgtcggagtcgccgccggccacggggaggcgtggggacgaggacgacgaggagaggcagaggtactacctcaacatggggtacgcgatccggacgctcagggaggagctccccgatgtgctctacaaggagcccagcttcgacatctacagagatgacattgtcttccaagatcccttgaatacattcaagggcctggaaaattacaaaaggctattctgggcgcttcgttttactggccggatcttcttcaaagcattgtgggttgatatagttagtatatggcagcctgctgagaacatgatcatgattcgctggattgcccacggcattcctcgagtaccttgggatgggcatggccgctttgatggtgcttctgtgtataaacttgacaagaatggcaagatctatgagcataaggtgcacaatgtcgcaatgaatccaccaacgaaattcaaggtcctaccggtccatgagctaatcagatcacttggttgcccctctactgcaaaaccaacttacttcgaagcttcatcacaatatctgtgtgctgggccatcttatttgagattagcatggataagatgctacatctcattgtgccgtatgctttcgctagcaaatctgggagaaggatag

SEQ ID NO: 12592 - protein, 285 aa, Sorghum bicolor
  misc_feature: Ceres ANNOT ID no. 6099968
  misc_feature (1)..(285): NCBI GI: 115462667 NCBI Desc: os05g0215600 [oryza sativa (japonica cultivar-group)]
  misc_feature (69)..(249): NCBI GI: 38347356 NCBI Desc: osjnba0070c17.17 [oryza sativa (japonica cultivar-group)]
  misc_feature (1)..(124): NCBI GI: 115435348 NCBI Desc: os01g0221500 [oryza sativa (japonica cultivar-group)]
  misc_feature (32)..(238): NCBI GI: 55962477 NCBI Desc: chromosome 6 open reading frame 136 [homo sapiens]
  misc_feature (60)..(246): NCBI GI: 118196876 NCBI Desc: 2310061i04rik protein [mus musculus]
  misc_feature: Useful for making plants with modulated nitrogen use efficiency
  misc_feature: GREAT-hit functional homolog of the protein sequence encoded by LOCUS at2g46220
  misc_feature: Useful for making plants with modulated nitrogen use efficiency
  misc_feature: Functional homolog of the protein sequence given in SEQ ID NO 13723
MAQLLHLPDLAAARPPAGRRRGVALAPAPAGPGRFKQGEAGTARGRVIRVADPVREGRMPVPPPPPLLAAPATPSESPPATGRRGDEDDEERQRYYLNMGYAIRTLREELPDVLYKEPSFDIYRDDIVFQDPLNTFKGLENYKRLFWALRFTGRIFFKALWVDIVSIWQPAENMIMIRWIAHGIPRVPWDGHGRFDGASVYKLDKNGKIYEHKVHNVAMNPPTKFKVLPVHELIRSLGCPSTAKPTYFEASSQYLCAGPSYLRLAWIRCYISLCRMLSLANLGEG

SEQ ID NO: 12593 - DNA, 1290 bp, Sorghum bicolor
  misc_feature: Ceres ANNOT ID no. 6100028
  misc_feature: Encodes the peptide sequence at SEQ ID NO 12594
  misc_feature: Down-regulated in shoot tissues in response to aminocyclopropane carboxylic treatment
atggccgcagcgtcctcggtggtcaggcgtgccgccgccgccgcctccgcctcgcgcggcctgctcctcgcccgcgccttcgcctcgggagttggcggcggcgagaaggccaagcgggtgctggtgccggtggccgccggcacggagccgatcgaggcggcggccaccgccgacgtcctcaaccgcgccggcgcgcgggtcaccgtcgccactgccgacccgcccggggacgacggcctcgtcgtccaggccgcctacggcgtcaagttcgtcgccgacggccgcgtcgccgacctgcagggggagtccttcgacctcatcgccctgccgggaggaatgcctgggtcagttggcctcagagattgcaaagcgctcgagaagatggtcaagacgcacgccgagaatgggggcctgtacggcgccatctgcgctgcgcccgcggtgacgctggcctattggggcatgctcaaaggcttaaaggcgacctgttatccgtcgttcatggagaagttcactgcagaggtgatccctgtggactcgagggtcgttgtcgacagaaatgcagtcaccagccagggtccaggaactgcgatcgagtttggtcttgctttggtggagaagctgtatggcaaagagaagatggaggaggttgctgggcctctgtacgtgcgccctcaacatggagctgaatataccgtagaagagcttaattcggctgaatggaaatgtagtagcacacctcaggttcttgttccggttgctaatggttcagaggaaattgaagctgtcaatttgatagatgtgttgcgtagagcaggagcaaatgttattgttgcatcggtggaggagaagttacaaactgtgacccgtcgccataagttcaatctaattgctgatatgatgttggatgaagccactgaaatgcaatttgatttgattgtcatgccgggaggtttgcaaggtgctcagaagtttgctagtacaaagaaacttgttgacttactcaagaaacaggcagaatcaaataaaccatatggtgcaatatgtgcctctccagctcatgtgcttcagccacatggtttactgaagggcaagaaggcgacagcatttccacctatgtcacacctgctcacagatcagagtgcatgtgagcatagggttgttgtagatggtaaccttatcaccagtagagccccaggcactgcaacagagttcgccctagccattgttgaaaaactgtttggtcgagataaagctgtcagcatagccaaggaaatgatctttatgtga

SEQ ID NO: 12594 - protein, 429 aa, Sorghum bicolor
  misc_feature: Ceres ANNOT ID no. 6100028
  misc_feature (65)..(209): Pfam Id: DJ-1_PfpI Pfam Desc: DJ-1/PfpI family
  misc_feature (275)..(414): Pfam Id: DJ-1_PfpI Pfam Desc: DJ-1/PfpI family
  misc_feature (2)..(429): NCBI GI: 115435298 NCBI Desc: os01g0217800 [oryza sativa (japonica cultivar-group)]
  misc_feature (23)..(429): NCBI GI: 115468368 NCBI Desc: os06g0531200 [oryza sativa (japonica cultivar-group)]
  misc_feature (38)..(424): NCBI GI: 33149230 NCBI Desc: thij-like protein [brassica rapa subsp. pekinensis]
  misc_feature (296)..(424): NCBI GI: 62319406 NCBI Desc: 4-methyl-5(b-hydroxyethyl)-thiazole monophosphate biosynthesis protein [arabidopsis thaliana]
  misc_feature (301)..(424): NCBI GI: 23321215 NCBI Desc: thij-like protein [brassica rapa subsp. pekinensis]
  misc_feature: Down-regulated in shoot tissues in response to aminocyclopropane carboxylic treatment
MAAASSVVRRAAAAASASRGLLLARAFASGVGGGEKAKRVLVPVAAGTEPIEAAATADVLNRAGARVTVATADPPGDDGLVVQAAYGVKFVADGRVADLQGESFDLIALPGGMPGSVGLRDCKALEKMVKTHAENGGLYGAICAAPAVTLAYWGMLKGLKATCYPSFMEKFTAEVIPVDSRVVVDRNAVTSQGPGTAIEFGLALVEKLYGKEKMEEVAGPLYVRPQHGAEYTVEELNSAEWKCSSTPQVLVPVANGSEEIEAVNLIDVLRRAGANVIVASVEEKLQTVTRRHKFNLIADMMLDEATEMQFDLIVMPGGLQGAQKFASTKKLVDLLKKQAESNKPYGAICASPAHVLQPHGLLKGKKATAFPPMSHLLTDQSACEHRVVVDGNLITSRAPGTATEFALAIVEKLFGRDKAVSIAKEMIFM

SEQ ID NO: 12595 - DNA, 1323 bp, Sorghum bicolor
  misc_feature: Ceres ANNOT ID no. 6100042
  misc_feature: Encodes the peptide sequence at SEQ ID NO 12596
atgaaaaaccagtccacgccaacgccactgccagatacgccgacgccgacgacctcaggagacgcggggacaccaggaggaggaggaggaggaggacatgagcaggccacggcatcgccccgccggctcgccgcgctcctgccaagcaggggcagcagcagcagggggacgatggcgaagcggccgggcgttctgtgggcagccgcgttggcggtggtggtgcttgcggcgtgcacggccgccgccgccgccgtgaccatctcgcggaagcagcaccatcgcggcgggtcgtcggcgtcgtcggcggcgcggtcctgcgcccccttcgcggcgtcgggcgcgtgggtggtggacgagtcgtacccgctctacgactcggcgcggtgccccttcatccgcgacgagttcgcgtgcgcgcgcttcggccgccccgacaccatgtacctcaagtaccggtggcacctcgacgcgccgtgcgctcagcccaggttcgacggcgcggcgctgctgaagatgtggagtggcaagacggtgatgttcgtgggcgactcgctggcgctgaaccagtacgagtcgctgctgtgcatgctccacgccgcggcggggcccggcgtgcggaccagcctgtcgccggcgtccgggaagatcgacccctcctccaccgtccgcttcgaggactacaacgtgaccgtcgtgtactacctgacgcactacctggtggacctcgtgacggaggcgtccggccggcgcgtcctcaagctcgacaccatcgaccaggcccgcgactggctcgccgccgacgtgctcgtcttcgactcctggcactggtggccgcgcaccggccccacgcaaccctgggactacatccaggtgggcaacacggtggtgaaggacatggaccgcacgcaggccttcaccaaggcgctgcgcacctgggccagctgggtcgacgccaaccttgtccacaccgacaccaaggtcttcttccagggcatctcgccctctcactacaggggccaggactggggcgcgtcgccgaagaagacgtgcatgggggagacgcggccgctcaacggcactacgacgggagcgtacccgggcgggccgatcccgcagcaggcgatcctgcgcggcgtgctggccgggatggccaagccagtctacctgctcgacttcacctacctgtcgcagctccgcaaggacgcgcaccccaccaagtacgacggcggcatcttcggcggcgactgcacgcactggtgcgtcgccgggctcccggacacctggaacgtcctcttctacgccgcgctcaccgggcaggactga

SEQ ID NO: 12596 - protein, 440 aa, Sorghum bicolor
  misc_feature: Ceres ANNOT ID no. 6100042
  misc_feature (94)..(436): NCBI GI: 19571145 NCBI Desc: lustrin a-like [oryza sativa (japonica cultivar-group)]
  misc_feature (98)..(439): NCBI GI: 115468370 NCBI Desc: os06g0531400 [oryza sativa (japonica cultivar-group)]
  misc_feature (286)..(439): NCBI GI: 53791963 NCBI Desc: lustrin a-like [oryza sativa (japonica cultivar-group)]
  misc_feature (105)..(436): NCBI GI: 115467002 NCBI Desc: os06g0207500 [oryza sativa (japonica cultivar-group)]
  misc_feature (105)..(436): NCBI GI: 51091192 NCBI Desc: lustrin a-like [oryza sativa (japonica cultivar-group)]
MKNQSTPTPLPDTPTPTTSGDAGTPGGGGGGGHEQATASPRRLAALLPSRGSSSRGTMAKRPGVLWAAALAVVVLAACTAAAAAVTISRKQHHRGGSSASSAARSCAPFAASGAWVVDESYPLYDSARCPFIRDEFACARFGRPDTMYLKYRWHLDAPCAQPRFDGAALLKMWSGKTVMFVGDSLALNQYESLLCMLHAAAGPGVRTSLSPASGKIDPSSTVRFEDYNVTVVYYLTHYLVDLVTEASGRRVLKLDTIDQARDWLAADVLVFDSWHWWPRTGPTQPWDYIQVGNTVVKDMDRTQAFTKALRTWASWVDANLVHTDTKVFFQGISPSHYRGQDWGASPKKTCMGETRPLNGTTTGAYPGGPIPQQAILRGVLAGMAKPVYLLDFTYLSQLRKDAHPTKYDGGIFGGDCTHWCVAGLPDTWNVLFYAALTGQD

SEQ ID NO: 12597 - DNA, 1476 bp, Sorghum bicolor
  misc_feature: Ceres ANNOT ID no. 6100058
  misc_feature: Encodes the peptide sequence at SEQ ID NO 12598
atggccgccgggccgccctcgccgtccggtaaaccctactcgcgcaaatctcacgccagctccaaggctcccagcgtcccctccttcgacgcccacaacggccccctcctccccaccgtcaccttctcgctgccctccacgaccgcctcccgccgggagctgcgccgccgcctctcctccgagctctcccaggtgcgcgctgccgccaagcgcctcaactccctctcggctcccgccccctcctcggcgctctccgccaccgacccgtccacgccgctcccgccgcacccgccggcgtccaagcacaagtccaagaagggcgggggagccccgcacccgcacccgcacccgcacccgcacccgcacccgcacctctcggcggaggcgcggcgcaagctctacgcgcccgtgttcaagacctgctccgtgctgctccagaggctgatgaagcacaagcacagctgggtgttcaacaagccggtagatgcgagcgcgcttggcctgcacgactaccatacaatcatcaccaagcccatggacctcggcacagtcaagtcaaagctaggggccggacagtacaagtcaccacgggaattcgcaggtgatgtgcgtctgacattccagaatgccatgacgtacaaccccaagggccaggacgtgcacttcatggccgagcagctgctgaacatgttcgaggagaagtggccggagattgaggctgaggtagctcagctatcaccacagcctccaacaccgtcctcagcggcacccaggaagccaaaggagatagataattctagggtattagagaggtctgattccacagttcatgctgccgcgatggaggctaccccgaagactcacaccggcagacccccagttttaaagaaacccaaggcaagggagcccaataagagggatatgacattctgggagaagcagcggcttagcaataacctccaggatttgccaccggagaagctagacaatgttgttcagatcataaagaagaggaacttgtcactcagccagcatgatgatgagattgaggttgatatcgatagctttgatgttgaaacattatgggagcttgatagatttgtgacaaactataggaagagtataactaagaataagcggaaggctgagcttgagctttctgcggtaaggccggatgaagctgatcctgatcaggagccagagaaggtagaacatgtgaggcaggatgagccagatcaggatcaaattcctgcagtacaagagccgattccagaacgagaagcagttgatgttgcgccacctaaggataatgcggcagatgacaatgagagatttgtgggtgaatcatcacctggtcatttggaagatcagaagggagagaatgctggtagatcaagtagttctggaagctctagcagtgactcggggtcatcctctagtgatggttctgatgctgcacaatcacccagaacatag

SEQ ID NO: 12598 - protein, 491 aa, Sorghum bicolor
  misc_feature: Ceres ANNOT ID no. 6100058
  misc_feature (137)..(226): Pfam Id: Bromodomain Pfam Desc: Bromodomain
  misc_feature (138)..(485): NCBI GI: 92874651 NCBI Desc: bromodomain [medicago truncatula]
  misc_feature (137)..(488): NCBI GI: 30679613 NCBI Desc: dna-binding bromodomain-containing protein [arabidopsis thaliana]
  misc_feature (40)..(245): NCBI GI: 13186138 NCBI Desc: pstvd rna-biding protein, virp1 [lycopersicon esculentum]
  misc_feature (40)..(245): NCBI GI: 57282314 NCBI Desc: bromodomain-containing rna-binding protein 1 [solanum tuberosum]
  misc_feature (40)..(245): NCBI GI: 57282320 NCBI Desc: bromodomain-containing rna-binding protein 1 [nicotiana tabacum]
MAAGPPSPSGKPYSRKSHASSKAPSVPSFDAHNGPLLPTVTFSLPSTTASRRELRRRLSSELSQVRAAAKRLNSLSAPAPSSALSATDPSTPLPPHPPASKHKSKKGGGAPHPHPHPHPHPHPHLSAEARRKLYAPVFKTCSVLLQRLMKHKHSWVFNKPVDASALGLHDYHTIITKPMDLGTVKSKLGAGQYKSPREFAGDVRLTFQNAMTYNPKGQDVHFMAEQLLNMFEEKWPEIEAEVAQLSPQPPTPSSAAPRKPKEIDNSRVLERSDSTVHAAAMEATPKTHTGRPPVLKKPKAREPNKRDMTFWEKQRLSNNLQDLPPEKLDNVVQIIKKRNLSLSQHDDEIEVDIDSFDVETLWELDRFVTNYRKSITKNKRKAELELSAVRPDEADPDQEPEKVEHVRQDEPDQDQIPAVQEPIPEREAVDVAPPKDNAADDNERFVGESSPGHLEDQKGENAGRSSSSGSSSSDSGSSSSDGSDAAQSPRT

SEQ ID NO: 12599 - DNA, 675 bp, Sorghum bicolor
  misc_feature: Ceres ANNOT ID no. 6100169
  misc_feature: Encodes the peptide sequence at SEQ ID NO 12600
atggcgcggcggatcgccggagttgcggctctggccctgctctctgtgctcatggcggcgacctgcgccgccggccgcgacttctacgtcggcgggcacgtcgggtgggcgcccaaacccgccgagcccttcaacgcctgggcggagcgcaaccggttccaggtcaacgacaccctcgtgttcaggtacagcaagggcgcggacgccgtgctggtggtgagccagggccactacgacgcgtgcaacgccacggagcccttcctacgcctcgacgacggcgactcccgcttcgtgttccacagctccgggccatacttcttcatcagccccgacgcggcgcggtgcagggccggggagcacctcatcgtcgtcgtcctagccgtccgcgacggcgacgcgccgccgaagcccgcgtcgtcgtcgaccccgccgctgcctcccgtcggcacaccacctgcttcgcatgttctacctacaccgccgccgccgccgcatcctgttccgggcaagaacgcttcgtcgccgtcgcattcgccggtgccggcgcccgcgcctgcgcctggcacaaacgggacgtcgtcttcgccaccgccggcgccgtcgtccgccgtatccttcaggggtggcttcctggcatgcctgatgctaatcggcggagcagctattctcgtttga

SEQ ID NO: 12600 - protein, 224 aa, Sorghum bicolor
  misc_feature: Ceres ANNOT ID no. 6100169
  misc_feature (36)..(119): Pfam Id: Cu_bind_like Pfam Desc: Plastocyanin-like domain
  misc_feature (60)..(201): NCBI GI: 56202119 NCBI Desc: phytocyanin protein -like [oryza sativa (japonica cultivar-group)]
  misc_feature (10)..(205): NCBI GI: 62861389 NCBI Desc: early salt stress and cold acclimation-induced protein 2-3 [lophopyrum elongatum]
  misc_feature (25)..(216): NCBI GI: 7270153 NCBI Desc: nodulin-like protein [arabidopsis thaliana]
  misc_feature (7)..(205): NCBI GI: 62861393 NCBI Desc: early salt stress and cold acclimation-induced protein 2-1 [lophopyrum elongatum]
  misc_feature (21)..(197): NCBI GI: 18417181 NCBI Desc: plastocyanin-like domain-containing protein [arabidopsis thaliana]
MARRIAGVAALALLSVLMAATCAAGRDFYVGGHVGWAPKPAEPFNAWAERNRFQVNDTLVFRYSKGADAVLVVSQGHYDACNATEPFLRLDDGDSRFVFHSSGPYFFISPDAARCRAGEHLIVVVLAVRDGDAPPKPASSSTPPLPPVGTPPASHVLPTPPPPPHPVPGKNASSPSHSPVPAPAPAPGTNGTSSSPPPAPSSAVSFRGGFLACLMLIGGAAILV

SEQ ID NO: 12601 - DNA, 594 bp, Sorghum bicolor
  misc_feature: Ceres ANNOT ID no. 6100187
  misc_feature: Encodes the peptide sequence at SEQ ID NO 12602
atggcaatgagcgagctcagctccgacacctcgtccacgtcctcctactcgtccgacccgtccacgtccaccagcccgcgcgcggcggcgccctgctctgccgcagctgctgtcagcggcaagaagcgcccgcgctcaaacggcggcggcgaaagcggttccgccccggcgtaccgcggcgtccgcatgcgggcgtggggcaagtgggtgtcggagatcagggagccccgcaagaagtcccgcatctggctgggaaccttcccgtgcccggagatggcggcgcgcgcgcacgacgtcgccgcgctcagcatcaagggcgcgcgcgccgtgctcaacttcccggacctcgcgcgccacctcccgcgcccggcatccctcgcgccgcgcgacgtccaggccgccgccgcgcgcgcccacgagcggcagcccgtagagatggccgccgagctggtgttcgacgagctggcgccgctgtgggtggaggacgtggtggagttcggggggccgccgtccgatcacacgtggacgccgtgcgatgggctcgacgccgccgtcggcttcctccaccctctccctctcctgtgggactactag

SEQ ID NO: 12602 - protein, 197 aa, Sorghum bicolor
  misc_feature: Ceres ANNOT ID no. 6100187
  misc_feature (56)..(107): Pfam Id: AP2 Pfam Desc: AP2 domain
  misc_feature (1)..(138): NCBI GI: 86129708 NCBI Desc: ap2 domain transcription factor tadreb2 [triticum aestivum]
  misc_feature (32)..(138): NCBI GI: 21908034 NCBI Desc: dre binding factor 2 [zea mays]
  misc_feature (32)..(138): NCBI GI: 25990951 NCBI Desc: dreb-like protein [zea mays]
  misc_feature (17)..(138): NCBI GI: 38257023 NCBI Desc: dreb-like protein [cucumis melo]
  misc_feature (5)..(138): NCBI GI: 32455220 NCBI Desc: transcription factor [oryza sativa (japonica cultivar-group)]
  misc_feature: The sequence is a functional homolog of SEQ ID NO 1050 in the 10/666,642US patent application
  misc_feature: The sequence is a functional homolog of SEQ ID NO 1222 in the 10/374,780US patent application
  misc_feature: The sequence is a functional homolog of SEQ ID NO 1224 in the 10/374,780US patent application
  misc_feature: The sequence is a functional homolog of SEQ ID NO 1226 in the 10/374,780US patent application
  misc_feature: The sequence is a functional homolog of SEQ ID NO 1233 in the 10/374,780US patent application
  misc_feature: The sequence is a functional homolog of SEQ ID NO 1234 in the 10/374,780US patent application
  misc_feature: The sequence is a functional homolog of SEQ ID NO 1411 in the 10/412,699US patent application
  misc_feature: The sequence is a functional homolog of SEQ ID NO 1413 in the 10/412,699US patent application
  misc_feature: The sequence is a functional homolog of SEQ ID NO 164 in the 11/375,241US patent application
  misc_feature: The sequence is a functional homolog of SEQ ID NO 1781 in the 11/479,226US patent application
  misc_feature: The sequence is a functional homolog of SEQ ID NO 182 in the 11/375,241US patent application
  misc_feature: The sequence is a functional homolog of SEQ ID NO 2233 in the 10/666,642US patent application
  misc_feature: The sequence is a functional homolog of SEQ ID NO 270 in the 10/374,780US patent application
  misc_feature: The sequence is a functional homolog of SEQ ID NO 2848 in the 10/374,780US patent application
  misc_feature: The sequence is a functional homolog of SEQ ID NO 4 in the 10/225,066US patent application
  misc_feature: The sequence is a functional homolog of SEQ ID NO 456 in the 10/225,066US patent application
  misc_feature: The sequence is a functional homolog of SEQ ID NO 710 in the 11/435,388US patent application
  misc_feature: The sequence is a functional homolog of SEQ ID NO 712 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: The sequence is a functional homolog of SEQ ID NO 96 in the 10/714,887US patent application
  misc_feature: The sequence is a functional homolog of SEQ ID NO 96 in the 11/435,388US patent application
  misc_feature: Useful for making plants with modulated growth and phenotype characteristics
  misc_feature: The sequence is a functional homolog of SEQ ID NO 1411 in the 20040045049 US patent application
  misc_feature: The sequence is a functional homolog of SEQ ID NO 1413 in the 20040045049 US patent application
  misc_feature: The sequence is a functional homolog of SEQ ID NO 4 in the 20050160493 US patent application
  misc_feature: The sequence is a functional homolog of SEQ ID NO 456 in the 20050160493 US patent application
  misc_feature: The sequence is a functional homolog of SEQ ID NO 96 in the 20060015972 US patent application
  misc_feature: The sequence is a functional homolog of SEQ ID NO 1226 in the 20060162006 US patent application
  misc_feature: The sequence is a functional homolog of SEQ ID NO 1233 in the 20060162006 US patent application
  misc_feature: The sequence is a functional homolog of SEQ ID NO 1234 in the 20060162006 US patent application
  misc_feature: The sequence is a functional homolog of SEQ ID NO 182 in the 20060195944 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: The sequence is a functional homolog of SEQ ID NO 1050 in the 20070033671 US patent application
  misc_feature: Useful for biocontainment applications
  misc_feature: Useful for making plants with modulated flowering time
  misc_feature: Functional homolog of the protein sequence given in SEQ ID NO 13724
  misc_feature: The sequence is a functional homolog of SEQ ID NO 2596 in the 10/374,780 US patent application
  misc_feature: The sequence is a functional homolog of SEQ ID NO 644 in the 10/225,066 US patent application
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: Useful for making plants with modulated biomass
  misc_feature: Functional homolog of the protein sequence given in SEQ ID NO 12893
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 1248 in the 10/374,780 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: Useful for making plants with altered lignin content
  misc_feature: Functional homolog of the protein sequence given in SEQ ID NO 13219
  misc_feature: The sequence is a functional homolog of SEQ ID NO. 274 in the 11/188,298 US application
MAMSELSSDTSSTSSYSSDPSTSTSPRAAAPCSAAAAVSGKKRPRSNGGGESGSAPAYRGVRMRAWGKWVSEIREPRKKSRIWLGTFPCPEMAARAHDVAALSIKGARAVLNFPDLARHLPRPASLAPRDVQAAAARAHERQPVEMAAELVFDELAPLWVEDVVEFGGPPSDHTWTPCDGLDAAVGFLHPLPLLWDY

SEQ ID NO: 12603 - DNA, 1548 bp, Sorghum bicolor
  misc_feature: Ceres ANNOT ID no. 6100300
  misc_feature: Encodes the peptide sequence at SEQ ID NO 12604
atggcgactgctgcgctggcaatggcagagcaggtggtggccgacctccgagcgaagtgtgaggcgccgccgccgatgctgcgcgaggtggcggcggagatggcccgcgagatgggcgcgggactggagaaggaaggcgggagcagggtcaagatgctcctctcctacgttgataagctccccacagggggagaagagggattattctatggattggacctaggagggacgaacttccgcgtcttgaaagtggaactgggtgggaatgagaagcacgtcgtggaccgtgactccagagaagtcattattcctccacatttgatgtcagggagctcctcggagctttttggtttcattgcttctgaattggccaagtttgttgttgatgatgagaagttcatcaatgttttgaatggaaagaagcgagaactagggttcacattttcattcccagtgaagcagcgttctgttgcttccggtacgcttgtcaagtggacaaaggcattttccattaatgatgctgttggtgaagatgtggtggctaaactgcaaacagctatggagaagcaaggtctggacatgcatgtagctgcattgattaatgatgctgttgggactctggctggagcaaggtactacgacaaagatgttgtcgctggtgtaatatttggcactggcacaaatgcagcatatgttgagaaggcaaatgctattccaaaatgggagggtgagctgcccaattcaggagatatggtcatcaacatggaatggggtaacttctgctcagcctatctcccaatcactgaatatgaccaagaattagataaggagagcttaaatccaggagaacagatttatgagaagttaacatcagggatgtatttgggcgaaattgtaaggagggtgctccttaaaatatcattgcagtctgcgatttttggcaatattgaccacactaagctcgaaaccccgttccttctgcggactccacatatttctgcaatgcaccatgatgaaacacctgatctgaagattgtggcaaaaaaactggaagaaaacctagagattacaggcgcatccttagaggctcgaaaattggtggttgaaatttgtgacattgtggcaacaagagctgcccggctggccgctgcagggcttgcagggatcctcatgaagctcgggagagattgcagtgtcgaggatcaacgatcagtcatcgccatcgatggaggattgttcgagcactacaccaaattccgccaatgcttggagaccacactgggcgagctgctaggagatgaggcgtctaaggcggtggccgtcaagcatgcagatgatggttcaggaataggtgctgccctgattgcagcttcacaatctctgtacaaaaatgacttagtggccgtcaagcatgcagatgacaagcatgcagatgacaagcatgaagatgcagatgacaagcatgaagatgacggtaaaggagtcaagcatgcagatgacggttcagaaataggtgctgccctgattgcagcctcgcaatctcagtag

SEQ ID NO: 12604 - protein, 515 aa, Sorghum bicolor
  misc_feature: Ceres ANNOT ID no. 6100300
  misc_feature (216)..(461): Pfam Id: Hexokinase_2 Pfam Desc: Hexokinase
  misc_feature (7)..(214): Pfam Id: Hexokinase_1 Pfam Desc: Hexokinase
  misc_feature (5)..(460): NCBI GI: 110808555 NCBI Desc: hexokinase-8 (hexokinase-4)
  misc_feature (5)..(460): NCBI GI: 115435012 NCBI Desc: os01g0190400 [oryza sativa (japonica cultivar-group)]
  misc_feature (5)..(460): NCBI GI: 73918017 NCBI Desc: hexokinase 8 [oryza sativa (japonica cultivar-group)]
  misc_feature (1)..(464): NCBI GI: 110808554 NCBI Desc: hexokinase-7 (hexokinase-6)
  misc_feature (1)..(464): NCBI GI: 62130764 NCBI Desc: hexokinase 6 [oryza sativa (japonica cultivar-group)]
  misc_feature (5)..(460): SWISSPROT Homolog: EC 2.7.1.1 Hexokinase-8
  misc_feature: The sequence is a functional homolog of SEQ ID NO. 321 in the 11/188,298 US application
MATAALAMAEQVVADLRAKCEAPPPMLREVAAEMAREMGAGLEKEGGSRVKMLLSYVDKLPTGGEEGLFYGLDLGGTNFRVLKVELGGNEKHVVDRDSREVIIPPHLMSGSSSELFGFIASELAKFVVDDEKFINVLNGKKRELGFTFSFPVKQRSVASGTLVKWTKAFSINDAVGEDVVAKLQTAMEKQGLDMHVAALINDAVGTLAGARYYDKDVVAGVIFGTGTNAAYVEKANAIPKWEGELPNSGDMVINMEWGNFCSAYLPITEYDQELDKESLNPGEQIYEKLTSGMYLGEIVRRVLLKISLQSAIFGNIDHTKLETPFLLRTPHISAMHHDETPDLKIVAKKLEENLEITGASLEARKLVVEICDIVATRAARLAAAGLAGILMKLGRDCSVEDQRSVIAIDGGLFEHYTKFRQCLETTLGELLGDEASKAVAVKHADDGSGIGAALIAASQSLYKNDLVAVKHADDKHADDKHEDADDKHEDDGKGVKHADDGSEIGAALIAASQSQ

SEQ ID NO: 12605 - DNA, 1119 bp, Sorghum bicolor
  misc_feature: Ceres ANNOT ID no. 6100418
  misc_feature: Encodes the peptide sequence at SEQ ID NO 12606
atggcggggaacggcggcgagggtgcggtcgggaaggtggcctgcgcggcgtggatacggcggcgggacgatgacggctggccacccggcctctcccgcctcctcgtggcgttcgcccgcggggccacggcctcgtccccgccgctcgtcgacgtcctcgagttcgacgccaaggcatccgcactcgccgcctacgagtccgagcccctggcgagggtcaccgtgggcgaggacgcagcggacgcgccgcgcgcgatcgccgtgcaccctggcggccgggagctcgtttgtgcaaccgccaaaggctgcagggtgtttaatcttgtttataaagacttcggtattcaccttatttcaagagatgcttcacctctccaatgtgttgggcctcaaaaatgtttagcattcagcactgatggtgctaagtttgctgttggtggtgaggatgggcgtctcagaatatttcattggccaagtctcaatgtgattttggacgaacctaaagctcacaaatccttctgtgacatggacatcagcttagactcaaagtttttagtttcatcatccattgatggctctgcaagaatatggaacattgatgagggggctccactaatcaatttgacaagatctttggatgagaagattgagtattgccgcttttctagggatggagccaaacctttcctgttttgcacacttgtaaaaggtcatgacgtttggactatggccgtggacataagtaattggaagagaatcggttacaaaagattttcagcaaagcccatttccacactcgcaattagcttggatgggaaatatcttgcactaggaaatcgtgatggtgacttttgcgccgtggaaataaagaagatggaggttgctcactggagcaagaaggttcatcttggcttcccagtttcctccattgaattttgtcctactgaaagggtagtaatctccacctcacatcaatggggagcagagataacaaaacttgacgtccctcccgaatggaaagtgtggcagatctggctggtgctcctgagcctcttcgtgtcgtcggccatcctcttctacgtctttttcaagcacgcaaggatcaacctggggccatag

SEQ ID NO: 12606 - protein, 372 aa, Sorghum bicolor
  misc_feature: Ceres ANNOT ID no. 6100418
  misc_feature (5)..(366): NCBI GI: 34394605 NCBI Desc: transducin / wd-40 repeat protein-like [oryza sativa (japonica cultivar-group)]
  misc_feature (68)..(364): NCBI GI: 166878 NCBI Desc: st12p protein
  misc_feature (23)..(342): NCBI GI: 8777388 NCBI Desc: protein transport protein sec12p-like [arabidopsis thaliana]
  misc_feature (60)..(333): NCBI GI: 113475867 NCBI Desc: wd-40 repeat [trichodesmium erythraeum ims101]
  misc_feature (111)..(343): NCBI GI: 119492582 NCBI Desc: wd-40 repeat protein [lyngbya sp. pcc 8106]
MAGNGGEGAVGKVACAAWIRRRDDDGWPPGLSRLLVAFARGATASSPPLVDVLEFDAKASALAAYESEPLARVTVGEDAADAPRAIAVHPGGRELVCATAKGCRVFNLVYKDFGIHLISRDASPLQCVGPQKCLAFSTDGAKFAVGGEDGRLRIFHWPSLNVILDEPKAHKSFCDMDISLDSKFLVSSSIDGSARIWNIDEGAPLINLTRSLDEKIEYCRFSRDGAKPFLFCTLVKGHDVWTMAVDISNWKRIGYKRFSAKPISTLAISLDGKYLALGNRDGDFCAVEIKKMEVAHWSKKVHLGFPVSSIEFCPTERVVISTSHQWGAEITKLDVPPEWKVWQIWLVLLSLFVSSAILFYVFFKHARINLGP

SEQ ID NO: 12607 - DNA, 1014 bp, Sorghum bicolor
  misc_feature: Ceres ANNOT ID no. 6100532
  misc_feature: Encodes the peptide sequence at SEQ ID NO 12608
atggctgcttgtacccgcaccagcaccggcagcaacaagccgccgtcgctgtgcctgctcctcctcgtccacgcgctgctgctcgccatcgcgtcgtctcctgccggcggtctccaggtgggcttctaccagcagacctgcccccaggcggagtccatcgttcggaacgtgacctgggcgcgggcggccgcggacccgagcctggccggcaagctgctgcggctctacttccacgactgcttcccgcagggctgcgacgcgtcggtgctgctggacggccggggcacggagaaggcggcgccgccgaaccagtcgctgggcgggctggacgtcgtcgacgccgccaaggcggcgctggaggcggcctgcccgggcaccgtctcctgcgcggacgtcgtggcgctggccacccgcgacgccgtctccttccagttccgccgctcgctgtggcaagtcgagacgggccgccgcgacaaccgcttctccgacgaggcgcacgccacggacctgcccagcccggagttcgtgttcccgctcctcagggactccttcgccaagcgggggctcggcgtccgcgacctcgtcgcgctctccggcgcgcacacgctgggacacacggactgccagttcgtgtcaccgaggctctacaccttccagggcaacggcggggtggacccgttcatcgacccgagctacgcgcgggagctcatgcgccagtgccccgccacgccgccgccgtcgtcgtcgtcgtcgtccggcaaggtggccttggaccctggcagcgagttcacgttcgacaccagctactacgccaccatcaaggccaaccgcggcgcgctgcacacggactccgtgctgctgcacgacgacgaggccgcccgcctcgtcgacgagatgcacgaccaaggcaagttcctcaccgccttcgccgcgtccatccagaagttgggagccttcggcgtcatcaccggcaacaaaggggagatcaggaggaactgccacgtcgtcaactaa

SEQ ID NO: 12608 - protein, 337 aa, Sorghum bicolor
  misc_feature: Ceres ANNOT ID no. 6100532
  misc_feature (54)..(302): Pfam Id: peroxidase Pfam Desc: Peroxidase
  misc_feature (20)..(337): NCBI GI: 575605 NCBI Desc: cationic peroxidase isozyme 40k precursor [nicotiana tabacum]
  misc_feature (6)..(337): NCBI GI: 55701143 NCBI Desc: tpa: class iii peroxidase 138 precursor [oryza sativa (japonica cultivar-group)]
  misc_feature (17)..(337): NCBI GI: 575603 NCBI Desc: cationic peroxidase isozyme 38k precursor [nicotiana tabacum]
  misc_feature (12)..(337): NCBI GI: 129808 NCBI Desc: cationic peroxidase 2 precursor (pnpc2)
  misc_feature (18)..(337): NCBI GI: 21592403 NCBI Desc: peroxidase [arabidopsis thaliana]
MAACTRTSTGSNKPPSLCLLLLVHALLLAIASSPAGGLQVGFYQQTCPQAESIVRNVTWARAAADPSLAGKLLRLYFHDCFPQGCDASVLLDGRGTEKAAPPNQSLGGLDVVDAAKAALEAACPGTVSCADVVALATRDAVSFQFRRSLWQVETGRRDNRFSDEAHATDLPSPEFVFPLLRDSFAKRGLGVRDLVALSGAHTLGHTDCQFVSPRLYTFQGNGGVDPFIDPSYARELMRQCPATPPPSSSSSSGKVALDPGSEFTFDTSYYATIKANRGALHTDSVLLHDDEAARLVDEMHDQGKFLTAFAASIQKLGAFGVITGNKGEIRRNCHVVN

SEQ ID NO: 12609 - DNA, 486 bp, Sorghum bicolor
  misc_feature: Ceres ANNOT ID no. 6100582
  misc_feature: Encodes the peptide sequence at SEQ ID NO 12610
atggcggcggcgggcctgcggaaggggaacgcgcgcctccctccggaggtgaaccgggtgctgtacgtgcggaacctgccgttcaacatctcgagcgaggagatgtacgacatcttcggcaagtacggcgcgatccggcagatccggctgggcaacgccaaggacacgcgaggcaccgcctacgttgtctacgaggacatctacgacgccaagaacgccgtcgaccacctctccggcttcaacgtcgccaaccgctacctcatcgtgctctactaccagccagcgaagatgtccaagaagtcggatgctccaggagaagtacggaatagggtccaagacacccggccctggctccagcgactgagcggccaggttattgcccctgcagcctcttgtatgctgaagagtagagggaacaaattggtagcgctgtgctgtgtttatccagtgttgctaattactctgtgttgttattcggtcaattga

SEQ ID NO: 12610 - protein, 161 aa, Sorghum bicolor
  misc_feature: Ceres ANNOT ID no. 6100582
  misc_feature (21)..(89): Pfam Id: RRM_1 Pfam Desc: RNA recognition motif. (a.k.a. RRM, RBD, or RNP domain)
  misc_feature (1)..(102): NCBI GI: 92874031 NCBI Desc: rna-binding region rnp-1 (rna recognition motif) [medicago truncatula]
  misc_feature (1)..(102): NCBI GI: 95115196 NCBI Desc: cg13298-like protein [bombyx mori]
  misc_feature (7)..(102): NCBI GI: 116129475 NCBI Desc: ensangp00000022192 [anopheles gambiae str. pest]
  misc_feature (7)..(109): NCBI GI: 29841272 NCBI Desc: similar to genbank accession number ae003563 cg13298 gene product in drosophila melanogaster [schistosoma japonicum]
  misc_feature (1)..(102): NCBI GI: 34785490 NCBI Desc: mgc68842 protein [xenopus laevis]
MAAAGLRKGNARLPPEVNRVLYVRNLPFNISSEEMYDIFGKYGAIRQIRLGNAKDTRGTAYVVYEDIYDAKNAVDHLSGFNVANRYLIVLYYQPAKMSKKSDAPGEVRNRVQDTRPWLQRLSGQVIAPAASCMLKSRGNKLVALCCVYPVLLITLCCYSVN

SEQ ID NO: 12611 - DNA, 1020 bp, Sorghum bicolor
  misc_feature: Ceres ANNOT ID no. 6100608
  misc_feature: Encodes the peptide sequence at SEQ ID NO 12612
atggccggccgcggagacaagaaaccggcgtcgcggaagggcggttcccctcacggatcggtctatggaagttcttcggcaccacgaaaacagggtgcctgtacattctctccttcggttagcagcaaagattcatcactgcaaaagttggttacaccagttcaaccacagaaacctgtagactccagaagcagtcagtctagtacaggatctgactctggagctgccccacttgatatatgcatgagtgctagcacatgcgctgtcaagttaaaaccttctatactcgagaccaacagagaaaaaaggcgagacagggaatgttccaaggatgtagctccattgcaattgagacctggaatggttcttttgaaaagattcataaagcctaatgatcaggttaaaattgtcaaactttgtcggcaacttggtgttggtcccgggggattttatagacctggctaccgaaatggtgctatgctaagactgtggatgatgtgcttagggaagaactgggatccaaattcatactcatatggagatagacgtccgtttgatggtgctcaaccaccgaccataccagaagaattcaagaagttcgttcaagatgtcatccaagcttccaatgaatttttgaaacaacaaaaaggagctgccaatgctgtgcaagaaatacctgcgatgtcaccagatatctgccttgttaacttctacaatagtagcgggaggttgggtcttcatcaggacaaagatgaatcaaagagcagccttgacaagggattgcctgtcgtttctttttcgataggcgagaccgcagaattcttgtacggcgatgttagagatcaagagaagctttcaaaggttgaccttgaatctggtgacgtcctgatatttggtggtcagtcaaggctcatattccacggggtttccaccaccaaacctaaaacggcaccaaagtggctgatggacgagacaaatcttcgacctgggcgtctgaatctcacattcaggcaatactag

SEQ ID NO: 12612 - protein, 339 aa, Sorghum bicolor
  misc_feature: Ceres ANNOT ID no. 6100608
  misc_feature (39)..(319): NCBI GI: 15231791 NCBI Desc: oxidoreductase, 2og-fe(ii) oxygenase family protein [arabidopsis thaliana]
  misc_feature (116)..(316): NCBI GI: 133912532 NCBI Desc: alkylated dna repair protein [saccharopolyspora erythraea nrrl 2338]
  misc_feature (223)..(338): NCBI GI: 90420982 NCBI Desc: alkb, alkylated dna repair protein [aurantimonas sp. si85-9a1]
  misc_feature (230)..(338): NCBI GI: 114704740 NCBI Desc: alkylated dna repair protein [fulvimarina pelagi htcc2506]
  misc_feature (111)..(337): NCBI GI: 62423875 NCBI Desc: cog3145: alkylated dna repair protein [brevibacterium linens bl2]
MAGRGDKKPASRKGGSPHGSVYGSSSAPRKQGACTFSPSVSSKDSSLQKLVTPVQPQKPVDSRSSQSSTGSDSGAAPLDICMSASTCAVKLKPSILETNREKRRDRECSKDVAPLQLRPGMVLLKRFIKPNDQVKIVKLCRQLGVGPGGFYRPGYRNGAMLRLWMMCLGKNWDPNSYSYGDRRPFDGAQPPTIPEEFKKFVQDVIQASNEFLKQQKGAANAVQEIPAMSPDICLVNFYNSSGRLGLHQDKDESKSSLDKGLPVVSFSIGETAEFLYGDVRDQEKLSKVDLESGDVLIFGGQSRLIFHGVSTTKPKTAPKWLMDETNLRPGRLNLTFRQY

SEQ ID NO: 12613 - DNA, 1173 bp, Sorghum bicolor
  misc_feature: Ceres ANNOT ID no. 6100675
  misc_feature: Encodes the peptide sequence at SEQ ID NO 12614
atgctgcgcctccggagtagcttcctctctctggtccgagccgcctccccgctaccctccccccccacccacccctgcgcgtggcgcttcctctccacccaccccgcgcccttctccctcgagggctacctcgtcaccgcctgcggcctcactcccgctgaagcccgcaaggcgtccaagaaggcgtcccacgatttatccagggaaacaccgaataagctcccctactccccacgcctcaactccgcctccaaccctgatgccatcctcgccctgctctccggcgtcggcctctcccgcgccgacattgccgccgtcgtctccgcagacccgctgctcctccgcgcttcggtgaagaacatcggcccccgccttcttgctctccgcgaccgcgtcggtctttccaccacccaaatcgctcgcttcctcctggtcgactcacgtgctctccgctgctgcgacgtcgtacctaggctcgagtttttcatctccttctacggttcgttagagaaggtcctggaagcctcaaaaaggaaccggatcctcctcatcgcgagccttgagaggtcaatcaagcccaacatagctttgtttcgtcagtggggtgttcgagatgttgcccagctgtgttcaaacttcccgcgggtgcttacctacaacccgcaacgcgtcaaagagtttctggcacgggcggaacaacttgtgcctcccacttcagggctgttcgggcaagcagtgtctgtcattgcctgtgtgtccgaagagaagcttgctgccaagcttgagttctttaagaggactcttggttgttcggagtctgaggtttccactgcagtgtccaagactccagctataatagcattatctgacgagattcttcttcgcaagattgagttccttgtcaacgaagctgcaatggagccacggtacattgtggaaagacctgtcctgctcacatacagcctggagaagaggctagtaccgcggcataatgtcctgacggtcctgaaggaaaagaggttgctgagtagcaatacaaattttttcagaataattaaattaggagaggagactttcaaatcaaagttcatcgactgtcacgaggactctgttcccggccttgcagatgcttatgctgcggctcatgctggtattgtgccctctaaagtctaa

SEQ ID NO: 12614 - protein, 390 aa, Sorghum bicolor
  misc_feature: Ceres ANNOT ID no. 6100675
  misc_feature (54)..(361): Pfam Id: mTERF Pfam Desc: mTERF
  misc_feature (38)..(389): NCBI GI: 115467190 NCBI Desc: os06g0225100 [oryza sativa (japonica cultivar-group)]
  misc_feature (1)..(384): NCBI GI: 51536063 NCBI Desc: mitochondrial transcription termination factor-like [oryza sativa (japonica cultivar-group)]
  misc_feature (1)..(380): NCBI GI: 51536067 NCBI Desc: mitochondrial transcription termination factor-like [oryza sativa (japonica cultivar-group)]
  misc_feature (2)..(390): NCBI GI: 51536066 NCBI Desc: mitochondrial transcription termination factor-like [oryza sativa (japonica cultivar-group)]
  misc_feature (1)..(386): NCBI GI: 115467186 NCBI Desc: os06g0224900 [oryza sativa (japonica cultivar-group)]
  misc_feature: Useful for making plants with altered alkaloid content
  misc_feature: Useful for making plants with altered terpenoid content
  misc_feature: Functional homolog of the protein sequence given in SEQ ID NO 13002
  misc_feature: Functional homolog of the protein sequence given in SEQ ID NO 13214
MLRLRSSFLSLVRAASPLPSPPTHPCAWRFLSTHPAPFSLEGYLVTACGLTPAEARKASKKASHDLSRETPNKLPYSPRLNSASNPDAILALLSGVGLSRADIAAVVSADPLLLRASVKNIGPRLLALRDRVGLSTTQIARFLLVDSRALRCCDVVPRLEFFISFYGSLEKVLEASKRNRILLIASLERSIKPNIALFRQWGVRDVAQLCSNFPRVLTYNPQRVKEFLARAEQLVPPTSGLFGQAVSVIACVSEEKLAAKLEFFKRTLGCSESEVSTAVSKTPAIIALSDEILLRKIEFLVNEAAMEPRYIVERPVLLTYSLEKRLVPRHNVLTVLKEKRLLSSNTNFFRIIKLGEETFKSKFIDCHEDSVPGLADAYAAAHAGIVPSKV

SEQ ID NO: 12615 - DNA, 1194 bp, Sorghum bicolor
  misc_feature: Ceres ANNOT ID no. 6100677
  misc_feature: Encodes the peptide sequence at SEQ ID NO 12616
atgctgctgcgcctccgaaatcgcctcctccctctgctccgcgccgcgtcaccgcttccctcccccatccacaccggcgcgtgccgcctcatctccacctccaaggccacctcccgcgtgcccttctccctcgagggctacctcgtcaccgcctgcggcctcgctcccgcccaagctcgcgaggtgtccaagaaggcctcccacgatttatccaaggaatctcgtagaacaccggataagctttcctactcccgcctcaactccgcctccaaccctgattccatcctcgccctgctctccggggccggcctctcccgcgccgacatcgccgccgtagtctccgcggacccgttgctccttcgtgcttcggtgaagaacatcgccccccgccttcttgccctccgtgaccgcgtcggtctgtccactccccagattgctagcttcctcctgatcgactcacatgctctccgcagctgcgatgtcgttcccaggctcgagttcttcatctccttctatggttcgtttgagaaggtcctcgtggccgccaagaggaacgggaacctcctcgtctcgagcattgacaatttaatcaagcctaacatcgcgttgtttcgtcagtggggtgttcgagatattgcccagctgtgtttgaccgtcccgcggttgctcacctacaacctggaacgcttgaaagagtgtctgccacgggcggaacaacttggggtgcctcccacttcggggcggttcgggcacgcagttgcaatagtctcctgtatgtccgaagagaagcttgctgccaagcttgagttctttaagaggactcttggttgttcagagtgtgatgtttccactgcagtatccaagacgccaggtataatagcattatctgacgagattcttcttcgcaagattgagttcctttgcaacgaggctgccatggagccacggtacattgtggaaaagtctgtactgctcacctacagcctggagaagaggttagtgccgcggcatcatgtgatgaaggccttgcaggaaaagggattgctaaatagtaatacaaaccttttacaattagttctttgtagagaagaggctttcaaatcgaacttcatcgaccgtcacaagaactctgttcctggccttgcagatgcttatgctgcagctcgtgctggtattgtgccctctagagtttaa

SEQ ID NO: 12616 - protein, 397 aa, Sorghum bicolor
  misc_feature: Ceres ANNOT ID no. 6100677
  misc_feature (69)..(368): Pfam Id: mTERF Pfam Desc: mTERF
  misc_feature (10)..(396): NCBI GI: 115467190 NCBI Desc: os06g0225100 [oryza sativa (japonica cultivar-group)]
  misc_feature (2)..(387): NCBI GI: 51536067 NCBI Desc: mitochondrial transcription termination factor-like [oryza sativa (japonica cultivar-group)]
  misc_feature (2)..(366): NCBI GI: 115467184 NCBI Desc: os06g0224700 [oryza sativa (japonica cultivar-group)]
  misc_feature (29)..(391): NCBI GI: 51536063 NCBI Desc: mitochondrial transcription termination factor-like [oryza sativa (japonica cultivar-group)]
  misc_feature (5)..(393): NCBI GI: 115467186 NCBI Desc: os06g0224900 [oryza sativa (japonica cultivar-group)]
  misc_feature: Useful for making plants with altered alkaloid content
  misc_feature: Useful for making plants with altered terpenoid content
  misc_feature: Functional homolog of the protein sequence given in SEQ ID NO 13002
  misc_feature: Functional homolog of the protein sequence given in SEQ ID NO 13214
MLLRLRNRLLPLLRAASPLPSPIHTGACRLISTSKATSRVPFSLEGYLVTACGLAPAQAREVSKKASHDLSKESRRTPDKLSYSRLNSASNPDSILALLSGAGLSRADIAAVVSADPLLLRASVKNIAPRLLALRDRVGLSTPQIASFLLIDSHALRSCDVVPRLEFFISFYGSFEKVLVAAKRNGNLLVSSIDNLIKPNIALFRQWGVRDIAQLCLTVPRLLTYNLERLKECLPRAEQLGVPPTSGRFGHAVAIVSCMSEEKLAAKLEFFKRTLGCSECDVSTAVSKTPGIIALSDEILLRKIEFLCNEAAMEPRYIVEKSVLLTYSLEKRLVPRHHVMKALQEKGLLNSNTNLLQLVLCREEAFKSNFIDRHKNSVPGLADAYAAARAGIVPSRV

SEQ ID NO: 12617 - DNA, 1947 bp, Sorghum bicolor
  misc_feature: Ceres ANNOT ID no. 6100686
  misc_feature: Encodes the peptide sequence at SEQ ID NO 12618
atgataatggacccccgtcctcgtgataatctcaactttggtgctcgattgcccaccccaaatccacccacacctcacatgattagcttctccctccaacagccacagcctcagttcttcccgtcatatggattccacagccacaaccacaacaaccctgctatcagctcacatccatctccaccctcagtcatgcctggctgcaccacgccaagcccagcatcaacaaccacaaccgaggcagacaatgccgaggatctctccgaggctgttgctgatgatgcagtccttgcttacatcaaccagttccttcttgaagatgaggatgaggagtcctatcctgttaccagtgtgcctgtggaggattcagtactcctcgccgctgtcgagaaaccattcgtcgacatcctcaagtctgctaaccatatcacagcaaaggcctatgaagtaaaatcctggatcactgatgattgccattccacgggaagtggaagatttcatgatgtggtcacaagtactctggactccacccaattggcccctgaaatggttcaaggggatgtagttgatgctgttcataagggtcagaagaacccacgtgacaatgacttggaggtggagaggaggaagagcaaacagtccgcattgtgtgatgaggagactgtccgagagatgtttgacaaagtgctgttgtgtaccgataagaattgtgcgttccactcaccaatgccagccgatgcacaaaacagcgggggatatgtgaaaggatctggaaatagaagagggcgaaggaagggaagatccggtgctggtgcagagcaggagccagtcgatctcacaaccctacttattcattgtgctcaggccgcggctattgatgaccacagaaactcaagtgagcatctgaaacagattaggaagcattcttctgctactggagatgctggccagagattggcacactactttgctgacgggctcgaggctcgcctagctggcactggtagcagcatctaccgttcacttgctgcaaagagaacttctactggtgatatgctgaaagcgttcaatttatatgttaaagcatgtccatttaggataatatcacactatgttgcaaatacgaccatcttaaatgctacgaagagcgtgacaaggttgcacattatagactacgggataatgtatggtttccagtggccaatcctcatgcagcggctctcaaagagatctggtgggcccccaacccttcgaatcactggtatagactttcccctgtcaggattccgccctgcagagcgtgttgaggcgacagggcgacggttacatgagtatgcccgtatgttcaatgttccgtttgaatatcaggccattgctgccaagtgggatactatccaagttaaagatctcaatataaagagcgatgagttcattgtcgttaactgcctttaccgaatgaggaacatgatggacgagacggcaacagatgacagcccgagaacaagagttttgaacacaatcagaaagttgaatccccatttgttcgttcatgggattgtcaacggtacttacaatgcacccttctttgtgacacggtttaaagaggctatgttttttttctcttcaatctttgatatgcttgaagcaaatgcctcacggatggatgaacataggctgctgatagaaagagaattctttggacgggaagctattaatgtgattgcttgcgagggtacagagaggattgaaaggccagagacctacaaacaatggcagatgagaaacctcagggcaggcttcaggcagctacctctggacagagagataatggcgagagcaaggtacaaggttagcaagacctatccgagggatttcctcgtggacgaagataacctacaaggttggaagggtcgtgtcatatatgctctttcagcatggagtacctag

SEQ ID NO: 12618 - protein, 648 aa, Sorghum bicolor
  misc_feature: Ceres ANNOT ID no. 6100686
  misc_feature (254)..(559): Pfam Id: GRAS Pfam Desc: GRAS family transcription factor
  misc_feature (194)..(647): NCBI GI: 32813435 NCBI Desc: scarecrow-like protein [lilium longiflorum]
  misc_feature (194)..(646): NCBI GI: 125743130 NCBI Desc: scarecrow-like protein 1 [pinus radiata]
  misc_feature (195)..(646): NCBI GI: 15222433 NCBI Desc: scarecrow-like transcription factor 14 (scl14) [arabidopsis thaliana]
  misc_feature (195)..(640): NCBI GI: 8778540 NCBI Desc: f22g5.9 [arabidopsis thaliana]
  misc_feature (196)..(646): NCBI GI: 89474466 NCBI Desc: gras4 [solanum lycopersicum]
  misc_feature: The sequence is a functional homolog of SEQ ID NO 1327 in the 10/374,780US patent application
  misc_feature: The sequence is a functional homolog of SEQ ID NO 1938 in the 10/412,699US patent application
  misc_feature: The sequence is a functional homolog of SEQ ID NO 2202 in the 10/374,780US patent application
  misc_feature: Useful for making plants with modulated growth and phenotype characteristics
  misc_feature: The sequence is a functional homolog of SEQ ID NO 1938 in the 20040045049 US patent application
  misc_feature: The sequence is a functional homolog of SEQ ID NO 1327 in the 20060162006 US patent application
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
MIMDPRPRDNLNFGARLPTPNPPTPHMISFSLQQPQPQFFPSYGFHSHNHNNPAISSHPSPPSVMPGCTTPSPASTTTTEADNAEDLSEAVADDAVLAYINQFLLEDEDEESYPVTSVPVEDSVLLAAVEKPFVDILKSANHITAKAYEVKSWITDDCHSTGSGRFHDVVTSTLDSTQLAPEMVQGDVVDAVHKGQKNPRDNDLEVERRKSKQSALCDEETVREMFDKVLLCTDKNCAFHSPMPADAQNSGGYVKGSGNRRGRRKGRSGAGAEQEPVDLTTLLIHCAQAAAIDDHRNSSEHLKQIRKHSSATGDAGQRLAHYFADGLEARLAGTGSSIYRSLAAKRTSTGDMLKAFNLYVKACPFRIISHYVANTTILNATKSVTRLHIIDYGIMYGFQWPILMQRLSKRSGGPPTLRITGIDFPLSGFRPAERVEATGRRLHEYARMFNVPFEYQAIAAKWDTIQVKDLNIKSDEFIVVNCLYRMRNMMDETATDDSPRTRVLNTIRKLNPHLFVHGIVNGTYNAPFFVTRFKEAMFFFSSIFDMLEANASRMDEHRLLIEREFFGREAINVIACEGTERIERPETYKQWQMRNLRAGFRQLPLDREIMARARYKVSKTYPRDFLVDEDNLQGWKGRVIYALSAWST

SEQ ID NO: 12619 - DNA, 1197 bp, Sorghum bicolor
  misc_feature: Ceres ANNOT ID no. 6100731
  misc_feature: Encodes the peptide sequence at SEQ ID NO 12620
atgctgcaactccgaaatcgcttcctccctctgctccgcgccgcctccacgctacactccccaatccacccccgcgcgtgccgcctcctcctctccacatccacctccaccaccctccccgcggccttctccctcgaggactacctcgtcgctgcctgcggcctcgccccagcccaagcccgcgaggtgtacaagaaggtgtcccgcgagttgctatccattggatacaagagatcattggagctctccaactcccgtctcacctctgcctccaaccctgatgctatcctcgccctgctctccggcgccggtctctcccgcgccgacatcgccgccgtcgtatccgcagatccgcttctccttcgcgcttccgcgaagaacatcgccccccgccttgttgctcttcgagaccgggtcggtctgtctgctccccagattgctcgcttcctcgtggtcggcgcacgcgcactccgccggggcgacgtctcttccaggctagagttcttcatctccttctacggctcgtttgagaaggtgctggtggccctaaagaggaatagagtcctcctcaatatgagccttgagaggataatcaagcctaacatagctttgctttgtcagtggggtgttcgagatattgtccagctgtgttcaaacaacacgcggttgcttaacttcaagccagaacgcgtcaaggagtttttgctgcgggcggaacagcttggggtgccacgaacttcacggatgtttaggcacgtggtgtcggtcgtcgccggtaatcccaaagagaaggttgctgccaagcgtgagttctttaagaggaccctcggttgttctgagtctgaggtttcctctgcagtatccaagatgccagctatattagggttctctgatgagattcttctccgcaaaattgagttccttgtcaatgaagttggggtggagccacaatacattgttcaaaggcctgtcctgttggcaatgagcctggagaagaggctaatgccgcggcattatgtcatgaaggtcctgcgggaaaagggtttgctggatagtagaacgggcttttcaacattcgttaaatttggagatgatgctttcaaattgaggttcattgactgtcacgaggactctgttcctggccttgcagatgcttatgctacagctcgtgctggtattgtgcccagtgatctctga

SEQ ID NO: 12620 - protein, 398 aa, Sorghum bicolor
  misc_feature: Ceres ANNOT ID no. 6100731
  misc_feature (68)..(369): Pfam Id: mTERF Pfam Desc: mTERF
  misc_feature (9)..(396): NCBI GI: 115467190 NCBI Desc: os06g0225100 [oryza sativa (japonica cultivar-group)]
  misc_feature (1)..(388): NCBI GI: 51536067 NCBI Desc: mitochondrial transcription termination factor-like [oryza sativa (japonica cultivar-group)]
  misc_feature (4)..(394): NCBI GI: 51536066 NCBI Desc: mitochondrial transcription termination factor-like [oryza sativa (japonica cultivar-group)]
  misc_feature (1)..(398): NCBI GI: 115467184 NCBI Desc: os06g0224700 [oryza sativa (japonica cultivar-group)]
  misc_feature (14)..(367): NCBI GI: 115467180 NCBI Desc: os06g0224500 [oryza sativa (japonica cultivar-group)]
  misc_feature: Useful for making plants with altered alkaloid content
  misc_feature: Functional homolog of the protein sequence given in SEQ ID NO 13002
MLQLRNRFLPLLRAASTLHSPIHPRACRLLLSTSTSTTLPAAFSLEDYLVAACGLAPAQAREVYKKVSRELLSIGYKRSLELSNSRLTSASNPDAILALLSGAGLSRADIAAVVSADPLLLRASAKNIAPRLVALRDRVGLSAPQIARFLVVGARALRRGDVSSRLEFFISFYGSFEKVLVALKRNRVLLNMSLERIIKPNIALLCQWGVRDIVQLCSNNTRLLNFKPERVKEFLLRAEQLGVPRTSRMFRHVVSVVAGNPKEKVAAKREFFKRTLGCSESEVSSAVSKMPAILGFSDEILLRKIEFLVNEVGVEPQYIVQRPVLLAMSLEKRLMPRHYVMKVLREKGLLDSRTGFSTFVKFGDDAFKLRFIDCHEDSVPGLADAYATARAGIVPSDL

SEQ ID NO: 12621 - DNA, 1848 bp, Sorghum bicolor
  misc_feature: Ceres ANNOT ID no. 6100760
  misc_feature: Encodes the peptide sequence at SEQ ID NO 12622
atggcagctgccagccctcttgctctcacattcttcttctgctgtatcctcctccttcaaacaatctgctgttcaggcgtatttgtggagctatcatatgattcgacacaggtcaagacactatcgagctcagtcgtcaccgagtacagagtcatggtcactgccaagcagcatgcctacctcttcttgaagccgttcgtgtgcagagagaagccatgcagatcggagcctctcgccgccggtggctcatttgttaacgaagttcttggtcctaaccggcgtctcaacgtcagcaacatcgtcgtcacggccaccgacacgcagctcggagcgctgcgccgcactttgcagtcgtttcacgcttctctcggcgccgccggattggcggcgagcgtcaaggtctcgccggagctctcgctgtcttctctgcgagtcgtcgccaaggatcgtgatcgtgccagaaagaagcggtggggcaaggtcatggagttcgtcaggaggacaggctcgtttgttcttgttcaggtggagacagaggcagaagcaaacggtgaggttgcggtggacgcggagatcgaagaggccgttgctgaggttgccgccctgttgcgcgccggcgccggcgtcgtgctccacgtcaagagccgtgcggctccaatcgcggtggcaatggcaaagctgggcggcgataccagccgggagaagaggctcttgggtgttctggtggacgtgtcctcccctcggcgggagctcggcgaggcaagagcgacggcgcacgacgagttctctccggtcagcaacccggcgacgacgcccgtgagcaacccagtgaccgtgccggccacgaaccccgtggccaacccgatggctccgggattcgtcaccgtgccgtcgaccaacccgggcaacgggttcgcgaccaacccgaacatgccgccgctgtacccggagccgacgacgccggccaccatgcccatgcctgacccgacgacgccgacgatgccgccggtgaccgtgccatcccctttcacgaacccggtctccgcgccgaccaccatgccgggtacagtgacaaacccggcagcccctgccgtgacgaatccggcaacgacgccgtcgcagttcccgggcacgtcgccggtcaccaacccggtgaccacgtacccgcagcagggcggcgtcggcgtcggtggcggcatgccggcaacgcagccagtgtaccagcctccggcgacgacaatgcccggcaccggcacggtgcagccgggcgcgcccaccatggccgggcaggcatggtgcgtcgccaagtcggggctcatggacaccaccctccaggacgcgatggactacgcgtgcggcatgggcggcgccgactgctcggccatccagcccatgggcgcctgctacaaccccaacacgctgcaggcgcacgcctcctacgccttcaacagctacttccagcgcaacccgtcggcggcgagctgcgacttcggtggcgccggcatgctcgtcaacgtcaacccaagctcaggaacttgcatgtaccagacatcatcaggtttcggcgccggttacagcccggggacgacgggcggcggcgtgcccggcggttacactccggggatgtcgggcaccggttacaacccagcgggagggatgtcgggcaccatgggagggggctccggttccacggtgctgaacgccaacaaccctgggggctccatgtacggcggctacgacaacccgacggggctcaccgcggggtcggcgccggtgtcctgcggcggctgggtcgtcctgtgcctcgtctggatggtcacctttgcgttcgtcaaggagagagtgtag

SEQ ID NO: 12622 - protein, 615 aa, Sorghum bicolor
  misc_feature: Ceres ANNOT ID no. 6100760
  misc_feature (431)..(515): Pfam Id: X8 Pfam Desc: X8 domain
  misc_feature (306)..(588): NCBI GI: 22329437 NCBI Desc: glucan endo-1,3-beta-glucosidase-related [arabidopsis thaliana]
  misc_feature (263)..(514): NCBI GI: 4835761 NCBI Desc: t8k14.10 [arabidopsis thaliana]
  misc_feature (381)..(515): NCBI GI: 140063135 NCBI Desc: x8 [medicago truncatula]
  misc_feature (431)..(574): NCBI GI: 57899559 NCBI Desc: glycosyl hydrolase family protein 17-like [oryza sativa (japonica cultivar-group)]
  misc_feature (431)..(564): NCBI GI: 23495810 NCBI Desc: glycosyl hydrolase family 17-like protein [oryza sativa (japonica cultivar-group)]
MAAASPLALTFFFCCILLLQTICCSGVFVELSYDSTQVKTLSSSVVTEYRVMVTAKQHAYLFLKPFVCREKPCRSEPLAAGGSFVNEVLGPNRRLNVSNIVVTATDTQLGALRRTLQSFHASLGAAGLAASVKVSPELSLSSLRVVAKDRDRARKKRWGKVMEFVRRTGSFVLVQVETEAEANGEVAVDAEIEEAVAEVAALLRAGAGVVLHVKSRAAPIAVAMAKLGGDTSREKRLLGVLVDVSSPRRELGEARATAHDEFSPVSNPATTPVSNPVTVPATNPVANPMAPGFVTVPSTNPGNGFATNPNMPPLYPEPTTPATMPMPDPTTPTMPPVTVPSPFTNPVSAPTTMPGTVTNPAAPAVTNPATTPSQFPGTSPVTNPVTTYPQQGGVGVGGGMPATQPVYQPPATTMPGTGTVQPGAPTMAGQAWCVAKSGLMDTTLQDAMDYACGMGGADCSAIQPMGACYNPNTLQAHASYAFNSYFQRNPSAASCDFGGAGMLVNVNPSSGTCMYQTSSGFGAGYSPGTTGGGVPGGYTPGMSGTGYNPAGGMSGTMGGGSGSTVLNANNPGGSMYGGYDNPTGLTAGSAPVSCGGWVVLCLVWMVTFAFVKERV

SEQ ID NO: 12623 - DNA, 765 bp, Sorghum bicolor
  misc_feature: Ceres ANNOT ID no. 6100796
  misc_feature: Encodes the peptide sequence at SEQ ID NO 12624
atggtgggtgttagcgcggggcgtgacttgggcgcgggcgcgggcgcggatgcggcggcggcggccagggcacaggcggcgcgggatgtgtgtgcggcgtcggcggcgttcgcgtcctgcacgcaccgccgccgccggtcgtcaccgcgcggcccgcacttcgtcgactggtacctcgtcctcgcccttcacccggacaagaacaggcaccccaaggcggaggtggcgttcaagatcgtctccgaggcgcacgcgtgcctcacggaccaggcgcggcggcgggccttcgactcggagcggcgggacagcttctgcgccgcgtgccacgaccgccacgccgccaggtggtccaagccgccgaccctccgcgtcgcgcccggcgcgaccaatcatcaggcgccagcgccagcggcgccggccaggagcagcaaggcggagcgggaggtgcagcgccggctgcgggacgagtgccgggtcatcgacgggtgcctgcgggccaacgacgcagcggcccgcgcgcgccgccgccagtcgttcccgctcttcgacccctccgacagccgccgcttcccggactacccgcacgtccgcccgccgccgttcggcctcggtggcgcggagctccggcgatccgacgagtggcttggccgcgcggcggtggatcagcaggccatgaatcggaggtggtgcagaaacggtggcgagtcgcctgtgtaccagatcaggacggcggcgacagagtgcaccgagaggcgtgcttggtga

SEQ ID NO: 12624 - protein, 254 aa, Sorghum bicolor
  misc_feature: Ceres ANNOT ID no. 6100796
  misc_feature (56)..(97): Pfam Id: DnaJ Pfam Desc: DnaJ domain
  misc_feature (59)..(197): NCBI GI: 145331990 NCBI Desc: heat shock protein binding / unfolded protein binding [arabidopsis thaliana]
  misc_feature (59)..(119): NCBI GI: 24668492 NCBI Desc: cg7130-pa [drosophila melanogaster]
  misc_feature (59)..(118): NCBI GI: 102139803 NCBI Desc: heat shock protein dnaj n-terminal domain-containing protein [musa acuminata]
MVGVSAGRDLGAGAGADAAAAARAQAARDVCAASAAFASCTHRRRRSSPRGPHFVDWYLVLALHPDKNRHPKAEVAFKIVSEAHACLTDQARRRAFDSERRDSFCAACHDRHAARWSKPPTLRVAPGATNHQAPAPAAPARSSKAEREVQRRLRDECRVIDGCLRANDAAARARRRQSFPLFDPSDSRRFPDYPHVRPPPFGLGGAELRRSDEWLGRAAVDQQAMNRRWCRNGGESPVYQIRTAATECTERRAW

SEQ ID NO: 12625 - DNA, 804 bp, Sorghum bicolor
  misc_feature: Ceres ANNOT ID no. 6100804
  misc_feature: Encodes the peptide sequence at SEQ ID NO 12626
  misc_feature: Up-regulated in shoot tissues in response to methyl jasmonate treatment
  misc_feature: Up-regulated in root tissues in response to methyl jasmonate treatment
atggcagcgatgaatagtgatttgggaggcttaggtggcaggcctgcaaacccacaagcaaatccttttggaactgccttgcatggtgctggatcaggattgatccgtactggactagaagcatacggggggaggattatagattcaagttctgaatttatgcagagcaatataacacaatatttatccaaccctcagtactactttcaagtcaacagccagtatgtgaggaacaaactgaaggtcatcttgttccctttcttgcacaggggtcactggacaagaataactgaaccggtaggaggaaggctatcctacaaacctccagtccaggatatcaatgcaccagacttgtacatccccttgatggcatttggcacctacattatagttgctgggtatgctttgggtgttcttggaaggtttacccctgaggcgctgaccctacagttctctaaagggatacttggctggtttctgcaagtcatgctcatcaaaggtctgctgtactccctgggcagcagtgaggctccattgctggacgtagtggcatacgctggatatggtttcgccggcacttcccttgcgatgctagcccgcatcttctggagctacctgtactacttcatcatgccatggttctgcatctgcacgggagtcttccttgtgaagaccatgaagagggttcttctgggcgggccaaggagctacgagaggcaccccagccggaaccactacttcctgctcttcttggcggctgtgcagttccctatgctgttctggctcagcaacatcagcggctga

SEQ ID NO: 12626 - protein, 267 aa, Sorghum bicolor
  misc_feature: Ceres ANNOT ID no. 6100804
  misc_feature (34)..(263): Pfam Id: YIF1 Pfam Desc: YIF1
  misc_feature (1)..(267): NCBI GI: 115468982 NCBI Desc: os06g0620600 [oryza sativa (japonica cultivar-group)]
  misc_feature (12)..(265): NCBI GI: 38346458 NCBI Desc: osjnba0019g23.6 [oryza sativa (japonica cultivar-group)]
  misc_feature (12)..(265): NCBI GI: 90265113 NCBI Desc: h0806h05.8 [oryza sativa (indica cultivar-group)]
  misc_feature (10)..(266): NCBI GI: 30695009 NCBI Desc: integral membrane hrf1 family protein [arabidopsis thaliana]
  misc_feature (16)..(266): NCBI GI: 33589682 NCBI Desc: at3g59500 [arabidopsis thaliana]
  misc_feature: Up-regulated in shoot tissues in response to methyl jasmonate treatment
  misc_feature: Up-regulated in root tissues in response to methyl jasmonate treatment
MAAMNSDLGGLGGRPANPQANPFGTALHGAGSGLIRTGLEAYGGRIIDSSSEFMQSNITQYLSNPQYYFQVNSQYVRNKLKVILFPFLHRGHWTRITEPVGGRLSYKPPVQDINAPDLYIPLMAFGTYIIVAGYALGVLGRFTPEALTLQFSKGILGWFLQVMLIKGLLYSLGSSEAPLLDVVAYAGYGFAGTSLAMLARIFWSYLYYFIMPWFCICTGVFLVKTMKRVLLGGPRSYERHPSRNHYFLLFLAAVQFPMLFWLSNISG

SEQ ID NO: 12627 - DNA, 2154 bp, Sorghum bicolor
  misc_feature: Ceres ANNOT ID no. 6100836
  misc_feature: Encodes the peptide sequence at SEQ ID NO 12628
atgagagctctcgcctcgcccaccgcctccttcctcccggggatcccgagccctagccctcgcgcgcgcggggctctccgttccgcgccggccgcgctctcgcgggccccttccgggcgctccgtcgccgcctcggccgcggccgccacaggggaccactggggcgccgaccaccagcactaccacggaggacgcgcgggcgcgtcggaggccgggtcccccgcgtcggcgcgcggcgtcaagtgcgacgtcgacgtggtgtcgtggcgggagcggcgggtgctcgcgtccgtgcctgtggccgccgacgtcgacaccctctggcaggtcatcaccgactacgagcgcctcgccgacttcatccccaacctcgtccagagtgggacgattccgtgcccgcatgaagggcggatatggctggagcagagaggcctgcagcaagcgttgtactggcacattgaggcgcgtgtcgtgttggatctccaggaaatccatgactccattaatgggcgagaactccatttctcgatggtagatggtgacttcaagaagtttgaaggaaaatggtccataagatctggtccaaggtcctctagtgcagttttgctgtatgaagttaatgtgataccaagatttaacttcccggctatatttcttgaaaagattataaggtcagatcttcctgtaaatcttggtgccttggcttgtagagctgaaaagatttatctggaaaatcaaagttgtggttcgagaaaattctctgttgaggacttgaagccatcatctacttcttctcagcttgataacttccgtagtaggacagttgatacttcttctagtaaatttaaagaagcacctcccacttctggtgttaacagtgtgcttccatcacctgcttctgaattgattagcaaatggggtgtatatggaaatgtatgcagaattgataggccttgcgtggtagatgagatccatcttcgaagatttgatggcatgttggaacatgagggggctcataggtgtgtttttgctagtatcactgtgaaagcaccagttcgggaggtatggaatgttctcacagcatatgagaatttgcccgaattcgtaccaaacctggctatcagtaggattgttcttcgtgataataacaaggtccgcataatgcaggagggttgcaaaggcctgctgtatatggtccttcatgcccgtgttgttatggatcttcgtgaaaaatttgagcaagagatcaggtttgaacaagttgagggtgatttttactcgtttaaagggaaatggcgcttagaacaacttggggatcagcacaccctgttgaagtacatggttgagactaagatgcatagggacacctttctctctgagtctatccttgaagaggtcatatatgaagatcttccatcaaacttgtgtgcaatccgtgattatattgaaaaggctggagccaagggtagcaactccacagctcattctgatgtgtccatagacccagatgcttatcatgctgaaagcaggcaatctgagcaagcatctgtgtcttgctcatccagtaccatgaagcagagaccaaaagtcccagggttgcaaaaggacattgaggtcctaaaatcagagcttgagaatttcattgcagaatatggtcagtatggtttcatgcctaagagaaagcatctccggtctcatggaagggtggatatcgagaaggcaataacacgaatgggtgggttccggaagattgccagcataatgaacctttctctttcttacaaaaatcgaaaaccaagaggctattgggataatctggagaacttgcaagaagagatcagccggttccagaaaagttgggggatggatccttcttatatgccaagtagaaaatcttttgagagggcaggtcgttacgacattgctcgggcattggaaaaatggggtggggtgcaggaggtttcacgccttctctctcttaaactaagacgtcctagaaggcaaggcgacttggatgacgagagccggtctgaatccccatctgagatgacaaagaagcacggggtgaaacctgataaaggcaatgtttccccagatgcccagaaatggctcctgaagctgaaggatttggatgtcaactgggtggaatactag

SEQ ID NO: 12628 - protein, 717 aa, Sorghum bicolor
  misc_feature: Ceres ANNOT ID no. 6100836
  misc_feature (100)..(235): Pfam Id: Polyketide_cyc Pfam Desc: Polyketide cyclase / dehydrase and lipid transport
  misc_feature (348)..(479): Pfam Id: Polyketide_cyc Pfam Desc: Polyketide cyclase / dehydrase and lipid transport
  misc_feature (23)..(716): NCBI GI: 92881332 NCBI Desc: streptomyces cyclase/dehydrase [medicago truncatula]
  misc_feature (84)..(241): NCBI GI: 119510311 NCBI Desc: cyclase/dehydrase-like protein [nodularia spumigena ccy9414]
  misc_feature (75)..(241): NCBI GI: 23127291 NCBI Desc: cog2867: oligoketide cyclase/lipid transport protein [nostoc punctiforme pcc 73102]
  misc_feature (80)..(247): NCBI GI: 75910653 NCBI Desc: streptomyces cyclase/dehydrase [anabaena variabilis atcc 29413]
  misc_feature (78)..(241): NCBI GI: 33240572 NCBI Desc: oligoketide cyclase family enzyme [prochlorococcus marinus subsp. marinus str. ccmp1375]
MRALASPTASFLPGIPSPSPRARGALRSAPAALSRAPSGRSVAASAAAATGDHWGADHQHYHGGRAGASEAGSPASARGVKCDVDVVSWRERRVLASVPVAADVDTLWQVITDYERLADFIPNLVQSGTIPCPHEGRIWLEQRGLQQALYWHIEARVVLDLQEIHDSINGRELHFSMVDGDFKKFEGKWSIRSGPRSSSAVLLYEVNVIPRFNFPAIFLEKIIRSDLPVNLGALACRAEKIYLENQSCGSRKFSVEDLKPSSTSSQLDNFRSRTVDTSSSKFKEAPPTSGVNSVLPSPASELISKWGVYGNVCRIDRPCVVDEIHLRRFDGMLEHEGAHRCVFASITVKAPVREVWNVLTAYENLPEFVPNLAISRIVLRDNNKVRIMQEGCKGLLYMVLHARVVMDLREKFEQEIRFEQVEGDFYSFKGKWRLEQLGDQHTLLKYMVETKMHRDTFLSESILEEVIYEDLPSNLCAIRDYIEKAGAKGSNSTAHSDVSIDPDAYHAESRQSEQASVSCSSSTMKQRPKVPGLQKDIEVLKSELENFIAEYGQYGFMPKRKHLRSHGRVDIEKAITRMGGFRKIASIMNLSLSYKNRKPRGYWDNLENLQEEISRFQKSWGMDPSYMPSRKSFERAGRYDIARALEKWGGVQEVSRLLSLKLRRPRRQGDLDDESRSESPSEMTKKHGVKPDKGNVSPDAQKWLLKLKDLDVNWVEY

SEQ ID NO: 12629 - DNA, 957 bp, Sorghum bicolor
  misc_feature: Ceres ANNOT ID no. 6100887
  misc_feature: Encodes the peptide sequence at SEQ ID NO 12630
atgtcgtcgtcggcggagaacgaccccacggtgaccgagcgcggcgccagcagcaaggacaagcacgaggacggcgacaaggagcagggcggcggcgggttcattgacaaggtgaaggacttcatccacgacatcggcgagaagatcgaggaggcggtcgggttcggcaagcccacggccgacgtctgcggcatccacatcccgcacatcagccttcaccgcgccgacctcgtcgtggacgtgctcatcaagaaccccaacccggtgcccatcccgctcgtcgacatcgactacctcatcgacagcgacggccgcaagctcgtgtccggcctcatccccgacgccggcaccatccacgcgcacggccaggagaccgtcaagatccccgtctcgctcgtcttcgacgacatccggagcacttacaaggacattcagccggggagcatcatcccttacctcgtccgcgtcgtgctcctcgtcgacgtccccatcatcggccgcatcaagatcccgatccagaaggacggcgagatccccatcccgtacaagcccgacgtcgacgtcgagaagatcaagttccaccacttctccttcgaggagaccaccgccacgctccacctcaagctcgagaacaagaacgacttcgacctcggcctcaacctgctcgagtacgagatgtggctcggcgacgatagcatcgcctccgctgagctcacccagaccgccaagatcgagaagcaggggatcaccaggatgcaggtgcccttcagcttcaggcctaaggactttggatccgctgtctgggacatgatcaggggaaggggcacggggtacaccatcaagggaaagattgatgtcgacactcccttcggcaacatgaagctgcccataagcaaagagggtggaaccacctgcatcaagaaggacgatgacgacgatgacgacgatgacaactga

SEQ ID NO: 12630 - protein, 318 aa, Sorghum bicolor
  misc_feature: Ceres ANNOT ID no. 6100887
  misc_feature (32)..(187): Pfam Id: LEA_2 Pfam Desc: Late embryogenesis abundant protein
  misc_feature (4)..(317): NCBI GI: 56112332 NCBI Desc: salt tolerance protein [sesuvium portulacastrum]
  misc_feature (1)..(317): NCBI GI: 34394536 NCBI Desc: late embryogenesis abundant proteins-like [oryza sativa (japonica cultivar-group)]
  misc_feature (6)..(317): NCBI GI: 3212877 NCBI Desc: similar to late embryogenesis abundant proteins [arabidopsis thaliana]
  misc_feature (6)..(316): NCBI GI: 21592483 NCBI Desc: similar to late embryogenesis abundant proteins [arabidopsis thaliana]
  misc_feature (61)..(318): NCBI GI: 3264769 NCBI Desc: late embryogenesis-like protein [prunus armeniaca]
  misc_feature: Useful for making plants with altered alkaloid content
  misc_feature: Functional homolog of the protein sequence given in SEQ ID NO 13165
  misc_feature: Useful for making plants with altered alkaloid content
  misc_feature: Functional homolog of the protein sequence given in SEQ ID NO 13165
MSSSAENDPTVTERGASSKDKHEDGDKEQGGGGFIDKVKDFIHDIGEKIEEAVGFGKPTADVCGIHIPHISLHRADLVVDVLIKNPNPVPIPLVDIDYLIDSDGRKLVSGLIPDAGTIHAHGQETVKIPVSLVFDDIRSTYKDIQPGSIIPYLVRVVLLVDVPIIGRIKIPIQKDGEIPIPYKPDVDVEKIKFHHFSFEETTATLHLKLENKNDFDLGLNLLEYEMWLGDDSIASAELTQTAKIEKQGITRMQVPFSFRPKDFGSAVWDMIRGRGTGYTIKGKIDVDTPFGNMKLPISKEGGTTCIKKDDDDDDDDDN

SEQ ID NO: 12631 - DNA, 834 bp, Sorghum bicolor
  misc_feature: Ceres ANNOT ID no. 6103908
  misc_feature: Encodes the peptide sequence at SEQ ID NO 12632
atggccttgttgcgcgagcacctcgacctcatccgcgcccacctcctcgacgaccaccacgtcgccgtgaccgtgagctccgatgactcggcgtcgttgcagtcgtcatcgccatcgccatcgcaatcgccgccggggcgtagtaggccgctgccagcgctttccgtctcgctgcccccgaggccaccggcggtagacctgcagcagcagcacctgtgggcgccggcgccgccgccgatgcagattcatcggcaggagcagcagcactactgctacccaccggaacccgaggaggaggaggacgatttccggcggtaccgcggcgtgcggcagcggccgtggggcaagtacgcggccgagatccgggaccccgcgcggaagggcgcgcgcgtgtggctgggcacctacgacaccgccgtggaggccgcgcgcgcctacgaccgcgccgcgttccgcctgcgcgggtccaaggccatcctcaacttccccaacgaggtcgcgttcggcgccgccgcacggtgggcggcggcgcctgctgctgctcctcagcccagcgtgaccgtggccgggaacaagaggggccgggcgaggtcgccgcaggagcaggacgccgggtgcttattggtcagggaggtgaagaaggagcgggttcaggagcccgcagcggcggcagcgggttgtggctgggatggcaaggatacggcggcaagcggcggaggggcggactacttctgggaggacgagtcgctgaagggggcgatctgcagcctgccgccgctctcaccgttgtcgccgcacccgcacctggccgtcccgcagctctccgtcagctga

SEQ ID NO: 12632 - protein, 277 aa, Sorghum bicolor
  misc_feature: Ceres ANNOT ID no. 6103908
  misc_feature (104)..(156): Pfam Id: AP2 Pfam Desc: AP2 domain
  misc_feature (56)..(277): NCBI GI: 33440024 NCBI Desc: ap25 [oryza sativa (japonica cultivar-group)]
  misc_feature (101)..(277): NCBI GI: 32490143 NCBI Desc: osjnba0065h10.2 [oryza sativa (japonica cultivar-group)]
  misc_feature (94)..(166): NCBI GI: 3298498 NCBI Desc: ethylene responsive element binding factor [arabidopsis thaliana]
  misc_feature (99)..(230): NCBI GI: 60459379 NCBI Desc: ethylene responsive element binding protein c2 [capsicum annuum]
  misc_feature (104)..(233): NCBI GI: 1208497 NCBI Desc: ethylene-responsive element binding protein [nicotiana tabacum]
  misc_feature: The plant flowers significantly late compared to wild-type.
  misc_feature: The plant is abnormally large.
  misc_feature: The sequence is a functional homolog of SEQ ID NO 10 in the 10/412,699US patent application
  misc_feature: The sequence is a functional homolog of SEQ ID NO 10 in the 10/666,642US patent application
  misc_feature: The sequence is a functional homolog of SEQ ID NO 1011 in the 10/412,699US patent application
  misc_feature: The sequence is a functional homolog of SEQ ID NO 124 in the 11/479,226US patent application
  misc_feature: The sequence is a functional homolog of SEQ ID NO 1352 in the 10/666,642US patent application
  misc_feature: The sequence is a functional homolog of SEQ ID NO 167 in the 11/479,226US patent application
  misc_feature: The sequence is a functional homolog of SEQ ID NO 1718 in the 10/412,699US patent application
  misc_feature: The sequence is a functional homolog of SEQ ID NO 503 in the 10/374,780US patent application
  misc_feature: The sequence is a functional homolog of SEQ ID NO 54 in the 10/412,699US patent application
  misc_feature: The sequence is a functional homolog of SEQ ID NO 700 in the 10/666,642US patent application
  misc_feature: Useful for biocontainment applications
  misc_feature: Useful for making plants with altered alkaloid content
  misc_feature: Useful for making plants with altered sugar content
  misc_feature: Useful for making plants with altered terpenoid content
  misc_feature: Useful for making plants with modulated biomass
  misc_feature: Useful for making plants with modulated cold sensitivity
  misc_feature: Useful for making plants with modulated flowering time
  misc_feature: Useful for making plants with modulated growth and phenotype characteristics
  misc_feature: Useful for making plants with modulated heat sensitivity
  misc_feature: Useful for making plants with modulated oxidative stress sensitivity
  misc_feature: Useful for making plants with modulated seed size
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13268
  misc_feature: Functional homolog of the protein sequence given in SEQ ID NO 13434
  misc_feature: Functional homolog of the protein sequence given in SEQ ID NO 13455
  misc_feature: Functional homolog of the protein sequence given in SEQ ID NO 13513
  misc_feature: Functional homolog of the protein sequence given in SEQ ID NO 13515
  misc_feature: The sequence is a functional homolog of SEQ ID NO 10 in the 20040045049 US patent application
  misc_feature: The sequence is a functional homolog of SEQ ID NO 1011 in the 20040045049 US patent application
  misc_feature: The sequence is a functional homolog of SEQ ID NO 1718 in the 20040045049 US patent application
  misc_feature: The sequence is a functional homolog of SEQ ID NO 54 in the 20040045049 US patent application
  misc_feature: The sequence is a functional homolog of SEQ ID NO 503 in the 20060162006 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Useful for making plants with altered lignin content
  misc_feature: Functional homolog of the protein sequence given in SEQ ID NO 13219
  misc_feature: The sequence is a functional homolog of SEQ ID NO. 274 in the 11/188,298 US application
MALLREHLDLIRAHLLDDHHVAVTVSSDDSASLQSSSPSPSQSPPGRSRPLPALSVSLPPRPPAVDLQQQHLWAPAPPPMQIHRQEQQHYCYPPEPEEEEDDFRRYRGVRQRPWGKYAAEIRDPARKGARVWLGTYDTAVEAARAYDRAAFRLRGSKAILNFPNEVAFGAAARWAAAPAAAPQPSVTVAGNKRGRARSPQEQDAGCLLVREVKKERVQEPAAAAAGCGWDGKDTAASGGGADYFWEDESLKGAICSLPPLSPLSPHPHLAVPQLSVS

SEQ ID NO: 12633 - DNA, 1056 bp, Sorghum bicolor
  misc_feature: Ceres ANNOT ID no. 6103958
  misc_feature: Encodes the peptide sequence at SEQ ID NO 12634
atgatgatgctgatcgactgctcggggtgccgtaccccgctgcagctgccgcacggggctccctgcatccggtgcgccatctgtggggccgtcacgcacgtcgcccccgcccctcccgccgaccccaaccgcggcgccgtacagcaggcgccgggatggggcccgccgccgccgccggtgcacgggcggaagcgcgccgtggtgtgcgggatctcgtatcggtactcgcggcatgagctcaagggctgcatcaacgacgccaagtgcatgcggcacctgctcatgacgcgcttcaacttccccgacgactccatcatcatgctcaacgaagaacaaaccgacccctacaaaatcccaacaaagcataacataaggatggccatgtattggcttgtccaaggttgtcaacctggagactcattggtgttccattattctgggcatggagcacaacaaagaaactacagtggagatgaggttgatgggttcgatgaaaccctctgcccattggattttgagacacagggaatgattgtggatgatgagataaatacagcactagttagaccacttcctcatggagttaaacttcatgcactcattgatgcttgtcatagtgggactgcacttgatttgccttacctctgcagaatgagcaggagtggtcaatatgtatgggaagatcaccgaccacgatctggtgtctggaaaggcactagtggtggggaggctatttcatttagtggttgtgatgatgatcagacctctgcagatacctctgctttgtcaaagatcacttcgactggtgcaatgacattctgcttcatccaagctattgaacgtggacagggcaccacctacggtagtatcttgaactccatgcgttcgacaatacgcaacacaggtgactcagcgggtgtcggtggtggtgctgttacatcactaattacaatgcttcttactggagggagcctttctgctggtggtctgagacaggagccacaactgacggcgtgcgagacatttgatgtctatgcgaagcccttctccctatga

SEQ ID NO: 12634 - protein, 351 aa, Sorghum bicolor
  misc_feature: Ceres ANNOT ID no. 6103958
  misc_feature (64)..(346): Pfam Id: Peptidase_C14 Pfam Desc: Caspase domain
  misc_feature (7)..(31): Pfam Id: zf-LSD1 Pfam Desc: LSD1 zinc finger
  misc_feature (1)..(351): NCBI GI: 115483494 NCBI Desc: os10g0565100 [oryza sativa (japonica cultivar-group)]
  misc_feature (3)..(351): NCBI GI: 32482812 NCBI Desc: metacaspase 1 [arabidopsis thaliana]
  misc_feature (5)..(351): NCBI GI: 115453333 NCBI Desc: os03g0388900 [oryza sativa (japonica cultivar-group)]
  misc_feature (5)..(351): NCBI GI: 37788549 NCBI Desc: metacaspase 3 [arabidopsis thaliana]
  misc_feature (5)..(259): NCBI GI: 30697974 NCBI Desc: latex-abundant family protein (amc3) / caspase family protein [arabidopsis thaliana]
  misc_feature: The sequence is a functional homolog of SEQ ID NO 110 in the 11/479,226US patent application
  misc_feature: The sequence is a functional homolog of SEQ ID NO 1289 in the 11/479,226US patent application
  misc_feature: The sequence is a functional homolog of SEQ ID NO 1715 in the 11/479,226US patent application
  misc_feature: The sequence is a functional homolog of SEQ ID NO 18 in the 10/412,699US patent application
  misc_feature: The sequence is a functional homolog of SEQ ID NO 180 in the 10/374,780US patent application
  misc_feature: The sequence is a functional homolog of SEQ ID NO 1854 in the 10/412,699US patent application
  misc_feature: The sequence is a functional homolog of SEQ ID NO 188 in the 10/412,699US patent application
  misc_feature: The sequence is a functional homolog of SEQ ID NO 1888 in the 10/412,699US patent application
  misc_feature: The sequence is a functional homolog of SEQ ID NO 2098 in the 10/374,780US patent application
  misc_feature: The sequence is a functional homolog of SEQ ID NO 2274 in the 10/374,780US patent application
  misc_feature: The sequence is a functional homolog of SEQ ID NO 234 in the 10/225,068US patent application
  misc_feature: The sequence is a functional homolog of SEQ ID NO 596 in the 10/412,699US patent application
  misc_feature: The sequence is a functional homolog of SEQ ID NO 704 in the 10/225,066US patent application
  misc_feature: Useful for making plants with modulated growth and phenotype characteristics
  misc_feature: The sequence is a functional homolog of SEQ ID NO 18 in the 20040045049 US patent application
  misc_feature: The sequence is a functional homolog of SEQ ID NO 1854 in the 20040045049 US patent application
  misc_feature: The sequence is a functional homolog of SEQ ID NO 188 in the 20040045049 US patent application
  misc_feature: The sequence is a functional homolog of SEQ ID NO 1888 in the 20040045049 US patent application
  misc_feature: The sequence is a functional homolog of SEQ ID NO 596 in the 20040045049 US patent application
  misc_feature: The sequence is a functional homolog of SEQ ID NO 110 in the 11/479,226 US patent application
  misc_feature: The sequence is a functional homolog of SEQ ID NO 1289 in the 11/479,226 US patent application
  misc_feature: The sequence is a functional homolog of SEQ ID NO 180 in the 10/374,780 US patent application
  misc_feature: The sequence is a functional homolog of SEQ ID NO 234 in the 10/225,068 US patent application
  misc_feature: The sequence is a functional homolog of SEQ ID NO 596 in the 10/412,699 US patent application
  misc_feature: The sequence is a functional homolog of SEQ ID NO 1888 in the 10/412,699 US patent application
  misc_feature: The sequence is a functional homolog of SEQ ID NO 1715 in the 11/479,226 US patent application
  misc_feature: The sequence is a functional homolog of SEQ ID NO 1854 in the 10/412,699 US patent application
  misc_feature: The sequence is a functional homolog of SEQ ID NO 2098 in the 10/374,780 US patent application
  misc_feature: The sequence is a functional homolog of SEQ ID NO. 330 in the 11/188,298 US application
MMMLIDCSGCRTPLQLPHGAPCIRCAICGAVTHVAPAPPADPNRGAVQQAPGWGPPPPPVHGRKRAVVCGISYRYSRHELKGCINDAKCMRHLLMTRFNFPDDSIIMLNEEQTDPYKIPTKHNIRMAMYWLVQGCQPGDSLVFHYSGHGAQQRNYSGDEVDGFDETLCPLDFETQGMIVDDEINTALVRPLPHGVKLHALIDACHSGTALDLPYLCRMSRSGQYVWEDHRPRSGVWKGTSGGEAISFSGCDDDQTSADTSALSKITSTGAMTFCFIQAIERGQGTTYGSILNSMRSTIRNTGDSAGVGGGAVTSLITMLLTGGSLSAGGLRQEPQLTACETFDVYAKPFSL

SEQ ID NO: 12635 - DNA, 1164 bp, Sorghum bicolor
  misc_feature: Ceres ANNOT ID no. 6104212
  misc_feature: Encodes the peptide sequence at SEQ ID NO 12636
atgaggataggggctggagcagcggcagcggccaacatggctgcttgctcctccgttccctgctccttccccaccaagccagaccctcaccgccggggccgcagctctcatctccctcggctccctgctgctacccagtttcgtcggtttcgatcactctctgccgccgccgccgcctcgtcgtcggcgagtcgcctccgtccacgagcctccgtgtccgcgtcggccgccccgtccaaggactacgagttcactgatggaaacggagaggtggagctgcgactggacatccaaaagcttggcatagagagtgcaagagatgtttttgttgacgtcgatgatacatccctattgatcagagccaagtctgacgggacactgaggactttgatgaacgtccaaacactgtttgataggattaagtcttctgagaccatatggttcatcgatgaggaccaattggtggtgaatctgaagaaagtagagcaagagttgaaatggcctgatatagatgaatcatgggaatccctcacttctgggatcacccagttgttgacagggatcagtgtccacattgttggtgattccacacacattaatgaggcagttgctaaggagatagccgagggcattgggtaccttccggtttgcacaagtgagctgttagagagcgccactcaaaagtcgattgatacatgggtggcttccgaaggagcggactcggtagctgaagccgaatctgttgtcttggaaagccttagcagccatgtccgcaccgtagttgcaactctggggggcaagcaaggagcagccagcagattcgacagatggcagtaccttcattctgggttcacggtatggctatcggtatctgatgcaagtgacgaagctactgcaagagaagaagcccgaagaagcgtgagcagtggaagcgtttcttacgccaaggcggacgtggtggtgaagcttggcgggtgggacccagagtacacgcgagctgttgcgcagggctgcctcgtcgccctcaagcagctaaccttagcagacaagaagctggcagggaagaagagcctctacatcaggcttggttgcagaggcgattggcccaacatcgagcctccaggctgggaccctgaatccgacgccccaccaaccaacatctga

SEQ ID NO: 12636 - protein, 387 aa, Sorghum bicolor
  misc_feature: Ceres ANNOT ID no. 6104212
  misc_feature (80)..(160): Pfam Id: CS Pfam Desc: CS domain
  misc_feature (203)..(343): Pfam Id: SKI Pfam Desc: Shikimate kinase
  misc_feature (185)..(290): NCBI GI: 56750655 NCBI Desc: shikimate kinase [synechococcus elongatus pcc 6301]
  misc_feature (185)..(290): NCBI GI: 81299703 NCBI Desc: shikimate kinase [synechococcus elongatus pcc 7942]
  misc_feature (184)..(288): NCBI GI: 126657832 NCBI Desc: shikimate kinase [cyanothece sp. ccy0110]
  misc_feature (183)..(291): NCBI GI: 67922250 NCBI Desc: shikimate kinase [crocosphaera watsonii wh 8501]
  misc_feature (181)..(290): NCBI GI: 60389805 NCBI Desc: shikimate kinase (sk)
MRIGAGAAAAANMAACSSVPCSFPTKPDPHRRGRSSHLPRLPAATQFRRFRSLSAAAAASSSASRLRPRASVSASAAPSKDYEFTDGNGEVELRLDIQKLGIESARDVFVDVDDTSLLIRAKSDGTLRTLMNVQTLFDRIKSSETIWFIDEDQLVVNLKKVEQELKWPDIDESWESLTSGITQLLTGISVHIVGDSTHINEAVAKEIAEGIGYLPVCTSELLESATQKSIDTWVASEGADSVAEAESVVLESLSSHVRTVVATLGGKQGAASRFDRWQYLHSGFTVWLSVSDASDEATAREEARRSVSSGSVSYAKADVVVKLGGWDPEYTRAVAQGCLVALKQLTLADKKLAGKKSLYIRLGCRGDWPNIEPPGWDPESDAPPTNI

SEQ ID NO: 12637 - DNA, 1644 bp, Sorghum bicolor
  misc_feature: Ceres ANNOT ID no. 6104229
  misc_feature: Encodes the peptide sequence at SEQ ID NO 12638
atggccgccaccgccatggttgcgattactaatttaggctgccgccatgacccgctctcctcccttccccgcgccacgtcggcgcccgcccgctcctgtacgcttcctcctcgccgccgccgatgcagaccgctcactccccgttcttcttgctgctccccgccttcctcctccgtctctccgcgccgggtcctccggccaacagcagcactgaagcgcatccctgccggcgacaccagcttcgtgggtccagccaataatgacgccaccacgcttaaccaccgatcgtcatcgtccgaccttcgccgaagtctgatcatccccaactccaccgctagcaccggacacgccactgcttcctcaggagtgctcccctctattcttggggtggcacatctggctgtgtcgctgggcattatgctcgccgccgacaagttcctcaaaaaggcattcgtcgccgcgggcatcaagttcccaagcgccctcttcggcatgttctgtgtcttctccgtgctggtcgtcttcgacatattcgcgcctcctgtcgccaaggcgttcatgaacttctttgagcctgccacaatgttcatcaagaggtggctacccgtgttctacgtcccgacgctggtcgtgtttccgctcgccatcacggagatcccagcggcttcagcgctcaagatttttgcaatcacttttggtggctggtttgctaccctcacggttgcaggatatacagtgttagctgtgagaaaccttgtgaaaacagagcttattccagatacagagcctgtgagcaagccgtcgccattttctacgtcggaaatctggtcatggactgctatattcgtcgcatcatttggtgttgcatatttcaatcccacggcacttggtaccaccgcaaaaacatgccttcctttcctgcttgctgctaacgtgctgggatacatggttggttctgggttaccagctggtgtcaagaaagtgttgcatccagtcatctcctgcgcactttctgcagatttggcggcagcagcgtatgggtacctctccgggtctggatttgatgctgtgctaggtgattacctcacaaaggcggcctctaatcctggagccggtgacatactgatgggtttccttgggtctgtgatcatatcatttgcattctccatattcaaacagagaaagcttgtaaagaggcacgcagcagagattttcacatcagttgccattggagctacattctctctgtactcaactgctatcatagggcgcctggttgggctagagccatcgttgaccatatccatgctgccaaggtgtattactctggcgctggctttgagcatagtatctttctttgaaggagtaaactcttcagtaactgctgtcgtggttgtccttaccgggctcctcggtgccaattttgtgctagcagcaatggagaaacttcgtctgaacgaccccatctccagaggaatagcgacagctgccagtgctcaaggactgggaacagcagcactgtcagccaaggaacccgaagcactccctttctgcgccatctcttatagtttcacgggaatctttggctcgctgatttgctcgattccagcagtcaggcaaagcttgatattcatagctggttaa

SEQ ID NO: 12638 - protein, 547 aa, Sorghum bicolor
  misc_feature: Ceres ANNOT ID no. 6104229
  misc_feature (311)..(542): Pfam Id: LrgB Pfam Desc: LrgB-like family
  misc_feature (25)..(320): NCBI GI: 115436940 NCBI Desc: os01g0511600 [oryza sativa (japonica cultivar-group)]
  misc_feature (368)..(505): NCBI GI: 126651385 NCBI Desc: ywbg [bacillus sp. b14905]
  misc_feature (305)..(537): NCBI GI: 126464795 NCBI Desc: lrgb family protein [rhodobacter sphaeroides atcc 17029]
  misc_feature (326)..(539): NCBI GI: 44983432 NCBI Desc: ael117cp [eremothecium gossypii]
  misc_feature (326)..(539): NCBI GI: 45190490 NCBI Desc: ael117cp [eremothecium gossypii]
MAATAMVAITNLGCRHDPLSSLPRATSAPARSCTLPPRRRRCRPLTPRSSCCSPPSSSVSPRRVLRPTAALKRIPAGDTSFVGPANNDATTLNHRSSSSDLRRSLIIPNSTASTGHATASSGVLPSILGVAHLAVSLGIMLAADKFLKKAFVAAGIKFPSALFGMFCVFSVLVVFDIFAPPVAKAFMNFFEPATMFIKRWLPVFYVPTLVVFPLAITEIPAASALKIFAITFGGWFATLTVAGYTVLAVRNLVKTELIPDTEPVSKPSPFSTSEIWSWTAIFVASFGVAYFNPTALGTTAKTCLPFLLAANVLGYMVGSGLPAGVKKVLHPVISCALSADLAAAAYGYLSGSGFDAVLGDYLTKAASNPGAGDILMGFLGSVIISFAFSIFKQRKLVKRHAAEIFTSVAIGATFSLYSTAIIGRLVGLEPSLTISMLPRCITLALALSIVSFFEGVNSSVTAVVVVLTGLLGANFVLAAMEKLRLNDPISRGIATAASAQGLGTAALSAKEPEALPFCAISYSFTGIFGSLICSIPAVRQSLIFIAG

SEQ ID NO: 12639 - DNA, 1629 bp, Sorghum bicolor
  misc_feature: Ceres ANNOT ID no. 6104236
  misc_feature: Encodes the peptide sequence at SEQ ID NO 12640
atggccgcgaccgccatgattaggattaccactttacgttgccgccacgacccgctctcctcccttccccgcaccacgtcggtcgcccgctcctgcacactgctcactccccattcttcttgctgctccccttcctcctccgtctctccgcgccgggtccgggtcagggtccgggtccgtccaacagcagcagcattgaagcgcatccctggcagcaacaccagcttcatgggtccaggtccagccgacaatggcgccaccacgcttcagcgatcgtcgtcgtccgaccttggccgcagcctgatcgtccccaactccactgctggcaccggagacgccagtgcttcctcaggactgctgcccattcttggggtggcgcatctgcttgtggcgctgggcattgtgtttgccaccgacaagttcctcaaacaggcattcgtcgccgcgtccatcaagttcccaagcgccctcttcggcatgttctgtgtcttctcagtgctagtcgtcttggacacattcgtgcctgctctcgccaaggcgttcatggacttctttgcgcctgccacactgttcatccagaggtggctacccttgttctacgtcccgacactagtcgtgctgccgctcgccgtcagggatgtcccagcggcttcaggactcaagatttttgcaatcacttttggtggctggtttgctacccttgcggttgcaggatatactgtgttagctgtgagaaaacttgtgaagacagagcttattacagatgcagagcctatgagcaagcagtcaccattttctacattggaaatctgggcatgggctgctatattcgttgcatcatttggtgttgcatatttcaatcccacggcacttggtaccacagcaagaacatgccttcctttcctgcttgctgctaatgtgctgggatacatggttggttctgggttaccatctggtgtcaagaaagtattacatccaatcatctgctgcgcactttctgcagatttggcagcagtagcgtatgggtacctctccgggtctggacttgatgctgtgctaggtgattacctcacaaaggcgccttctaatcctggagccggtgacgtactaatgggtttccttgggtctgtgatcatatcatttgcattctcaatgttcaaacagagaaagcttgtaaagaggcacgcagcagagattttcacatcaattgccattgcatcgacattctctctgtactcaactgctgtcatagggcgcctgattgggctagagccatcattaaccatatccatattgccaaggtgtataactgtggcgctggctttgagcatagtgtctttctttgaaggtgtaaactctacactaactgctgccgtggttgtccttaccgggctcattggagcgaattttgtgcaagcagctatggataaacttggtctgaacgaccccattgccagaggaatagggacagcttccagtgctcatggactggggacagcagcactgtcagccaaggaacctgaagcactccctttctgtgccattgcttatggtctcacgggaatttttggctcgctgatttgctcggttccggcagtgaggcaaagcttggtattcatagctggttaa

SEQ ID NO: 12640 - protein, 542 aa, Sorghum bicolor
  misc_feature: Ceres ANNOT ID no. 6104236
  misc_feature (267)..(537): Pfam Id: LrgB Pfam Desc: LrgB-like family
  misc_feature (25)..(315): NCBI GI: 115436940 NCBI Desc: os01g0511600 [oryza sativa (japonica cultivar-group)]
  misc_feature (301)..(530): NCBI GI: 83593762 NCBI Desc: lrgb-like protein [rhodospirillum rubrum atcc 11170]
  misc_feature (363)..(516): NCBI GI: 126651385 NCBI Desc: ywbg [bacillus sp. b14905]
  misc_feature (374)..(532): NCBI GI: 118063799 NCBI Desc: lrgb-like protein [roseiflexus castenholzii dsm 13941]
  misc_feature (366)..(527): NCBI GI: 145617577 NCBI Desc: lrgb family protein [geobacter bemidjiensis bem]
MAATAMIRITTLRCRHDPLSSLPRTTSVARSCTLLTPHSSCCSPSSSVSPRRVRVRVRVRPTAAALKRIPGSNTSFMGPGPADNGATTLQRSSSSDLGRSLIVPNSTAGTGDASASSGLLPILGVAHLLVALGIVFATDKFLKQAFVAASIKFPSALFGMFCVFSVLVVLDTFVPALAKAFMDFFAPATLFIQRWLPLFYVPTLVVLPLAVRDVPAASGLKIFAITFGGWFATLAVAGYTVLAVRKLVKTELITDAEPMSKQSPFSTLEIWAWAAIFVASFGVAYFNPTALGTTARTCLPFLLAANVLGYMVGSGLPSGVKKVLHPIICCALSADLAAVAYGYLSGSGLDAVLGDYLTKAPSNPGAGDVLMGFLGSVIISFAFSMFKQRKLVKRHAAEIFTSIAIASTFSLYSTAVIGRLIGLEPSLTISILPRCITVALALSIVSFFEGVNSTLTAAVVVLTGLIGANFVQAAMDKLGLNDPIARGIGTASSAHGLGTAALSAKEPEALPFCAIAYGLTGIFGSLICSVPAVRQSLVFIAG

SEQ ID NO: 12641 - DNA, 405 bp, Sorghum bicolor
  misc_feature: Ceres ANNOT ID no. 6104403
  misc_feature: Encodes the peptide sequence at SEQ ID NO 12642
atgaagagcagcagcaacgccaacgccaacgccagcaaggaggaggaggatgctcccggcggccagtcagggaagaagccgccgcactggaggcgccgggagcacgcggcgacgacggtgtacgtggtccaccccacccagttccgcaccgtggtgcagcagctcacaggcgccgcgtcaccgccgccgctgtcgtccacccatcagcatgttgctggcggcagcggcggcaatggcgctgccgctggtacaggaaccaatgcagtggctcaggctcaggctcaggctcaggctcagcgtggcgggggagagcagagcggcggcaacggcagcagccgggggcggacgctggggcagatgtaccaggactgcctggactgggccaacgccgacgaccatagctaa

SEQ ID NO: 12642 - protein, 134 aa, Sorghum bicolor
  misc_feature: Ceres ANNOT ID no. 6104403
  misc_feature (34)..(64): Pfam Id: VQ Pfam Desc: VQ motif
  misc_feature (2)..(101): NCBI GI: 116007696 NCBI Desc: charlatan cg11798-pd, isoform d [drosophila melanogaster]
  misc_feature (73)..(114): NCBI GI: 73921720 NCBI Desc: at-rich interactive domain-containing protein 1b (arid domain-containing protein 1b) (osa homolog 2) (hosa2) (p250r) (brg1-binding protein held/osa1) (brg1-associated factor 250b)
  misc_feature (73)..(114): NCBI GI: 73921720 (continued) (baf250b)
MKSSSNANANASKEEEDAPGGQSGKKPPHWRRREHAATTVYVVHPTQFRTVVQQLTGAASPPPLSSTHQHVAGGSGGNGAAAGTGTNAVAQAQAQAQAQRGGGEQSGGNGSSRGRTLGQMYQDCLDWANADDHS

SEQ ID NO: 12643 - DNA, 1359 bp, Sorghum bicolor
  misc_feature: Ceres ANNOT ID no. 6105481
  misc_feature: Encodes the peptide sequence at SEQ ID NO 12644
atgggcgccggcgcccaggaggatgaggaggagacaaccatggtggcggagggaggagtcagagaggaggagcaagcggcggcggagggcgcaggagaggaggagcagttggggcagggtggagggggtgagggagagggcgagggcgaaggcgagggcgggtgcggggaggagaaagctgcggcggtgatgtcgtgctcgatctgcctcgatacggtggtcgccggcggcgaggagaggtccaccgcgaggctgcagtgcggtcacgaatttcacctcgcatttaatgccaaaggaattatgcaatgccccaattgtcgcacaattgagaatgggaattggctttatgcaaatggttcccgatcatcacaggatgtaaacaatgatgaatggggttatgatgacctttatgatcatggtcactcagagctggcaacctttgtgcctcttcgcattcagtggtgtcctattgggcgcttagaacttccatccttatttgaagaagtagagtcctcagctccagctacttttaatgatttcacggggcaattcaactctgagcccatggcaccagtacctgccacacctcatcctggtccatatctagcttattttcagcctgccccgccaccggcatcatcaagcacccatgtcgctgagagaacaatggatggtgctgcatatcatgatcactggaacactatggctgggctatcagatgtcagacgaccctgggcgtactattctcaacccaacaatgataatggtatagctgagcagcaaggactccctctgggggcaatgagagttggaggggttgatagtgaaagccaacaacgaggatctctcccctcattttatggaaatgggtctggaagaccaaggatcccaagtgttcctccaatggcaccacaattcataagagcgcatggaaacttaattgatcaattccagcagacttcttctagtttgtttgctgggtcacagcaatcaggaggcatgcgtccattgggagctgttgggccttctgtgccacctccggagaacacctccttttgcctgttcccaccagcttcatcaggccccagtacgatggaggccgaggatgtcagagcaaaccagttctacgcctgggagagggattgcttggctccttacccgctgatgcctgttaataatgaaggtacctggtggagctcttcacaacaacagccccctcaaggtgcaccagagcctgctgcatctgctccaaggaggctgtctgggcagtggattggtggcgttggcaggttgccaccatcagagaatagatcgccagatgactcgcccttccgtccattgcacatccctcggatgtag

SEQ ID NO: 12644 - protein, 452 aa, Sorghum bicolor
  misc_feature: Ceres ANNOT ID no. 6105481
  misc_feature (16)..(290): NCBI GI: 115436448 NCBI Desc: os01g0350900 [oryza sativa (japonica cultivar-group)]
  misc_feature (177)..(452): NCBI GI: 115462167 NCBI Desc: os05g0154600 [oryza sativa (japonica cultivar-group)]
  misc_feature (186)..(452): NCBI GI: 6996144 NCBI Desc: vip2 protein [avena fatua]
  misc_feature (50)..(233): NCBI GI: 144923772 NCBI Desc: zinc finger, ring-type [medicago truncatula]
  misc_feature (37)..(362): NCBI GI: 92871674 NCBI Desc: zinc finger, ring-type; zinc finger, phd-type [medicago truncatula]
MGAGAQEDEEETTMVAEGGVREEEQAAAEGAGEEEQLGQGGGGEGEGEGEGEGGCGEEKAAAVMSCSICLDTVVAGGEERSTARLQCGHEFHLAFNAKGIMQCPNCRTIENGNWLYANGSRSSQDVNNDEWGYDDLYDHGHSELATFVPLRIQWCPIGRLELPSLFEEVESSAPATFNDFTGQFNSEPMAPVPATPHPGPYLAYFQPAPPPASSSTHVAERTMDGAAYHDHWNTMAGLSDVRRPWAYYSQPNNDNGIAEQQGLPLGAMRVGGVDSESQQRGSLPSFYGNGSGRPRIPSVPPMAPQFIRAHGNLIDQFQQTSSSLFAGSQQSGGMRPLGAVGPSVPPPENTSFCLFPPASSGPSTMEAEDVRANQFYAWERDCLAPYPLMPVNNEGTWWSSSQQQPPQGAPEPAASAPRRLSGQWIGGVGRLPPSENRSPDDSPFRPLHIPRM

SEQ ID NO: 12645 - DNA, 873 bp, Sorghum bicolor
  misc_feature: Ceres ANNOT ID no. 6105955
  misc_feature: Encodes the peptide sequence at SEQ ID NO 12646
atggcgtaccgtgtcctggaggtcacccttgtctcggcaaatgacctcaagaaactgtcggtcttctcccggccgcgcatctacgccgtggcttccatttccgggctcgacctccgcatgcctagccacagcacccaggcagaccagaccaacggttgcaaccccgcctggaacgccgtggcacacttccccatcccggctgccattgacacccgcggcctcgcgctccacgtgaggctctgcgcccagcgtgtgtacctgggcgaccgcgacatcggcgaggtgttcgtgcccatcgacgacctcctggccggcgccgacaagggaggtgatccgaggcccgtgagctaccaggtgcgcaggccgcactctggccgcgcccacggcgtcctctacttctgctataagttcaccgacgtccccgccgtggcgtgtgtcccggaaccggaaggcaaacaaggccagtacgccaagtacgtgctggactccgtgaacacgacggacaagacgatggtgccgcccaccgcgtacccaccgtcggccatgccgtctacgtacccaccgccggccatgtcgcctgcgtaccctccgccgcaatatggctcgccgtacccggcctacccgccgcagccttacgcgtacgctgctccgccaccgtacgggtacaatgcggctaccccacaaccggcgatgtacggctacgccgcgcagccggtggctgcacccgcgagccatggcggaggcatggggatggggcttggcctagggctcctaggcggtgctgtcggagggatgatgcttggagaggcgatcggtgactatgaggccgacgccgcctatgatgcagggttcaacgatgcgttggcattttag

SEQ ID NO: 12646 - protein, 290 aa, Sorghum bicolor
  misc_feature: Ceres ANNOT ID no. 6105955
  misc_feature (6)..(96): Pfam Id: C2 Pfam Desc: C2 domain
  misc_feature (1)..(290): NCBI GI: 115436586 NCBI Desc: os01g0369500 [oryza sativa (japonica cultivar-group)]
  misc_feature (1)..(290): NCBI GI: 2055230 NCBI Desc: src2 [glycine max]
  misc_feature (1)..(246): NCBI GI: 15408785 NCBI Desc: p0492g09.1 [oryza sativa (japonica cultivar-group)]
  misc_feature (2)..(246): NCBI GI: 102139812 NCBI Desc: c2 domain-containing protein / xyppx domain-containing protein [musa acuminata]
  misc_feature (1)..(288): NCBI GI: 93115321 NCBI Desc: src2-like protein [nicotiana benthamiana]
MAYRVLEVTLVSANDLKKLSVFSRPRIYAVASISGLDLRMPSHSTQADQTNGCNPAWNAVAHFPIPAAIDTRGLALHVRLCAQRVYLGDRDIGEVFVPIDDLLAGADKGGDPRPVSYQVRRPHSGRAHGVLYFCYKFTDVPAVACVPEPEGKQGQYAKYVLDSVNTTDKTMVPPTAYPPSAMPSTYPPPAMSPAYPPPQYGSPYPAYPPQPYAYAAPPPYGYNAATPQPAMYGYAAQPVAAPASHGGGMGMGLGLGLLGGAVGGMMLGEAIGDYEADAAYDAGFNDALAF

SEQ ID NO: 12647 - DNA, 621 bp, Sorghum bicolor
  misc_feature: Ceres ANNOT ID no. 6106039
  misc_feature: Encodes the peptide sequence at SEQ ID NO 12648
atggcttccagcaagctctttgcgattggcctcgtcgtcttactaagcattggactgtgcaatgctattagggtggtaaatcacgccactgcagatggccaaggcggtggaggtggtggagctaacgggagtggaaccagctctggctctggctctggctccggcttcggcaatgctgaggcctatgacggcagtgcccagtccccgagctctggccactcgtatggcagtggatccggtgaaggtggtggcgattggcgaggtgaggaccagtacgcgtctggttatggagtgggtggtgcatctggtgaaggccatggtgactcaggtaactccaacactaatggggatgcaaatgcgaatggagctggtggcgggggcggctctggtggaagcaacgggaatggtaatggatttggtggtggcaagggagtcggggaaggtgaaggcgataactatggtgcctatggctcgagctttgcaaatagcggtggcgatggaggtgggagcggaggcggtcgtaatggtgggttcggcagtggttctggtggcgggtcagggaggagtggtggttccacatcaggttataatgatggcagctacaacggatcaacaccttaa

SEQ ID NO: 12648 - protein, 206 aa, Sorghum bicolor
  misc_feature: Ceres ANNOT ID no. 6106039
  misc_feature (4)..(195): NCBI GI: 15887008 NCBI Desc: glycine rich protein [oryza sativa]
  misc_feature (1)..(197): NCBI GI: 94730387 NCBI Desc: glycine-rich cell wall structural protein 2 precursor
  misc_feature (1)..(192): NCBI GI: 20245 NCBI Desc: glycine-rich protein [oryza sativa]
  misc_feature (1)..(196): NCBI GI: 4755087 NCBI Desc: aluminum-induced protein; al-induced protein [zea mays]
  misc_feature (1)..(187): NCBI GI: 4115615 NCBI Desc: root cap-specific glycine-rich protein [zea mays]
MASSKLFAIGLVVLLSIGLCNAIRVVNHATADGQGGGGGGANGSGTSSGSGSGSGFGNAEAYDGSAQSPSSGHSYGSGSGEGGGDWRGEDQYASGYGVGGASGEGHGDSGNSNTNGDANANGAGGGGGSGGSNGNGNGFGGGKGVGEGEGDNYGAYGSSFANSGGDGGGSGGGRNGGFGSGSGGGSGRSGGSTSGYNDGSYNGSTP

SEQ ID NO: 12649 - DNA, 621 bp, Sorghum bicolor
  misc_feature: Ceres ANNOT ID no. 6106056
  misc_feature: Encodes the peptide sequence at SEQ ID NO 12650
atggcttccatcaagctctttgcaattggcctcgtcgttttactaagcattggactgtgcaatgctattagggtggtaaatcatgccactgcagatggccaaggtggtggaggtggtgtagctggcgggagcggaaccagctatggctctagctatggctccggcttcggcaattctgaggcctacgatggcagtgcccagtccccgagctctggccacgcatatggcagtggatctggtggaggtggtggcgattggcaaggtgaggacgagtgcgcgtctggttatggagcaggtggtgcatctggtgaaggccatggtgactcaggtaactccaacaccaatggggctgcaaatgcaaatggagttggcggcgggggtggctccggtggaagcaacgggaacggtagtggatctggtggtggcaacggagtcggggaaggtgaaggcgataactatggtgcctatggctcgagttttgcaaatagcggtggcgacggaggtgggagcggaggcggtcgtaatggtgggttcggcagtggttccggtggcggatctgggaagagtggtggtgccacatcaggttataatgatggcagctacaacggatcaacaccttaa

SEQ ID NO: 12650 - protein, 206 aa, Sorghum bicolor
  misc_feature: Ceres ANNOT ID no. 6106056
  misc_feature (5)..(195): NCBI GI: 15887008 NCBI Desc: glycine rich protein [oryza sativa]
  misc_feature (1)..(197): NCBI GI: 94730387 NCBI Desc: glycine-rich cell wall structural protein 2 precursor
  misc_feature (1)..(191): NCBI GI: 20245 NCBI Desc: glycine-rich protein [oryza sativa]
  misc_feature (1)..(196): NCBI GI: 4755087 NCBI Desc: aluminum-induced protein; al-induced protein [zea mays]
  misc_feature (1)..(203): NCBI GI: 92869574 NCBI Desc: eggshell protein [medicago truncatula]
MASIKLFAIGLVVLLSIGLCNAIRVVNHATADGQGGGGGVAGGSGTSYGSSYGSGFGNSEAYDGSAQSPSSGHAYGSGSGGGGGDWQGEDECASGYGAGGASGEGHGDSGNSNTNGAANANGVGGGGGSGGSNGNGSGSGGGNGVGEGEGDNYGAYGSSFANSGGDGGGSGGGRNGGFGSGSGGGSGKSGGATSGYNDGSYNGSTP

SEQ ID NO: 12651 - DNA, 618 bp, Sorghum bicolor
  misc_feature: Ceres ANNOT ID no. 6106090
  misc_feature: Encodes the peptide sequence at SEQ ID NO 12652
atggctacttgtaagctcttagctgttggtctcactgtcctgctatgctttgtattaaccaatgctattagggtggtaaaccacgccgccacagctgatgggcaaggcagcggcggtggtggaggtgggggaacggaaactgcctatggctctggttacggctctggctctggcactagctcttccttcagcggttcctatgacagcgatacatctgctgctgctagtgcaagtggtgatggctctggcagtggcagctgggaaggttatgaccaatccgcgaaagggtatggagcaggaggtgcgtctggctcaggccatggcgattcgggtgggttttacggtgatggggcttccaatgcaaatggaagtggtggtggcagtggctctggaggaagtttcggcaatggtgaagggagtggtgcaggctcaggaagtgggcaaggttcaggctattacggcggaccagatggttcaagcaacgcaaacagcggtggcggtggaggtgggagcggtggtggccacggtggtgggtttggccgtggttccggtggtggatcaggtaccagtaatagctctcactgggacaacggttattatgacactccacagccttaa

SEQ ID NO: 12652 - protein, 205 aa, Sorghum bicolor
  misc_feature: Ceres ANNOT ID no. 6106090
  misc_feature (5)..(194): NCBI GI: 15887008 NCBI Desc: glycine rich protein [oryza sativa]
  misc_feature (1)..(192): NCBI GI: 4115615 NCBI Desc: root cap-specific glycine-rich protein [zea mays]
  misc_feature (29)..(199): NCBI GI: 47007952 NCBI Desc: major ampullate spidroin 2-2 [kukulcania hibernalis]
  misc_feature (5)..(191): NCBI GI: 4755087 NCBI Desc: aluminum-induced protein; al-induced protein [zea mays]
  misc_feature (1)..(188): NCBI GI: 94730387 NCBI Desc: glycine-rich cell wall structural protein 2 precursor
MATCKLLAVGLTVLLCFVLTNAIRVVNHAATADGQGSGGGGGGGTETAYGSGYGSGSGTSSSFSGSYDSDTSAAASASGDGSGSGSWEGYDQSAKGYGAGGASGSGHGDSGGFYGDGASNANGSGGGSGSGGSFGNGEGSGAGSGSGQGSGYYGGPDGSSNANSGGGGGGSGGGHGGGFGRGSGGGSGTSNSSHWDNGYYDTPQP

SEQ ID NO: 12653 - DNA, 1464 bp, Sorghum bicolor
  misc_feature: Ceres ANNOT ID no. 6106537
  misc_feature: Encodes the peptide sequence at SEQ ID NO 12654
atgaggaagaattgggggctcagctccgggcacgcgcggccgttcggtgaccgccggtggctgctccccttcctcgccagtctgctcgtgacggccacgctcctactcgccgccgcgtgcggcctcttctcgccgccctacccgagcggcgccggcgacgcggccctgttcgacgtcgtctccctcgccgactgggacgacggcggcggctcgtcgtcgggccgcgacggcgcgccctccgtcgaggcgggaatcaagaaccggctgctggaaggtaacgccgccagcgacagcgacgacgacgacgacgacgagaaccccgatgatgctgcagtcaactctgacgactccgacgccgagccgccgcggatcgcgtacctcctcgagggcaccaagggcgacggcctgcggatgcggcggacgttgcaggccatctaccacccgcgcaaccagtacatcctgcacctcgacctggaggcgccgccgcgggagcggatcgatctggctatgtatgtcaagggcgaccccatgttcagccaggtcggaaatgtgcgggtcatcgccaagggaaaccttgtcacctacaaggggccgaccatggtcgcctgcacgcttcacgctgtagccattcttctcaaggaggggctccagtgggactggttcatcaatctcagcgcgtcggattatccgctcatgacacaagatgatatacttcatgtcttctcttctttgccaagaaatcttaattttatagagcactttcggttatctgggtggaaagttaatataagggcgaaaccaattgttctggacccagggctttatctgtcaaagaaatttgatcttactatgactactgagcggagagaattgccaacatctttcaaattatatactggttctgcttggataatgctcacaaaatccttccttgagtactgtatatggggttgggataatctcccacgaaacctgctgatgtactatgtcaacttcatctcctcaccagaaggctatttccaaactgttatctgcaactctgatgattttcggggcacggcagttggtcatgaccttcactacatcgcttgggactaccctccaaagcagcatccattgatcctctccatgaaggacttcaacaagatggtcaagagcggcgcgccatttgcacggaagtttcccaaggatgacaaggtcctggacaagatagaccgcgagcttttgcaccgctcagagggccggttcaccccgggagcatggtgtgatgggagctctgaaggaggggctgatccatgtttgtctaggggtgaagactctgttttcgagcctggtcctggtgctgaaaggctgcgaggcctgatgaagaaggtgctctcatgggattaccgcaatggtagctgttcctcacttgcttatgatcagacaaagagggattggtatgttcctaaaagtaaaggatag

SEQ ID NO: 12654 - protein, 487 aa, Sorghum bicolor
  misc_feature: Ceres ANNOT ID no. 6106537
  misc_feature (124)..(349): Pfam Id: Branch Pfam Desc: Core-2/I-Branching enzyme
  misc_feature (51)..(487): NCBI GI: 45736153 NCBI Desc: n-acetylglucosaminyltransferase-like protein [oryza sativa (japonica cultivar-group)]
  misc_feature (112)..(469): NCBI GI: 145323728 NCBI Desc: glycosyltransferase family 14 protein / core-2/i-branching enzyme family protein [arabidopsis thaliana]
  misc_feature (122)..(468): NCBI GI: 102139993 NCBI Desc: glycosyl transferase family 14 protein [musa acuminata]
  misc_feature (114)..(460): NCBI GI: 77556820 NCBI Desc: glycosylation enzyme-like protein [oryza sativa (japonica cultivar-group)]
  misc_feature (122)..(460): NCBI GI: 20856992 NCBI Desc: at3g15350/k7l4_15 [arabidopsis thaliana]
  misc_feature: Useful for making plants with altered carbohydrate content
  misc_feature: Functional homolog of the protein sequence given in SEQ ID NO 13727
MRKNWGLSSGHARPFGDRRWLLPFLASLLVTATLLLAAACGLFSPPYPSGAGDAALFDVVSLADWDDGGGSSSGRDGAPSVEAGIKNRLLEGNAASDSDDDDDDENPDDAAVNSDDSDAEPPRIAYLLEGTKGDGLRMRRTLQAIYHPRNQYILHLDLEAPPRERIDLAMYVKGDPMFSQVGNVRVIAKGNLVTYKGPTMVACTLHAVAILLKEGLQWDWFINLSASDYPLMTQDDILHVFSSLPRNLNFIEHFRLSGWKVNIRAKPIVLDPGLYLSKKFDLTMTTERRELPTSFKLYTGSAWIMLTKSFLEYCIWGWDNLPRNLLMYYVNFISSPEGYFQTVICNSDDFRGTAVGHDLHYIAWDYPPKQHPLILSMKDFNKMVKSGAPFARKFPKDDKVLDKIDRELLHRSEGRFTPGAWCDGSSEGGADPCLSRGEDSVFEPGPGAERLRGLMKKVLSWDYRNGSCSSLAYDQTKRDWYVPKSKG

SEQ ID NO: 12655 - DNA, 1131 bp, Sorghum bicolor
  misc_feature: Ceres ANNOT ID no. 6106579
  misc_feature: Encodes the peptide sequence at SEQ ID NO 12656
atggcggtggcggaggtgaggtacgggatagtcggggtggggatgatggggcgggagcacctccacaacctcgcccacctcgccgccgaggtcgagcgggagcaggccgtccgggtgcgggtcaccggcctcgccgacccacaccaggagtcgctccgcctcggcctccagctcgccgccgagctcggcctcccggctccccagaccttttcaggtcaccgcgagctgcttgacagcgggctctgtgacgccatcatcgtatcgtccccaaacatgacccactatgagatactcatggacatcatccgccaccgcgaaccgcaccacatccttgtcgagaagccgctgtgcaccactgtgcaggactgcaagaaggttatcgaagctgcaaaacagagaccagaaatacttgtgcaagttggtttagaatacaggtatatgccaccagttgctaagctgatagacatagttaagagtggtacactaggacaagtcagaatggtggcaatacgagaacaccggtttcctttccttgttaaggtgaacaactggaatagattcaattgtaacagtgggggaactctagtagagaagtgttgccacttctttgatttgatgagactgtttgcggctgcaaatccagttcgtgtgatggcttctggagccattgatgttaaccataagaatgaagtgtatgatggaaaggtaccagatattattgataatgcatatgtgatagtggaatttgataatggctctcgtggcatgcttgatctctgcatgtttgctgaaggaagtaggaacgagcaagaaatttctgtggttggtgacattgggaagggtgaaacttttgttccagagagcattgtcaggtttggaaagagaacagaaggcagagatggagttgtaacaataatggcggaagatgaacggatcaagtatcaaggtctccatcatggatccagctatttggagcacctcaatttcttgtctgctataagggctcaaggtgcatctggaccatctgtcaacttaagtgacggcctactatctgttgccattggtgtggctgggcaattatcaatcgagcagggccggttcgtaaccatggaagaggtcttaggtttgtag

SEQ ID NO: 12656 - protein, 376 aa, Sorghum bicolor
  misc_feature: Ceres ANNOT ID no. 6106579
  misc_feature (6)..(142): Pfam Id: GFO_IDH_MocA Pfam Desc: Oxidoreductase family, NAD-binding Rossmann fold
  misc_feature (154)..(264): Pfam Id: GFO_IDH_MocA_C Pfam Desc: Oxidoreductase family, C-terminal alpha/beta domain
  misc_feature (70)..(372): NCBI GI: 50726295 NCBI Desc: organic cation transporter-like protein [oryza sativa (japonica cultivar-group)]
  misc_feature (4)..(373): NCBI GI: 89257649 NCBI Desc: oxidoreductase family protein [brassica oleracea]
  misc_feature (7)..(374): NCBI GI: 53828611 NCBI Desc: at4g17370 [arabidopsis thaliana]
  misc_feature (7)..(374): NCBI GI: 7268489 NCBI Desc: inositol 2-dehydrogenase like protein [arabidopsis thaliana]
  misc_feature (8)..(371): NCBI GI: 85373570 NCBI Desc: myo-inositol-2-dehydrogenase [erythrobacter litoralis htcc2594]
MAVAEVRYGIVGVGMMGREHLHNLAHLAAEVEREQAVRVRVTGLADPHQESLRLGLQLAAELGLPAPQTFSGHRELLDSGLCDAIIVSSPNMTHYEILMDIIRHREPHHILVEKPLCTTVQDCKKVIEAAKQRPEILVQVGLEYRYMPPVAKLIDIVKSGTLGQVRMVAIREHRFPFLVKVNNWNRFNCNSGGTLVEKCCHFFDLMRLFAAANPVRVMASGAIDVNHKNEVYDGKVPDIIDNAYVIVEFDNGSRGMLDLCMFAEGSRNEQEISVVGDIGKGETFVPESIVRFGKRTEGRDGVVTIMAEDERIKYQGLHHGSSYLEHLNFLSAIRAQGASGPSVNLSDGLLSVAIGVAGQLSIEQGRFVTMEEVLGL

SEQ ID NO: 12657 - DNA, 1878 bp, Sorghum bicolor
  misc_feature: Ceres ANNOT ID no. 6106649
  misc_feature: Encodes the peptide sequence at SEQ ID NO 12658
atgctactatgctgctgtccttttccccaccaaatcgagacctgtgctccgcgctcgccgtttcacccgagctgcttgccgcggagctcgctcagctccggggagcaggggaggagcaaaaagagcaagttccaccgcgtcagggcgcaggttttcaagtccaagaaccagtctttgcgctcccaatcccaccgggatgatggccacggggaccctacggataaaatcccgagaaaggatttgccttgttccgcggcgccgtcgctgccggacgccggggcggtcgcgctctggctgcgttactgccggagcgcgctcgacgtccggagaacgcacgcggttgccctgcggtcgctcggcagcctggggatgttcgtgtccaacaatttgatcagcgcttacgtgcggttcgacgaggctgctaatgcgaggaaggtgttcgacgaaatgcgcgagaggagcgtcgtgtcgtggacggctatgatgaatgggtatcagaagcttggccgccacggtgaggttgtgaggcttttgatggatatgctggccactggcatcgaaggtaacagcttgacttttgtttgcctgttgaaatcctgtggggagcgatgtgatgccaagttggggcaacaggtccactgttgcgttgtgaagggtggctggagcaatgtgatagtggacagcgctgtcgcacacttctatgctcaatgcggtgatgttgccgctgcttcaactgtgtttgataggatggcttcccgcgatgttgtctcatggacaacgatgatcacggcttatgtgcagcatgggcatggtgacaaagctcttcagatgtttccaaaaatggtgtctgagggatttcgccccaatgagttcactgtttgcagcgccctcaaggcttgcgcagaggagaaggctctaagatttgggaagcagttgcatggtgcgattgtgaaaaggctgtacaaatatgatatccatgtcgggagtgcacttgtcactatgtatgccagatgtggtgaggtatttgatgctcaggcagtgtttgataagatgccaagaagaaacactattacatggacttcaatgatctctggatacgctcaaagtgggtgtggtgaagaagctgtcttgttgttccgaaagatgaagatgcgcagagtatttgtcaaccatcttactgttgttggcctccttagtgcttgtggctctatgcagtcaatttatcttggaaaagaacttcatgcacagataataaagaactgtatggaacagaatcttcagattgggagtacgcttgtttggttttattccagatgtggggagcatacgtatgctgcaagaattctagaagcgatgcctgaccgtgatgctgtcgcatggacagctatgatttcaggctataacaatcttggccataatgttgaagcacttaaatcattagatgagatgttatgggatggcgtggcaccaaatacttacacttattcctcagctttgaaagcttgtgccagattggaggctcttcgagatggaaggaggatccatggtgttgttaacaagacccaagctttctcaaatgtctttgtgggatgctcactgattgatatgtacatgcggtgtgggaaagtcgatgaagctcgaagagtcttcgatgccatgccagagcacaacttagtgacatggaaagtgatgattacaggatttactcagaattgcctctgtgaagaggctttaaaatacatgtacctaatgcagcaagatgggtatgatgttgatgactttgtgctttcgacggttttgtcttcatgtggaggtcatcagttgaaatcagactgcatcctcaataacctgtccactttcagtgaagttttagactag

SEQ ID NO: 12658 - protein, 625 aa, Sorghum bicolor
  misc_feature: Ceres ANNOT ID no. 6106649
  misc_feature (156)..(190): Pfam Id: PPR Pfam Desc: PPR repeat
  misc_feature (256)..(290): Pfam Id: PPR Pfam Desc: PPR repeat
  misc_feature (357)..(391): Pfam Id: PPR Pfam Desc: PPR repeat
  misc_feature (458)..(492): Pfam Id: PPR Pfam Desc: PPR repeat
  misc_feature (559)..(593): Pfam Id: PPR Pfam Desc: PPR repeat
  misc_feature (90)..(603): NCBI GI: 54695180 NCBI Desc: ppr986-12 [physcomitrella patens]
  misc_feature (109)..(603): NCBI GI: 140039544 NCBI Desc: tetratricopeptide-like helical [medicago truncatula]
  misc_feature (126)..(623): NCBI GI: 78183583 NCBI Desc: ppr1106-17 [physcomitrella patens]
  misc_feature (56)..(603): NCBI GI: 38347057 NCBI Desc: osjnba0060p14.4 [oryza sativa (japonica cultivar-group)]
  misc_feature (69)..(603): NCBI GI: 92876242 NCBI Desc: tetratricopeptide-like helical [medicago truncatula]
MLLCCCPFPHQIETCAPRSPFHPSCLPRSSLSSGEQGRSKKSKFHRVRAQVFKSKNQSLRSQSHRDDGHGDPTDKIPRKDLPCSAAPSLPDAGAVALWLRYCRSALDVRRTHAVALRSLGSLGMFVSNNLISAYVRFDEAANARKVFDEMRERSVVSWTAMMNGYQKLGRHGEVVRLLMDMLATGIEGNSLTFVCLLKSCGERCDAKLGQQVHCCVVKGGWSNVIVDSAVAHFYAQCGDVAAASTVFDRMASRDVVSWTTMITAYVQHGHGDKALQMFPKMVSEGFRPNEFTVCSALKACAEEKALRFGKQLHGAIVKRLYKYDIHVGSALVTMYARCGEVFDAQAVFDKMPRRNTITWTSMISGYAQSGCGEEAVLLFRKMKMRRVFVNHLTVVGLLSACGSMQSIYLGKELHAQIIKNCMEQNLQIGSTLVWFYSRCGEHTYAARILEAMPDRDAVAWTAMISGYNNLGHNVEALKSLDEMLWDGVAPNTYTYSSALKACARLEALRDGRRIHGVVNKTQAFSNVFVGCSLIDMYMRCGKVDEARRVFDAMPEHNLVTWKVMITGFTQNCLCEEALKYMYLMQQDGYDVDDFVLSTVLSSCGGHQLKSDCILNNLSTFSEVLD

SEQ ID NO: 12659 - DNA, 576 bp, Sorghum bicolor
  misc_feature: Ceres ANNOT ID no. 6106831
  misc_feature: Encodes the peptide sequence at SEQ ID NO 12660
atggcatcacaaacaaccaaaatgcttgccctggttgctgcgctccttgctctctctacgattgctactgccacagccaattgcctacaaaacatcccacatgtgatgggaatgacagtgatggatccatgcatgcagtcatgcatgatgcaacaaccattagccatggtaatgatgggaatgacagcgatggatccatgcatgcaatcatgcatgatgcaacaaccattagccatggtaataagttcaccctccctgatgatgagaatgaattccatggtctcgtgcgtgcaatcttgcatgacacaacaggcattctccataggaggctcatcattgtcaaaaatggtgatgcagccacaaccattctccatgatgcaacaacagtgctgcatgcaaccaatgatgatgcagggtctgatgtcaccaccgtgccactgtggtgctatgtgccagctgatgatgcacttgcaacagatgcaaatgacgctacaactgccttccatgtatagcactacagccatgccaactctagtggcctatggccaaaagccctttccttgttgtgcattctag

SEQ ID NO: 12660 - protein, 191 aa, Sorghum bicolor
  misc_feature: Ceres ANNOT ID no. 6106831
  misc_feature (58)..(191): NCBI GI: 511870 NCBI Desc: zein protein
  misc_feature (58)..(191): NCBI GI: 18087509 NCBI Desc: 11 kda methionine-rich protein [zea mays]
  misc_feature (41)..(191): NCBI GI: 15983739 NCBI Desc: modified zein precursor [zea mays]
  misc_feature (7)..(183): NCBI GI: 16305117 NCBI Desc: 18kd delta zein [zea mays]
  misc_feature (41)..(191): NCBI GI: 984525 NCBI Desc: dzs18
MASQTTKMLALVAALLALSTIATATANCLQNIPHVMGMTVMDPCMQSCMMQQPLAMVMMGMTAMDPCMQSCMMQQPLAMVISSPSLMMRMNSMVSCVQSCMTQQAFSIGGSSLSKMVMQPQPFSMMQQQCCMQPMMMQGLMSPPCHCGAMCQLMMHLQQMQMTLQLPSMYSTTAMPTLVAYGQKPFPCCAF

SEQ ID NO: 12661 - DNA, 597 bp, Sorghum bicolor
  misc_feature: Ceres ANNOT ID no. 6107657
  misc_feature: Encodes the peptide sequence at SEQ ID NO 12662
atggcgggggcgcagtcgcaggcgatgctggagaagatggagctgcggcagagctaccgcaacgtctggcacaccgacctcaccaacgccgtcgccgcggacctcccctggtgctgcctgtcgctgtggtgcggcccgtgcgtttcctacatgctgcgccgacgcgccctgtacaatgacatgtccaggtacgtgtgctgcgctgggtacatgccgtgcagcggcaagtgcggcgagagccagtgcccggaagtatgccttgcgaccgaggtgttctgctgcttcggcaactcggttgcttccacccgattcctgctgcaggacgagttcaacatccagacgacgcagtgcgacaactgcatcatcgccttcatgttcttcctgcagcagctggcctgcatctgctccctcgtcgcctgcatcgtcggcaacagcgagctctcggaggtggcgcacgtcatctcctgcatgtccaacctggtctactggacggtttgctcgtgcatgcagacgcagcacaaggtggagatggacaagagggacggcacgttgaacaccatgtctgcgcccccgatgcagcagatgtcgcgttggtaa

SEQ ID NO: 12662 - protein, 198 aa, Sorghum bicolor
  misc_feature: Ceres ANNOT ID no. 6107657
  misc_feature (23)..(147): Pfam Id: PLAC8 Pfam Desc: PLAC8 family
MAGAQSQAMLEKMELRQSYRNVWHTDLTNAVAADLPWCCLSLWCGPCVSYMLRRRALYNDMSRYVCCAGYMPCSGKCGESQCPEVCLATEVFCCFGNSVASTRFLLQDEFNIQTTQCDNCIIAFMFFLQQLACICSLVACIVGNSELSEVAHVISCMSNLVYWTVCSCMQTQHKVEMDKRDGTLNTMSAPPMQQMSRW

SEQ ID NO: 12663 - DNA, 1497 bp, Sorghum bicolor
  misc_feature: Ceres ANNOT ID no. 6107794
  misc_feature: Encodes the peptide sequence at SEQ ID NO 12664
  misc_feature: Up-regulated in root tissues in response to methyl jasmonate treatment
  misc_feature: Up-regulated in shoot tissues in response to methyl jasmonate treatment
atgcgccgcccgtggaggcacccgggcccaggggcagccgtcgcggcgcgccacggcgccgccgacctctgcctccgcgaggtcggggacctcctgccgcgacgcttcgcccgccgcgcggccggttccgaggaccttgtgatgcggcttcagattcaccggaagcttgacagacacacgggttgcgtcaacacagtgagcttcagtgaggtcggtgacatcctcgtatcggggtctgatgaccagagggtgatgctgtgggactgggacactggcaccgtcaaattagagtttcattcaggacatggtggcaatgtgttccaggcacggttcatgccctgctcagacgaccagaccattgtcacttgtgctgccgatggcgaggtgaggcttgccaagatacaggatggtggagacgtctccacaacattgcttggtgaacatgggggaagggctcacaatttggctatagagcccggtagcccttatatcctctacagctgtggtgaggatggccttgttcaacaatttgatctcagaacaaatactgcctcaaaactatttctttgcagaagctccttcattaaatcagtatcctcaactcgtatccacctaaatgcaattgcaatagatccaaggaacccaaatctttttgctgttggaggaagtaatgcatatgctcgtgtgtatgacatccgcaagtgcaagtgggatggatcatctgattttggtcacacatctaactgctattgtccaccacatctagttgacgataagagtgttgggataacagggttagcgttctctcacctgagtgagttgcttgtatcttacaatgaagagaatatttacctattccctaaaaatggagggctgggatctgaccccaaaaaatctgttaagataggagcaaatgaagggtgcaaatcaacaacgttagcatctggacatgatgtttctcaacctgcacctcaggtatatgtcggtcatcgcaactgtgaaaccgtgaagcgtgtgagtttcattgggccaaatgatgaatatgttgccagtgggtcagattgtggtcggatgtttatttggagaaagagagatgggaagtttctacgagccatggagggtgatgagtgcattgtgaattgcattgagcctcatcctcatgctatgacaattgcgagctgtggaattgataatgatgtcaaagtttggactccctctgcaattgagcgggcacctgtggtaaatgttgatgagctccagtcgagacctcgcaagagaagagccaagttctggcgctttgacttaccagatctgttgatccaacacatactggtatcagaacataggcagcgatcagctgaagaagattcatcagaggaccatgaggacaatacaggattacttaatctagtgctacgggctgcagttggaggtgtgtcatctgatgatgatggtgatgacgatgatgatgatgagacctctgatggctctgaatag

SEQ ID NO: 12664 - protein, 498 aa, Sorghum bicolor
  misc_feature: Ceres ANNOT ID no. 6107794
  misc_feature (50)..(88): Pfam Id: WD40 Pfam Desc: WD domain, G-beta repeat
  misc_feature (366)..(404): Pfam Id: WD40 Pfam Desc: WD domain, G-beta repeat
  misc_feature (21)..(490): NCBI GI: 54291610 NCBI Desc: transducin family protein-like [oryza sativa (japonica cultivar-group)]
  misc_feature (18)..(299): NCBI GI: 18420246 NCBI Desc: transducin family protein / wd-40 repeat family protein [arabidopsis thaliana]
  misc_feature (26)..(333): NCBI GI: 62898682 NCBI Desc: h326 variant [homo sapiens]
  misc_feature (26)..(333): NCBI GI: 119573116 NCBI Desc: wd repeat domain 42a, isoform cra_b [homo sapiens]
  misc_feature (26)..(333): NCBI GI: 67514230 NCBI Desc: h326 [homo sapiens]
  misc_feature: Up-regulated in root tissues in response to methyl jasmonate treatment
  misc_feature: Up-regulated in shoot tissues in response to methyl jasmonate treatment
  misc_feature: The sequence is a functional homolog of SEQ ID NO. 502 in the 11/188,298 US application
  misc_feature: The sequence is a functional homolog of SEQ ID NO. 485 in the 11/188,298 US application
MRRPWRHPGPGAAVAARHGAADLCLREVGDLLPRRFARRAAGSEDLVMRLQIHRKLDRHTGCVNTVSFSEVGDILVSGSDDQRVMLWDWDTGTVKLEFHSGHGGNVFQARFMPCSDDQTIVTCAADGEVRLAKIQDGGDVSTTLLGEHGGRAHNLAIEPGSPYILYSCGEDGLVQQFDLRTNTASKLFLCRSSFIKSVSSTRIHLNAIAIDPRNPNLFAVGGSNAYARVYDIRKCKWDGSSDFGHTSNCYCPPHLVDDKSVGITGLAFSHLSELLVSYNEENIYLFPKNGGLGSDPKKSVKIGANEGCKSTTLASGHDVSQPAPQVYVGHRNCETVKRVSFIGPNDEYVASGSDCGRMFIWRKRDGKFLRAMEGDECIVNCIEPHPHAMTIASCGIDNDVKVWTPSAIERAPVVNVDELQSRPRKRRAKFWRFDLPDLLIQHILVSEHRQRSAEEDSSEDHEDNTGLLNLVLRAAVGGVSSDDDGDDDDDDETSDGSE

SEQ ID NO: 12665 - DNA, 1545 bp, Sorghum bicolor
  misc_feature: Ceres ANNOT ID no. 6107869
  misc_feature: Encodes the peptide sequence at SEQ ID NO 12666
atggcccagttgacatctcgagctgctaccattgttatcacgaatggcaaggtgagaagagggttacagctagggactgagggagtgaaggccgaccctacgctggtgagctggctgctcccggcagcgcctgccatttgccccgcattggtgaagctcagagcccggggattctgcagccatgtctctttccgctcggtgtctcagattacttgctcgtcagagttatctggtactgatagaggtcatggcaaggagatggaggagtcagaattcagtgacgagatatatgccgagaatggcgctgaagaggacgatgagacagaggatttaatttggagcaaagaagagattgatgctatttcggcgctcttcgaccggccgatgcgccagaagcccctgaagccgccaaaccccgcgaggcagagggcgctcccattgccactgccgcacaagacgaggctgcccgtcgctcctgcgccgaagcagcacgtccgcctcgctgcaagagcggggctctcttctcgcgcttccgtcagcgaccaggtgcgcaagaacccggagttcctcctcgggatttcccgggagatcgccgtgcttcctccagagcacgatgtctccacggtgctcgaccggtgggcgaggttcctccggaaaggctccttgtcacttaccattcgtgagcttgggcacatggggctcccagagcgcgcgctgcagacattgtgctgggctcagaggcagaaagctgtgccattgttccctgacgaccgggttcttgcttcggccatcgaagttttggcacgctttgaccagctcagagtggactctgcgctggagcaatgtgtccccacggccagccgtgccgttcttgaggccatggcgagcgggttcatcagggcagggaaagtagatcgtgtgcgcaaactcctggaacttgcaaggatcaataacaggacgctgcaccccagcatctacgtgaagttgatgttggaagccacccggacacctgaaggctatgggcttgcatcggcattggtcgatgagctcggcgagagaccggacttggagctgcgtccgcaggactgcacggctgtcatgaaggtctgcataaagctccgacggtacgcagctgtcgagagcctgttcagctggttcagggagtccactggtagccccacagtggtgatgtacacgacagtgatccacagccgctgccgtgacgggaggcaccgcgaggcgctgtccctggtgtgggaaatggagcaggcaggctgcctgcttgatctgccggcctaccgagttattgtcaagttgtgcgtggcattgcaggatccagaaagggctctccgctatttgtcaaggatgaaggaggctgggttcattccaaccggcgacatgtacgacagtctgatcgagggctatttggcagatggaaggctggccaagtgccgacagctgatcaaagatgccgagtcggccggcgtgaagctggacaggaggctgctttcgcagttgtcgggaatcggaggcagacatccttag

SEQ ID NO: 12666 - protein, 514 aa, Sorghum bicolor
  misc_feature: Ceres ANNOT ID no. 6107869
  misc_feature (396)..(430): Pfam Id: PPR Pfam Desc: PPR repeat
  misc_feature (95)..(495): NCBI GI: 54695176 NCBI Desc: ppr566-6 [physcomitrella patens]
  misc_feature (223)..(506): NCBI GI: 115461420 NCBI Desc: os04g0684500 [oryza sativa (japonica cultivar-group)]
  misc_feature (177)..(499): NCBI GI: 1931651 NCBI Desc: membrane-associated salt-inducible protein isolog; 88078-84012 [arabidopsis thaliana]
  misc_feature (267)..(507): NCBI GI: 115473413 NCBI Desc: os07g0621100 [oryza sativa (japonica cultivar-group)]
  misc_feature (271)..(506): NCBI GI: 95931777 NCBI Desc: pentatricopeptide repeat protein [zea mays]
MAQLTSRAATIVITNGKVRRGLQLGTEGVKADPTLVSWLLPAAPAICPALVKLRARGFCSHVSFRSVSQITCSSELSGTDRGHGKEMEESEFSDEIYAENGAEEDDETEDLIWSKEEIDAISALFDRPMRQKPLKPPNPARQRALPLPLPHKTRLPVAPAPKQHVRLAARAGLSSRASVSDQVRKNPEFLLGISREIAVLPPEHDVSTVLDRWARFLRKGSLSLTIRELGHMGLPERALQTLCWAQRQKAVPLFPDDRVLASAIEVLARFDQLRVDSALEQCVPTASRAVLEAMASGFIRAGKVDRVRKLLELARINNRTLHPSIYVKLMLEATRTPEGYGLASALVDELGERPDLELRPQDCTAVMKVCIKLRRYAAVESLFSWFRESTGSPTVVMYTTVIHSRCRDGRHREALSLVWEMEQAGCLLDLPAYRVIVKLCVALQDPERALRYLSRMKEAGFIPTGDMYDSLIEGYLADGRLAKCRQLIKDAESAGVKLDRRLLSQLSGIGGRHP

SEQ ID NO: 12667 - DNA, 1437 bp, Sorghum bicolor
  misc_feature: Ceres ANNOT ID no. 6107891
  misc_feature: Encodes the peptide sequence at SEQ ID NO 12668
atggagaaggttttcgtcgtgctgccggcagagttcaaggcggggcagtccacgctgtcgtgggttctcgatcatttcagcggcggcagaaccacggttgtgatcacacatgtgcatgtcccgccacagatgattccagtgatgggagttaaattccactctagtaaactgagtccggagcaagtgaaactgttcagaaggatcgagtatgagaaggtggacaaacagctagatggctatgttcatcagtgctcaaaaatgaaggtcaaatgtgagaaactagtttttgagaaggaagacgatgtagctggtctgattgaactcattgtcttgcataaggtcactaagctaattatttcaggtgctgcagacaggcaatattcaagaaaaatggacaaacctaaaagtaagacagcaacagaaattatgcagagagctgatccatcatgcaagatttggtgtgtttgcaagggacaactaatctgtaccaggggtgaggaagaggagattgcaccatcagccacaccttttgtccctgattttgatcaccaagctctgcagttagtaccttaccagaaagaggacgacgttaagtcggagttggggttatacgatgagcttaaagaggcatgcatagcagctgagaacttgatgaagagagccctaaacgaatcttccaggcgccaaaaggcagatggagaagtggcctctgctcttcagaaagcaaaggaataccaggagctgtacttagaggagacgagaaagcgtgaagagcttgaaggagctcttgcgagagcacaccgagagatcgctcggttaaggcaagcaaaccaggtactacccctggatgagcaaaacaaagcaacagacgaactccaagaggcaatgtcagagagatcatccctggaaggccacatcttcaacatggatgccgttttcggaacagccgccggtcaagcaactgagcaacagcagaaggagcatgtccagatacaattcgatctcggcaccggtgaaaaggacctggaactggaactggaactcgaagcgctgctcaaccagagcaagctggccgcgttctcgccgtcgtccgtcattcagtcgccgtacgagttcgacgaagatcgcgtcccgtcctacttcctctgcccgatccttcaggaggccatgagggatccccacgtcgcggcagacgggttcacgtacgaaggcgacgccatcagaggctggctggacggcgggaacgacgcgtcccccgtgaccgggcagccgctcgcgcaccgggagctggcacccaatctcgcgcttgctgccgtgatccaagattacacggtgatgatgatgaagaagcggcggcagtaccgattcggcgattcgcatgacaacaccgttgctgcacttcagtttctttcctctcctgtgggcagtgagcggtga

SEQ ID NO: 12668 - protein, 478 aa, Sorghum bicolor
  misc_feature: Ceres ANNOT ID no. 6107891
  misc_feature (376)..(453): Pfam Id: U-box Pfam Desc: U-box domain
  misc_feature (2)..(178): NCBI GI: 87240964 NCBI Desc: protein kinase; u box [medicago truncatula]
  misc_feature (2)..(238): NCBI GI: 30690163 NCBI Desc: protein kinase family protein / u-box domain-containing protein [arabidopsis thaliana]
  misc_feature (57)..(163): NCBI GI: 115447781 NCBI Desc: os02g0665800 [oryza sativa (japonica cultivar-group)]
  misc_feature (2)..(158): NCBI GI: 115449837 NCBI Desc: os02g0822900 [oryza sativa (japonica cultivar-group)]
  misc_feature (307)..(443): NCBI GI: 115483266 NCBI Desc: os10g0548300 [oryza sativa (japonica cultivar-group)]
  misc_feature: The sequence is a functional homolog of SEQ ID NO. 308 in the 11/188,298 US application
  misc_feature: The sequence is a functional homolog of SEQ ID NO. 309 in the 11/188,298 US application
  misc_feature: The sequence is a functional homolog of SEQ ID NO. 528 in the 11/188,298 US application
MEKVFVVLPAEFKAGQSTLSWVLDHFSGGRTTVVITHVHVPPQMIPVMGVKFHSSKLSPEQVKLFRRIEYEKVDKQLDGYVHQCSKMKVKCEKLVFEKEDDVAGLIELIVLHKVTKLIISGAADRQYSRKMDKPKSKTATEIMQRADPSCKIWCVCKGQLICTRGEEEEIAPSATPFVPDFDHQALQLVPYQKEDDVKSELGLYDELKEACIAAENLMKRALNESSRRQKADGEVASALQKAKEYQELYLEETRKREELEGALARAHREIARLRQANQVLPLDEQNKATDELQEAMSERSSLEGHIFNMDAVFGTAAGQATEQQQKEHVQIQFDLGTGEKDLELELELEALLNQSKLAAFSPSSVIQSPYEFDEDRVPSYFLCPILQEAMRDPHVAADGFTYEGDAIRGWLDGGNDASPVTGQPLAHRELAPNLALAAVIQDYTVMMMKKRRQYRFGDSHDNTVAALQFLSSPVGSER

SEQ ID NO: 12669 - DNA, 1149 bp, Sorghum bicolor
  misc_feature: Ceres ANNOT ID no. 6107929
  misc_feature: Encodes the peptide sequence at SEQ ID NO 12670
atggatttgaagacaggcctcaattcacctgttattgctgaccatctccctacgttagcatcacctgctgctgtcatgactttcacaacacctactagctttccctctccggggctttgcttgaacactacaaagaagatacctctacctggtaagattgaagaagttcgtgctactggatggcttgacctcatgaaggcctcatcacctacccgcaaaaggcagaccaaggatgccatctgtgatactcaatctgatgatcttgatttgcaataccgcaactggacggtgaactatccttctgctttgacctcatttgaggaaattagtgatcttgctgggaataaaagattggcattgtttcttgattatgatggaacactttcaccgattgtggacaatcctgaaaatgcattaatgtctgatgagatgcgtgctgcagtgaggcatgtggcatcacttttcccaactgcaatcattagcggaaggtctcgtgataaggtttttgactttgtcaacctaaatgaactatactacgctggaagccatggaatggacataatgggccctgttaggaagactactgactccaatggcgtggaatgtattcggtcaactgatgcgcatggtaaagaagtcaatctgttccaacctgctagtgagtttttacctatgatcactgaggtgtatgaaaaacttggtgagagtgttaaggacattgatggtgcaaggatggaagacaacaagttctgtgtgtctgtgcattaccgtaatgtggcggaagatgactataaaaaggttttccatcgtgtaagtgctgttttggaagattacccttgcctaagactaacccatgggagaaaggtttttgaggtccgtcctgttattgattggaacaaaggtaaagctgtggagtttttactcgaatcacttgggctcaacgagagtgaagatgttctccctatctatgttggagatgacagaacagatgaagatgcattcaaagttctgaaggcaagcaaccgtggctttggaatattggtgtcatctatacccaaagagagtgacgccttctattccttgagggatccagctgaggtgatggaatttctgagaatgttggcagcatggaaggagcagtccacctga

SEQ ID NO: 12670 - protein, 382 aa, Sorghum bicolor
  misc_feature: Ceres ANNOT ID no. 6107929
  misc_feature (121)..(365): Pfam Id: Trehalose_PPase Pfam Desc: Trehalose-phosphatase
  misc_feature (1)..(381): NCBI GI: 51458330 NCBI Desc: trehalose-phosphate phosphatase [nicotiana tabacum]
  misc_feature (1)..(380): NCBI GI: 144924741 NCBI Desc: trehalose-phosphatase [medicago truncatula]
  misc_feature (1)..(378): NCBI GI: 30725608 NCBI Desc: at5g51460 [arabidopsis thaliana]
  misc_feature (1)..(378): NCBI GI: 9758188 NCBI Desc: trehalose-6-phosphate phosphatase [arabidopsis thaliana]
  misc_feature (1)..(381): NCBI GI: 45544517 NCBI Desc: trehalose-6-phosphate phosphatase [oryza sativa (japonica cultivar-group)]
  misc_feature: The plant flowers significantly late compared to wild-type.
  misc_feature: Useful for making plants with modulated drought sensitivity
  misc_feature: Useful for making plants with modulated flowering time
  misc_feature: Functional homolog of the protein sequence given in SEQ ID NO 13348
  misc_feature: Useful for making plants with modulated drought sensitivity
  misc_feature: Useful for making plants with modulated flowering time
  misc_feature: Useful for making plants with modulated water use efficiency
  misc_feature: Functional homolog of the protein sequence given in SEQ ID NO 13348
  misc_feature: The sequence is a functional homolog of SEQ ID NO 16 in US patent 7214858
  misc_feature: Useful for making plants with modulated low light sensitivity
  misc_feature: Functional homolog of the protein sequence given in SEQ ID NO 13725
MDLKTGLNSPVIADHLPTLASPAAVMTFTTPTSFPSPGLCLNTTKKIPLPGKIEEVRATGWLDLMKASSPTRKRQTKDAICDTQSDDLDLQYRNWTVNYPSALTSFEEISDLAGNKRLALFLDYDGTLSPIVDNPENALMSDEMRAAVRHVASLFPTAIISGRSRDKVFDFVNLNELYYAGSHGMDIMGPVRKTTDSNGVECIRSTDAHGKEVNLFQPASEFLPMITEVYEKLGESVKDIDGARMEDNKFCVSVHYRNVAEDDYKKVFHRVSAVLEDYPCLRLTHGRKVFEVRPVIDWNKGKAVEFLLESLGLNESEDVLPIYVGDDRTDEDAFKVLKASNRGFGILVSSIPKESDAFYSLRDPAEVMEFLRMLAAWKEQST

SEQ ID NO: 12671 - DNA, 1338 bp, Sorghum bicolor
  misc_feature: Ceres ANNOT ID no. 6107941
  misc_feature: Encodes the peptide sequence at SEQ ID NO 12672
atgccgtcggcttccctccgcctcgccgtcgtcggcgcgggcgcggcgggcctggtggcggcccgcgagctacgccgcgaggggcatgcgcccgtcgtcttcgagcgcgccgccgccgtcgggggaacctggctctacacgccgcccgccacgtcctccgacccgctcggcgccgcggcgacgcactccagcctctacgcgtcgctccgcaccaacctgccacgcgagaccatgggcttcctcgacttccccttcgccgctggcgccgcggccgcgggctccccccgagacccccgcaggttcccggggcacgaggaggtgctccgctacttggaggcgttcgcgcggcggttcgatctgctccggctcgtccgcttcgagacggaggtgctcagtgtgaggcgggaggacggcggcggcgggaggtgggcggtgacgtcgaggaagctcggggagaaagggagcggccaggaggagttctacgacgccgtcgtggtttgcaatggtcactacacggagccacgcatcgccgtcattcccggggtcgatgcttggccaggaaagcaaatgcatagccacaattaccgtgtgccggagccattccttgatcaagtagtgatcgtaattggggcctcggcaagtgcatttgacatttctcgagacatcgcaagcatggcggaagaggtccatattgctgatagatcagcaccagcttccacctgtaagaaggagcctggctatgataatctgtggcttcattccatgattgaccatgcgcaggaggatggcactgtggtgttccaggatggcagctcaatcaaagctgatgtcatcatgcactgcactggctacctgtatgactttccattccttggagatgacagcactatcactgtggatgacaaccgtgtcgatccactatacaagcatattttcccacccgaagtggcacctcatctgtccttcatcggattgccttggaaggttattccctttccactttttgaactccaaagtaagtgggttgctagagttctatcaggacgggtcaaacttccatctaaagacaagatgatggaagatgtgaaagctttctatttgaaactagaagcacttggatggcctaagagatacacacataacttttcaaaccatcagtttgagtatgatgattggctcgctgagcaatgtggctatccaccaatcgaagaatggaggaaacagatgtatgctgttaatgcaatgaacaaggcagctcgtcctgagagctaccgtgatgaatgggatgacgagcatctggtggccgaagcaaatgaatacttcaagaaattcttgtaa

SEQ ID NO: 12672 - protein, 445 aa, Sorghum bicolor
  misc_feature: Ceres ANNOT ID no. 6107941
  misc_feature (7)..(425): Pfam Id: FMO-like Pfam Desc: Flavin-binding monooxygenase-like
  misc_feature (7)..(255): Pfam Id: DAO Pfam Desc: FAD dependent oxidoreductase
  misc_feature (2)..(444): NCBI GI: 23308211 NCBI Desc: at1g62600/t3p18_16 [arabidopsis thaliana]
  misc_feature (2)..(444): NCBI GI: 30696735 NCBI Desc: flavin-containing monooxygenase family protein / fmo family protein [arabidopsis thaliana]
  misc_feature (2)..(444): NCBI GI: 21536927 NCBI Desc: similar to flavin-containing monooxygenase 3 [arabidopsis thaliana]
  misc_feature (2)..(444): NCBI GI: 15222405 NCBI Desc: flavin-containing monooxygenase family protein / fmo family protein [arabidopsis thaliana]
  misc_feature (2)..(444): NCBI GI: 5454204 NCBI Desc: t3p18.18 [arabidopsis thaliana]
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: Functional homolog of the protein sequence given in SEQ ID NO 13561
  misc_feature: Useful for making plants with modulated biomass
  misc_feature: Useful for making plants with modulated flowering time
  misc_feature: Functional homolog of the protein sequence given in SEQ ID NO 13561
MPSASLRLAVVGAGAAGLVAARELRREGHAPVVFERAAAVGGTWLYTPPATSSDPLGAAATHSSLYASLRTNLPRETMGFLDFPFAAGAAAAGSPRDPRRFPGHEEVLRYLEAFARRFDLLRLVRFETEVLSVRREDGGGGRWAVTSRKLGEKGSGQEEFYDAVVVCNGHYTEPRIAVIPGVDAWPGKQMHSHNYRVPEPFLDQVVIVIGASASAFDISRDIASMAEEVHIADRSAPASTCKKEPGYDNLWLHSMIDHAQEDGTVVFQDGSSIKADVIMHCTGYLYDFPFLGDDSTITVDDNRVDPLYKHIFPPEVAPHLSFIGLPWKVIPFPLFELQSKWVARVLSGRVKLPSKDKMMEDVKAFYLKLEALGWPKRYTHNFSNHQFEYDDWLAEQCGYPPIEEWRKQMYAVNAMNKAARPESYRDEWDDEHLVAEANEYFKKFL

SEQ ID NO: 12673 - DNA, 1014 bp, Sorghum bicolor
  misc_feature: Ceres ANNOT ID no. 6108099
  misc_feature: Encodes the peptide sequence at SEQ ID NO 12674
atggcggttaatgcgagagacgaggagaagaagtacgacggggacgacaaccatctcgggcttgggctaagcctcagcctcggcatcgccaccaccgcggctactccggtcgaggtcgacccgccgccgcggcagcagcagcagcagcgagctatcagcgtcgcgcccatctcctccctccccgcgccgcagtggtggaacggacccgccggtctcttcttctccccctcctccgggatgaagatggatccatctctggagaggaagcatcagcatcagcagcagcagcagcagcaggcggcggccacgagctacagccacgatatgccgttcctgcgtgggatcgacgtgaaccggcgggccaccgccggagagacccggaggggccgcagctgcagcgaggacgaggagcccggcgcgtcgtcgccgaacagcacgctctccagcctcagcgggaagcgcgccgcgccggcgaggagcagcggagaagtggatcgagaggccgacggccacaccccgagagccggaggcggcggcagcgacgacgaggactccggcgccggcggtgggtcgcgcaagaagctccgcctctccaaggaccaggccgccgtcctcgaggacagcttcaaggagcacaacaccctcaaccccaagcagaaggcggcgctggcgaagcagctgaacctgaagccacgtcaggttgaggtctggttccagaaccgcagagccaggacgaagctgaagcagacggaggtggactgcgagttcctgaagcgctgctgcgagacgctgacggaggagaaccggcggctgcagcgggaggtggcggagctgcgcgcgctcaagctcgtggcgccgcaccactacgcgcggatgccgccgccaaccacgctcaccatgtgcccctcctgcgagcgcctcgcctccgcggccctggggccctctccccgtgcggccagtgttcgtcgacggcccggcccggaggtcatgatcgatcgacagacaatggaatga

SEQ ID NO: 12674 - protein, 337 aa, Sorghum bicolor
  misc_feature: Ceres ANNOT ID no. 6108099
  misc_feature (3)..(160): Pfam Id: HD-ZIP_N Pfam Desc: HD-ZIP protein N terminus
  misc_feature (248)..(292): Pfam Id: HALZ Pfam Desc: Homeobox associated leucine zipper
  misc_feature (193)..(247): Pfam Id: Homeobox Pfam Desc: Homeobox domain
  misc_feature (90)..(328): NCBI GI: 2344893 NCBI Desc: homeodomain transcription factor (athb-4) [arabidopsis thaliana]
  misc_feature (75)..(327): NCBI GI: 30984526 NCBI Desc: at3g60390 [arabidopsis thaliana]
  misc_feature (75)..(327): NCBI GI: 549890 NCBI Desc: homeobox protein
  misc_feature (45)..(315): NCBI GI: 1149535 NCBI Desc: homeobox-leucine zipper protein [pimpinella brachycarpa]
  misc_feature (90)..(317): NCBI GI: 1234900 NCBI Desc: homeobox-leucine zipper protein [glycine max]
  misc_feature: The plant flowers significantly late compared to wild-type.
  misc_feature: The plant is abnormally small.
  misc_feature: The sequence is a functional homolog of SEQ ID NO 1411 in the 11/479,226US patent application
  misc_feature: The sequence is a functional homolog of SEQ ID NO 1674 in the 10/374,780US patent application
  misc_feature: The sequence is a functional homolog of SEQ ID NO 2328 in the 10/374,780US patent application
  misc_feature: The sequence is a functional homolog of SEQ ID NO 2492 in the 10/374,780US patent application
  misc_feature: The sequence is a functional homolog of SEQ ID NO 52 in the 10/225,066US patent application
  misc_feature: The sequence is a functional homolog of SEQ ID NO 524 in the 10/225,066US patent application
  misc_feature: The sequence is a functional homolog of SEQ ID NO 553 in the 11/479,226US patent application
  misc_feature: The sequence is a functional homolog of SEQ ID NO 568 in the 11/479,226US patent application
  misc_feature: Useful for biocontainment applications
  misc_feature: Useful for making plants with altered Lignin content
  misc_feature: Useful for making plants with altered alkaloid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated light quality response
  misc_feature: Functional homolog of the protein sequence given in SEQ ID NO 12880
  misc_feature: Functional homolog of the protein sequence given in SEQ ID NO 13109
  misc_feature: Functional homolog of the protein sequence given in SEQ ID NO 13185
  misc_feature: The sequence is a functional homolog of SEQ ID NO 52 in the 20050160493 US patent application
  misc_feature: The sequence is a functional homolog of SEQ ID NO 524 in the 20050160493 US patent application
  misc_feature: The sequence is a functional homolog of SEQ ID NO 1674 in the 20060162006 US patent application
  misc_feature: The sequence is a functional homolog of SEQ ID NO 568 in the 20070022495 US patent application
  misc_feature: GREAT-hit functional homolog of the protein sequence given in SEQ ID NO 13544
  misc_feature: The sequence is a functional homolog of SEQ ID NO 2328 in the 10/374,780 US patent application
  misc_feature: The sequence is a functional homolog of SEQ ID NO 524 in the 10/225,066 US patent application
  misc_feature: The sequence is a functional homolog of SEQ ID NO 553 in the 11/479,226 US patent application
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13544
  misc_feature: The sequence is a functional homolog of SEQ ID NO 254 in the 10/412,699 US patent application
  misc_feature: The sequence is a functional homolog of SEQ ID NO 550 in the 11/479,226 US patent application
  misc_feature: Useful for making plants with altered lignin content
  misc_feature: Functional homolog of the protein sequence given in SEQ ID NO 12880
  misc_feature: Useful for making plants with altered alkaloid content
  misc_feature: Functional homolog of the protein sequence given in SEQ ID NO 13109
  misc_feature: The sequence is a functional homolog of SEQ ID NO 2326 in the 10/374,780 US patent application
  misc_feature: The sequence is a functional homolog of SEQ ID NO 252 in the 10/412,699 US patent application
  misc_feature: The sequence is a functional homolog of SEQ ID NO 546 in the 11/479,226 US patent application
  misc_feature: The sequence is a functional homolog of SEQ ID NO 8 in the 10/225,068 US patent application
  misc_feature: The sequence is a functional homolog of SEQ ID NO 1674 in the 10/374,780 US patent application
MAVNARDEEKKYDGDDNHLGLGLSLSLGIATTAATPVEVDPPPRQQQQQRAISVAPISSLPAPQWWNGPAGLFFSPSSGMKMDPSLERKHQHQQQQQQQAAATSYSHDMPFLRGIDVNRRATAGETRRGRSCSEDEEPGASSPNSTLSSLSGKRAAPARSSGEVDREADGHTPRAGGGGSDDEDSGAGGGSRKKLRLSKDQAAVLEDSFKEHNTLNPKQKAALAKQLNLKPRQVEVWFQNRRARTKLKQTEVDCEFLKRCCETLTEENRRLQREVAELRALKLVAPHHYARMPPPTTLTMCPSCERLASAALGPSPRAASVRRRPGPEVMIDRQTME

SEQ ID NO: 12675 - DNA, 1416 bp, Sorghum bicolor
  misc_feature: Ceres ANNOT ID no. 6108180
  misc_feature: Encodes the peptide sequence at SEQ ID NO 12676
atggaggatgcccctgctacaaagaagagatttcaaggtccacgttgcaaagattctactcccaaagaaggaaatgaagacggtgttgaccatataagcagactccccaataatatcctaggtgagattatctccctccttcctacaatggattgtgcgcgtacaaagtgtctatcctccaagtggagcgacctttggctctctggcccacttaattttgactattgtgatctcaaagatcctcatgatgataaagaccttgtgagcatcatttctagcatttttaatgctcaccccggacctgcccgacgattttgcatccctgcacactatctctgcaccaacattgacaatgttgttacttggcttgagtcccccacccttaatgggctacaagagcttgagttccacatcacagaagttgactttacattgtcactatatcccccaccaccagcatccatctttcgtttctcgtccacactccgtattgtctcctttggtggatgccgcctcccagatatcatggtcaatcagctccagttccccaacctccagcagcttacactatttgatgctattatatctgaagagaccctgcatgccatgcttgagagttgccccaaacttgagatcttgctgatgaaacacaatgaaggttttcgctatgttcggatcaattcccgatcccttaagagcataggtgttcatactgattcttttcgacaaggtcccactatagaggagctcattattgagaatgcgccaatacttgagaggcttatcagttttgagcgatatagtaggttgcacatatcagtgatctcagcaccaaagctggaaaccctgggctgtatttttgagaataatgacaagacaatgctcactcttggatctacgacttttctgggaatacgttcggttgacatgagagcaatggtgccaatgcatactgtcaaggtcttatctgtgttccctttgtctctctgtctggatgatgttctcaatttcattagatgttttccgtgcctggagaagctgtacatccagctgtcttgtgcacaagggcacacgaaccagtggccccgtaaacacaggaatcttatcaaatcgcttgacctttgcctgaaaacaatagtgatgataaattatcggggcgcagcagaacaatcagaatttgtgacattctttgtggagaatgcaagaatgcttgagtctatgaggtttgtggtcccaagttgtttctatcatgacaagaactggataagaagccagaatagacagctcaagctggacaagagctcttccagatgtgtttcatttactttcactgagaatcaattccaccacaatatgatacatgttttgcgggccagtgatctgtcagcagctgatccatttcactgtaactgctga

SEQ ID NO: 12676 - protein, 471 aa, Sorghum bicolor
  misc_feature: Ceres ANNOT ID no. 6108180
  misc_feature (360)..(411): Pfam Id: FBD Pfam Desc: FBD
  misc_feature (30)..(77): Pfam Id: F-box Pfam Desc: F-box domain
  misc_feature (70)..(471): NCBI GI: 50509648 NCBI Desc: ribosomal rna apurinic site specific lyase-like [oryza sativa (japonica cultivar-group)]
  misc_feature (150)..(461): NCBI GI: 115471537 NCBI Desc: os07g0277500 [oryza sativa (japonica cultivar-group)]
  misc_feature (150)..(455): NCBI GI: 34393947 NCBI Desc: ribosomal rna apurinic site specific lyase-like [oryza sativa (japonica cultivar-group)]
  misc_feature (14)..(467): NCBI GI: 115471573 NCBI Desc: os07g0287000 [oryza sativa (japonica cultivar-group)]
  misc_feature (1)..(414): NCBI GI: 6513849 NCBI Desc: ribosomal rna apurinic site specific lyase [triticum aestivum]
MEDAPATKKRFQGPRCKDSTPKEGNEDGVDHISRLPNNILGEIISLLPTMDCARTKCLSSKWSDLWLSGPLNFDYCDLKDPHDDKDLVSIISSIFNAHPGPARRFCIPAHYLCTNIDNVVTWLESPTLNGLQELEFHITEVDFTLSLYPPPPASIFRFSSTLRIVSFGGCRLPDIMVNQLQFPNLQQLTLFDAIISEETLHAMLESCPKLEILLMKHNEGFRYVRINSRSLKSIGVHTDSFRQGPTIEELIIENAPILERLISFERYSRLHISVISAPKLETLGCIFENNDKTMLTLGSTTFLGIRSVDMRAMVPMHTVKVLSVFPLSLCLDDVLNFIRCFPCLEKLYIQLSCAQGHTNQWPRKHRNLIKSLDLCLKTIVMINYRGAAEQSEFVTFFVENARMLESMRFVVPSCFYHDKNWIRSQNRQLKLDKSSSRCVSFTFTENQFHHNMIHVLRASDLSAADPFHCNC

SEQ ID NO: 12677 - DNA, 1479 bp, Sorghum bicolor
  misc_feature: Ceres ANNOT ID no. 6108410
  misc_feature: Encodes the peptide sequence at SEQ ID NO 12678
atggtgtcagctctcactccctcagcaaagccgctgcctcaccatcgccaccctgcaaaacgaggattactggagttccggagggattgcagccgcgctgttacatcgagggtaagaatcaccatgcttattagccagcagaatccccgcggcgccggcgatggcgatggcgccggcacgcctttgtacctcgggatagacttcggaacttccggagcaagatacgccctcatcgacaaggaaggagccatccattcggaagggaaacgagcttaccctgttcctgtcggcgacgccgccgccgccgccacggactgggcgagctcctggcgagcggcgctcttccagctcctcgccgacatcccgcccgtccaccgcccgtccatctcctccatctccatagacgggacctcggccaccacgctcatcgtcgacagcgacaccggggagcttctcgccggcccgttcctctacaacgagagcttcccagacgcgctgcccgccgtggagtcgatcgcgcccgccaaccacaccgtgtgctccgcctcctccacgctctgcaagctcgtgtcgtggtggacctcgaccacgaccggcggcagtcgtccggcggcggcggtgctgatgcaccagtccgactggctcctctggctcttgcacggccagttcagcgtctccgactacaacaacgccctcaaggtgggctacgatccggagctccacgcctacccgagctggctgacgtcgcagccgtactcgcgcatgctgcctgcttccgtcagagcacctggcacccccattgctgcactcaaagatgacgtgtgctcacagtacgggttctccaagaactgcgttgtgtgcaccggaaccaccgacagcatagcggcgttccttgcagctcgcagcagtgaaccaggaagagctgtgacgtcgctgggttcaactctggcgatcaagctggtgagccaagtccgcgtggacgacgcgaggttcggcgtgtacagccaccgcctggacgacacgtactggctcgtcggcggggcgtccaacaccgggggagccgtgctccggcagctcttcaccgacgaccagctcgtggcgctgagcgaccacatcgacccggccgtgccttccacgctcgactactacccgctgccggcgaagggcgagaggttcccagtctctgatcccgacatgacgccgaggttgcagccccgcccagtgagcgacgccgagtacctgcacggcatcctggaatccatcgcgcgaattgaggccaaggggtacaatctgctcaaggagctcggcgcgacggctgtggaggaagtgttcacggcagggggaggggcgcagaacgacaagtggacggccattcgggagagggtgctcggcgtgccggtccggaaagcccagcagactgaggcagcctatggagctgcattgctagcactcaagggcgccagcagcttaattagctag

SEQ ID NO: 12678 - protein, 492 aa, Sorghum bicolor
  misc_feature: Ceres ANNOT ID no. 6108410
  misc_feature (62)..(299): Pfam Id: FGGY_N Pfam Desc: FGGY family of carbohydrate kinases, N-terminal domain
  misc_feature (302)..(492): Pfam Id: FGGY_C Pfam Desc: FGGY family of carbohydrate kinases, C-terminal domain
  misc_feature (309)..(489): NCBI GI: 23617033 NCBI Desc: xylulose kinase-like protein [oryza sativa (japonica cultivar-group)]
  misc_feature (38)..(486): NCBI GI: 140071411 NCBI Desc: carbohydrate kinase, fggy [medicago truncatula]
  misc_feature (234)..(486): NCBI GI: 92888715 NCBI Desc: probable xylulose kinase [imported] - arabidopsis thaliana-related [medicago truncatula]
  misc_feature (62)..(489): NCBI GI: 23126774 NCBI Desc: cog1070: sugar (pentulose and hexulose) kinases [nostoc punctiforme pcc 73102]
  misc_feature (153)..(402): NCBI GI: 115471683 NCBI Desc: os07g0409200 [oryza sativa (japonica cultivar-group)]
MVSALTPSAKPLPHHRHPAKRGLLEFRRDCSRAVTSRVRITMLISQQNPRGAGDGDGAGTPLYLGIDFGTSGARYALIDKEGAIHSEGKRAYPVPVGDAAAAATDWASSWRAALFQLLADIPPVHRPSISSISIDGTSATTLIVDSDTGELLAGPFLYNESFPDALPAVESIAPANHTVCSASSTLCKLVSWWTSTTTGGSRPAAAVLMHQSDWLLWLLHGQFSVSDYNNALKVGYDPELHAYPSWLTSQPYSRMLPASVRAPGTPIAALKDDVCSQYGFSKNCVVCTGTTDSIAAFLAARSSEPGRAVTSLGSTLAIKLVSQVRVDDARFGVYSHRLDDTYWLVGGASNTGGAVLRQLFTDDQLVALSDHIDPAVPSTLDYYPLPAKGERFPVSDPDMTPRLQPRPVSDAEYLHGILESIARIEAKGYNLLKELGATAVEEVFTAGGGAQNDKWTAIRERVLGVPVRKAQQTEAAYGAALLALKGASSLIS

SEQ ID NO: 12679 - DNA, 1188 bp, Sorghum bicolor
  misc_feature: Ceres ANNOT ID no. 6108491
  misc_feature: Encodes the peptide sequence at SEQ ID NO 12680
atgacaagtaagaaaagtaacagatctacagtcacatcacgcactgctctgcatatggaatgggacaggatttcttgccctatttgtatggagcaaccccacaatgccgttttacttatatgcagttcatacaagaatggctgcagatgttacatttgtaacacaagccatcgacactctaattgccttgaccggttcagaaaagtgaatggtgatagtaaggtccgtgcttcacactcaacctattcggtgctttcaaactccaatatcagaactgtccaaccaagagctcactataatatgatttccagacgttcacggagcccaagactcggaagacatgttgataatgaaggatcttatcataccaatgtaaacagtggaaatattgtattgggggaatgccatgatgccatgcaaagttctgctgaaatgaagtgtcctctctgtagaggatctgtatctggctggattcctgctggagatgtgagacagtatctagacaataagttgagaacttgctctcatgattcctgcaaatttactggaacctatgagcaactgcgtgaacatgcaaggactgcacacgtgcttacaaagcctgctcatgtagatctgtcaagaaaaagaacttgggatcgccttgagcgtgagcaggaggttggcgatgtcatcagtgcaattaggtcccaggtacctggggcaataatagttggtgactatgttattgagactcgagatgacttgtccccagacatagactccggcgatgaaagtagtgaatggtattcagaccatcttgattcaccagataatagacttgattccccaagggtgtggccaaatgaagcgctagggtcacctagcatttggtcagatgaaaggcgtaatttggcaaggctgccacagatcaatagagtttcacccaggctttcattaggcagtaggcgaaccttgcattcaggttggcagggggttcgtcggtcaagcacacggagtctgctgcaacggggcttctcaaatcactactctggacaccgcagcagcaactaccgtggacatcgtcacatgcttctggataggtcttatgctggtacccgaaattcaggtactggcaggagcctaaatccgtcggtggtgccaagcaggcggcagcggcttcggtacacgcacagaagtcactactga

SEQ ID NO: 12680 - protein, 395 aa, Sorghum bicolor
  misc_feature: Ceres ANNOT ID no. 6108491
  misc_feature (139)..(395): NCBI GI: 115471759 NCBI Desc: os07g0419800 [oryza sativa (japonica cultivar-group)]
  misc_feature (144)..(256): NCBI GI: 38346521 NCBI Desc: osjnba0027h09.16 [oryza sativa (japonica cultivar-group)]
  misc_feature (144)..(256): NCBI GI: 116317899 NCBI Desc: osigba0131j24.4 [oryza sativa (indica cultivar-group)]
  misc_feature (143)..(257): NCBI GI: 82568695 NCBI Desc: pm27 [prunus mume]
  misc_feature (134)..(250): NCBI GI: 115438510 NCBI Desc: os01g0612600 [oryza sativa (japonica cultivar-group)]
MTSKKSNRSTVTSRTALHMEWDRISCPICMEQPHNAVLLICSSYKNGCRCYICNTSHRHSNCLDRFRKVNGDSKVRASHSTYSVLSNSNIRTVQPRAHYNMISRRSRSPRLGRHVDNEGSYHTNVNSGNIVLGECHDAMQSSAEMKCPLCRGSVSGWIPAGDVRQYLDNKLRTCSHDSCKFTGTYEQLREHARTAHVLTKPAHVDLSRKRTWDRLEREQEVGDVISAIRSQVPGAIIVGDYVIETRDDLSPDIDSGDESSEWYSDHLDSPDNRLDSPRVWPNEALGSPSIWSDERRNLARLPQINRVSPRLSLGSRRTLHSGWQGVRRSSTRSLLQRGFSNHYSGHRSSNYRGHRHMLLDRSYAGTRNSGTGRSLNPSVVPSRRQRLRYTHRSHY

SEQ ID NO: 12681 - DNA, 873 bp, Sorghum bicolor
  misc_feature: Ceres ANNOT ID no. 6108526
  misc_feature: Encodes the peptide sequence at SEQ ID NO 12682
atgagcagcgggaagcgatccttcttcgcgcccaagaagaaggcaaccaacccgttcgattccggctccgacgacgacaaaccgcagcggcgaccggcgcgggcttcctccgtgcctcccccggagtcggacgaacaacagcgagggggctcctctctctcgggcagcgccggcggcgacagggccgggctcttctcctcttcctcgaccaaccatcactaccggaacgacttccgcgacgccggcggcctggagagccagtccgtgcaggagctggagggctacgcggcgtacaaggccgaggagaccacgcgccgcgcgcagggctgcgtcaggatcgccgaggagatgcgggacaccgcgtccaagacgctcgtcaccgtccaccagcaggggcagcagatccaccgcacccacatgatggccgtcgacatcgaccaagatctctccaggagtgagaagctattgggtgatcttgggggcctattttccaaaaagtggaagccaaagaagaatggcgcaatcaggggtcctatgctaactagagatgattccttcataaggaagggcagccatctggagcaaaggcagaaacttgggctggcagatcatccacctcggtcaaatgcgcgccaattcagttctgaaccctcatcagcacttgagaaagtcgagatggagaagggaaagcaggatgatgctctgtctgatctaagcaacatactgatcgagctgaaagggatggccgttgacatgggctctgagatagagaggcaaacaaaagcaatgggcgatgcagagaaggattatgacgagctgaacatcagggtcaagggagcaaacactcgagctcgccgtcttcttgggagatag

SEQ ID NO: 12682 - protein, 290 aa, Sorghum bicolor
  misc_feature: Ceres ANNOT ID no. 6108526
  misc_feature (230)..(289): Pfam Id: SNARE Pfam Desc: SNARE domain
  misc_feature (3)..(290): NCBI GI: 58825794 NCBI Desc: snap1 [oryza sativa (japonica cultivar-group)]
  misc_feature (1)..(290): NCBI GI: 32308074 NCBI Desc: snap-34 [hordeum vulgare subsp. vulgare]
  misc_feature (12)..(290): NCBI GI: 22655332 NCBI Desc: at5g61210/maf19_210 [arabidopsis thaliana]
  misc_feature (12)..(290): NCBI GI: 21553460 NCBI Desc: snap25a [arabidopsis thaliana]
  misc_feature (86)..(290): NCBI GI: 32308076 NCBI Desc: snap-28 [hordeum vulgare subsp. vulgare]
  misc_feature: The sequence is a functional homolog of SEQ ID NO. 342 in the 11/188,298 US application
MSSGKRSFFAPKKKATNPFDSGSDDDKPQRRPARASSVPPPESDEQQRGGSSLSGSAGGDRAGLFSSSSTNHHYRNDFRDAGGLESQSVQELEGYAAYKAEETTRRAQGCVRIAEEMRDTASKTLVTVHQQGQQIHRTHMMAVDIDQDLSRSEKLLGDLGGLFSKKWKPKKNGAIRGPMLTRDDSFIRKGSHLEQRQKLGLADHPPRSNARQFSSEPSSALEKVEMEKGKQDDALSDLSNILIELKGMAVDMGSEIERQTKAMGDAEKDYDELNIRVKGANTRARRLLGR

SEQ ID NO: 12683 - DNA, 261 bp, Sorghum bicolor
  misc_feature: Ceres ANNOT ID no. 6108707
  misc_feature: Encodes the peptide sequence at SEQ ID NO 12684
atggcggccgcggccgcgtccaagagcgacgatggtccggcggtaggcatcgaccttggtacgaccaactcctgcgtatccatgtggtggaacggccgtgttgaggtcatcgccaacgatcagggcgagcgcctcacgccgtccgtcgtcgcgttcaccggcaacaagatcctcgtcggcgacgccgccgtgaaccaggccgcctcgaatcccaccaacaccatctttggtgagaaccacttgttctttgttcaaacttga

SEQ ID NO: 12684 - protein, 86 aa, Sorghum bicolor
  misc_feature: Ceres ANNOT ID no. 6108707
  misc_feature (9)..(81): NCBI GI: 32394610 NCBI Desc: heat shock protein 70 [griffithsia japonica]
  misc_feature (12)..(78): NCBI GI: 119587946 NCBI Desc: heat shock 70kda protein 8, isoform cra_c [homo sapiens]
  misc_feature (11)..(81): NCBI GI: 3986691 NCBI Desc: heat shock protein [cichorium intybus]
  misc_feature (11)..(81): NCBI GI: 92868673 NCBI Desc: orn/dap/arg decarboxylase 2; heat shock protein hsp70 [medicago truncatula]
  misc_feature (7)..(81): NCBI GI: 166765 NCBI Desc: heat shock protein hsp70-1
  misc_feature: Useful for making plants with modulated heat sensitivity
  misc_feature: Functional homolog of the protein sequence given in SEQ ID NO 13726
MAAAAASKSDDGPAVGIDLGTTNSCVSMWWNGRVEVIANDQGERLTPSVVAFTGNKILVGDAAVNQAASNPTNTIFGENHLFFVQT

SEQ ID NO: 12685 - DNA, 948 bp, Sorghum bicolor
  misc_feature: Ceres ANNOT ID no. 6108737
  misc_feature: Encodes the peptide sequence at SEQ ID NO 12686
atgagcaggcttgcgtcggggctccagcgcctgcggaggtcgtcgtcgccgtgggaggtgctgtggtccgcgctggcgtcatgcggcctagtgcttttctcgcagctcgccgtggcgatggttccccgtctcttcccttccctctccctcctcgccatgctccccatcgcggggttggtgttcctcgcggctatcgtggtcggccgcctgtggaggaggttcatcggggtggcggcgtcggcgccgctcttcgtgctcttcaacatcctcctattgtggggcgtttacctcttcgtgatccggagagaaacttcttctctgctggacatgctaataaatgcagaatgtgcactgcttttgtggggactctacaggattttatctggtgatccaggtattgttgcttgtgattcttcatatttggaagaagctggctgcaaggattttgtggaagctatatgctcgagtgagaaactcccaatgctctcaagggttaggcagtgtacctggtgcaaagcaaacattaggggctatgaccatcattgccctgcatttggtacttgcataggacagaaaaatcatcggctatttatggcccttttgacaggatttgttgttgctgaatcaacttatacaatgtgctcaacaaaatatattaccagatgcatcagttcaggaactataagacctgagaatcctgtatctctaaacatggtaatcagtacaatgctcttctctatcctccaggtcctctggcagattgcattcttgatgtggcacatatattgcatctgcttcaacatcaagacagatgagtggattaactggaagaaatatcctgaattccagatgaaggaacagcctcgatcagattctgaagtcaaatttgtgaacccatatgacaaaggcatgctgtgtaacataagagaatttctgaagccggaatga

SEQ ID NO: 12686 - protein, 315 aa, Sorghum bicolor
  misc_feature: Ceres ANNOT ID no. 6108737
  misc_feature (144)..(207): Pfam Id: zf-DHHC Pfam Desc: DHHC zinc finger domain
  misc_feature (84)..(314): NCBI GI: 123507594 NCBI Desc: dhhc zinc finger domain containing protein [trichomonas vaginalis g3]
  misc_feature (130)..(315): NCBI GI: 123394388 NCBI Desc: dhhc zinc finger domain containing protein [trichomonas vaginalis g3]
  misc_feature (22)..(313): NCBI GI: 116117300 NCBI Desc: ensangp00000008882 [anopheles gambiae str. pest]
  misc_feature (117)..(313): NCBI GI: 21357959 NCBI Desc: cg6017-pa [drosophila melanogaster]
  misc_feature (116)..(313): NCBI GI: 54641771 NCBI Desc: ga19299-pa [drosophila pseudoobscura]
MSRLASGLQRLRRSSSPWEVLWSALASCGLVLFSQLAVAMVPRLFPSLSLLAMLPIAGLVFLAAIVVGRLWRRFIGVAASAPLFVLFNILLLWGVYLFVIRRETSSLLDMLINAECALLLWGLYRILSGDPGIVACDSSYLEEAGCKDFVEAICSSEKLPMLSRVRQCTWCKANIRGYDHHCPAFGTCIGQKNHRLFMALLTGFVVAESTYTMCSTKYITRCISSGTIRPENPVSLNMVISTMLFSILQVLWQIAFLMWHIYCICFNIKTDEWINWKKYPEFQMKEQPRSDSEVKFVNPYDKGMLCNIREFLKPE

SEQ ID NO: 12687 - DNA, 843 bp, Sorghum bicolor
  misc_feature: Ceres ANNOT ID no. 6108765
  misc_feature: Encodes the peptide sequence at SEQ ID NO 12688
atgagcttcgtcttccgagggagcagggccgacatcgaggccggtggcttcccggggttcgcccccgagcgccgcgccatgcgaattcatgcagggagcaggccggtgaatagcaattccttggcttttcttctaactgttcttgttttgttcatggtactgaactcacaccagatgtctcccaatcttttgctttggcttgtcttgggagtcttcctaatggccacaagccttagaatgtatgccacgtgccagcagcttgctcatgctgcagctgccaacaattttcttggacacactgagctgcgtgtgcatgtaccgccgaccattgcccttgctacgagaggccggttacagagccttagacttcaactggctcttcttgatcgtgaatttgacgatttagattatgacactctgagagcattggatgctgacaatagcccgcatactccttctatgagtgaagaagaaataaattctcttcctgtattcaaatataaagttcaggcgcagcaggggaatgcccctgcccagaaaagtgatgggccatctcagctatcggtttcttcaactggatctggcaatgagaagaagcaggatggtttaaaatcagatggaaccagcaaaactccagaggatgaactaacatgtagtgtttgcttagagcaagtcgccgtgggtgatctgttgagaagcctaccatgcttgcatcagtttcacgtaaactgcatcgacccatggctgcgccaacagggtacatgcccaatctgcaagcaccaggtgagtgatgggtggcatgccacaggcaacggtgaagaggatgcctcttacatggtgtaa

SEQ ID NO: 12688 - protein, 280 aa, Sorghum bicolor
  misc_feature: Ceres ANNOT ID no. 6108765
  misc_feature (218)..(258): Pfam Id: zf-C3HC4 Pfam Desc: Zinc finger, C3HC4 type (RING finger)
  misc_feature (6)..(280): NCBI GI: 115452191 NCBI Desc: os03g0272300 [oryza sativa (japonica cultivar-group)]
  misc_feature (66)..(280): NCBI GI: 92879542 NCBI Desc: zinc finger, ring-type [medicago truncatula]
  misc_feature (1)..(280): NCBI GI: 92879543 NCBI Desc: zinc finger, ring-type [medicago truncatula]
  misc_feature (74)..(280): NCBI GI: 140045962 NCBI Desc: zinc finger, ring-type [medicago truncatula]
  misc_feature (199)..(280): NCBI GI: 140045964 NCBI Desc: zinc finger, ring-type [medicago truncatula]
  misc_feature: Useful for making plants with modulated water use efficiency
  misc_feature: Functional homolog of the protein sequence given in SEQ ID NO 13730
  misc_feature: The sequence is a functional homolog of SEQ ID NO. 329 in the 11/188,298 US application
  misc_feature: The sequence is a functional homolog of SEQ ID NO. 271 in the 11/188,298 US application
MSFVFRGSRADIEAGGFPGFAPERRAMRIHAGSRPVNSNSLAFLLTVLVLFMVLNSHQMSPNLLLWLVLGVFLMATSLRMYATCQQLAHAAAANNFLGHTELRVHVPPTIALATRGRLQSLRLQLALLDREFDDLDYDTLRALDADNSPHTPSMSEEEINSLPVFKYKVQAQQGNAPAQKSDGPSQLSVSSTGSGNEKKQDGLKSDGTSKTPEDELTCSVCLEQVAVGDLLRSLPCLHQFHVNCIDPWLRQQGTCPICKHQVSDGWHATGNGEEDASYMV

SEQ ID NO: 12689 - DNA, 1410 bp, Sorghum bicolor
  misc_feature: Ceres ANNOT ID no. 6108772
  misc_feature: Encodes the peptide sequence at SEQ ID NO 12690
atgtgcgcacgcacaaccaccagctcatggatgaagcagctgacgaacgcttcccggcaaggccgccacggccgcgttctccacctcttcttcgcccacctccgacgcggcgatcgcggcttggtggacctgcaccccgcggccgtccccacggcgctccgcgcctgcgcgcgcctcggaaacgcttcctccggccgcctaatccacgcgctcgtcatcacccggttcccgttcctcgccgccgacgccgtcgccgccaccgcgcttctcgacatgtacgccaaatgcggcctggtcgcgagtgcccagagggtgttcgacgaaatgccgcgaaaggatgacctcgtcgcctggaacgcgctggtcgcatgctacgcgcgccacgccctcccggaccgggccctggcgctagccatcaagatgcggggccaatgcctgcgacccgacctgatgacatggaacgccgtcatctctggtttcgcgctagctggcgacgaccagatggccggggaattggtcggcgccatggaggaggacgggttccagccggacgtggtcacttggacatcgcttgtatccggctcggtgctgaacttccagtatgccagggcgcgcgtgctgttccggagaatggtgaccgctggcaaccccgtcctgccgtgctcggccacgattgtcagcatcctgcctgccttcgccaatgtcgctgacgtgaagcgtggcaaggaagtccacacctacgccgtggtgaccggcgtcgaacaggagcttactgtgggcagcgctctactagatatgtacacgaagagcgggttcctgctggaagcacgccggctgttcgacaggatggcggaaagaagcacggtgacttggaattccatgatcttcgggctggcgaattcaggccactgccaagaagccatcggtctcttcaaccggatgctgtgcgacggagcaaggccggatcacctgacgttcacagccgttctgacggcttgcagctacgccggcatggtggagctcgggaagagcctgtaccgcgacatgcaggaagagcacggcatcgagccgaggctggagcactgcgcatgcatggtgcatttgcttggccgagccggctggctcgccgaggcttatgatttcatcaaagccatgcccctggagcctgactgcttcgtctggggggcgttgctgggggcatgccggagccatggcgacatcaagcttgccgagctggctgcgtcccacctgctaaccgtcgagccggccaatgcagctagttgcctgctactctcggactcgctggcaggtgcaggcagacaagatgatgttacgaagatgaagaggctggcaaagagacggcgcatgaagaagctggatggctgcagctggctgagtgagtctacataa

SEQ ID NO: 12690 - protein, 469 aa, Sorghum bicolor
  misc_feature: Ceres ANNOT ID no. 6108772
  misc_feature (116)..(150): Pfam Id: PPR Pfam Desc: PPR repeat
  misc_feature (151)..(185): Pfam Id: PPR Pfam Desc: PPR repeat
  misc_feature (289)..(323): Pfam Id: PPR Pfam Desc: PPR repeat
  misc_feature (1)..(468): NCBI GI: 29893615 NCBI Desc: chloroplast import-associated channel protein homolog [oryza sativa (japonica cultivar-group)]
  misc_feature (1)..(468): NCBI GI: 115452179 NCBI Desc: os03g0271300 [oryza sativa (japonica cultivar-group)]
  misc_feature (88)..(465): NCBI GI: 116308873 NCBI Desc: h0613h07.7 [oryza sativa (indica cultivar-group)]
  misc_feature (88)..(465): NCBI GI: 38344863 NCBI Desc: osjnba0020p07.6 [oryza sativa (japonica cultivar-group)]
  misc_feature (82)..(463): NCBI GI: 92894679 NCBI Desc: asp/glu racemase [medicago truncatula]
MCARTTTSSWMKQLTNASRQGRHGRVLHLFFAHLRRGDRGLVDLHPAAVPTALRACARLGNASSGRLIHALVITRFPFLAADAVAATALLDMYAKCGLVASAQRVFDEMPRKDDLVAWNALVACYARHALPDRALALAIKMRGQCLRPDLMTWNAVISGFALAGDDQMAGELVGAMEEDGFQPDVVTWTSLVSGSVLNFQYARARVLFRRMVTAGNPVLPCSATIVSILPAFANVADVKRGKEVHTYAVVTGVEQELTVGSALLDMYTKSGFLLEARRLFDRMAERSTVTWNSMIFGLANSGHCQEAIGLFNRMLCDGARPDHLTFTAVLTACSYAGMVELGKSLYRDMQEEHGIEPRLEHCACMVHLLGRAGWLAEAYDFIKAMPLEPDCFVWGALLGACRSHGDIKLAELAASHLLTVEPANAASCLLLSDSLAGAGRQDDVTKMKRLAKRRRMKKLDGCSWLSEST

SEQ ID NO: 12691 - DNA, 741 bp, Sorghum bicolor
  misc_feature: Ceres ANNOT ID no. 6108862
  misc_feature: Encodes the peptide sequence at SEQ ID NO 12692
atggggtcgtcggaggccgacgaggaccagctcctcaagagcttcctcgcggaggtcagcgaggccgagcgggacaacgaagtgctcaggatacttggttgcttcaagttaaaccccttcgagcatcttaagttgtcttttgattcatcaccagatgaggtgaaaaagcaatacaggaagttatcattgttggtccatcctgataaatgcaagcatcctcaggcacaagaagcttttgcagctctggcaaaagcacaacagctcctgcttgatccacaggaaagaggctacattcttgaccaagttactgctgcaaaagaagaattgagggcaaagcggaaaaaggagctgaagaaagatagtgcgtccaagataaaatctcttgtagatgagggaaaatatgaagagcagtttgaacgatcggacgaatttcagcagcagttaataattaaagtacgtgaaattttgacggacaaagaatggcgtcggagaaaaatgcaaatgaggatatctgaggaagaaggaagacttaagaaggacgaggaggaaacaaaagagatgtggaagaggaagagagagcatgaagagaagtgggaggagaccagagaccagcgggtctccagctggagggatttcatgaagacaggaaagaagggacggaaaggtgaaatcaaacccccaaaattaaagactgaagatccaaacaaatcttatgtccaaaggccagtaaagcgcaattga

SEQ ID NO: 12692 - protein, 246 aa, Sorghum bicolor
  misc_feature: Ceres ANNOT ID no. 6108862
  misc_feature (38)..(98): Pfam Id: DnaJ Pfam Desc: DnaJ domain
  misc_feature (3)..(245): NCBI GI: 140040352 NCBI Desc: heat shock protein dnaj [medicago truncatula]
  misc_feature (2)..(232): NCBI GI: 119628112 NCBI Desc: dnaj (hsp40) homolog, subfamily c, member 8, isoform cra_a [homo sapiens]
  misc_feature (2)..(232): NCBI GI: 48145917 NCBI Desc: dnajc8 [homo sapiens]
  misc_feature (2)..(232): NCBI GI: 3599415 NCBI Desc: spf31 [homo sapiens]
  misc_feature (2)..(232): NCBI GI: 62900355 NCBI Desc: dnaj homolog subfamily c member 8
MGSSEADEDQLLKSFLAEVSEAERDNEVLRILGCFKLNPFEHLKLSFDSSPDEVKKQYRKLSLLVHPDKCKHPQAQEAFAALAKAQQLLLDPQERGYILDQVTAAKEELRAKRKKELKKDSASKIKSLVDEGKYEEQFERSDEFQQQLIIKVREILTDKEWRRRKMQMRISEEEGRLKKDEEETKEMWKRKREHEEKWEETRDQRVSSWRDFMKTGKKGRKGEIKPPKLKTEDPNKSYVQRPVKRN

SEQ ID NO: 12693 - DNA, 1209 bp, Sorghum bicolor
  misc_feature: Ceres ANNOT ID no. 6108919
  misc_feature: Encodes the peptide sequence at SEQ ID NO 12694
atgggtaacgcgggtagcaacggtggaggcgccgccgctggtcaccgccgtcggagctccagccacggccatggccaccaccaccaggcgccgccgcctccccagccgcaggagactgcgcccaaccgctacgtgttcgcggccgccacgccgtatccgccccagtaccctaaccccaacccgccgcagtactacccgcagtacgggaactactacccgccgccgccgccatccgtgccggtgccccttccggcgccgtacgaccaccaccacaggccacccaccgccgcccccggcgagttcccgcccccgccccccgcccacccccaccactaccccggctgggctgggcggtatccctcctacggaccgcatctgcctatgccgacgccctacgttgagcaccagaaggctgtcactatccgcaacgacgtcaaccttaagaaggaaacgcttcggatcgagcctgatgaagagtgccctggccacttcctcgtcgccttcacctttgatgccaccgtcgccggcagcatgactgtttacttctttgcaaaggaagagctcaactgcaatctagcagcaatgaaagaagacctaattaagcccgttactgttagcttcaaagagggtcttggtcaaaaattcaggcaaccttcaggaacaggaattgacttttcagtgtttgaagaatcagatttattaaagcagggggacatggatgtatatccacttgtagttaaagctgaaacagcattgtctgctgatcacccatcagaaggggatgaccaaaagatgaaaactcctaactcacagatcacccaggcggtgtttgaaaagaaagaaaatggggattatcaagtaagagttgtttgccagatcctttgggtcaatggaactaggtatgaactgcaagaaatatatggcatagggaactccatggaaggtgatgctgatgcaaatgatccagggaaagaatgtgttatttgcctctcagagccaagggatactactgtcctcccatgtaggcatatgtgcatgtgcagtgagtgtgccaaggtcctgaggtaccaaaccactcggtgccccatctgcaggcagcctgttgagcgtctcctcgagatcaaagtgaacaacaaatctgaagagcagcagcagacgccccaatcgccaccgctcccagccccggctccgcagcaggaagaggtgtag

SEQ ID NO: 12694 - protein, 402 aa, Sorghum bicolor
  misc_feature: Ceres ANNOT ID no. 6108919
  misc_feature (326)..(364): Pfam Id: zf-C3HC4 Pfam Desc: Zinc finger, C3HC4 type (RING finger)
  misc_feature (3)..(390): NCBI GI: 115451977 NCBI Desc: os03g0254900 [oryza sativa (japonica cultivar-group)]
  misc_feature (43)..(379): NCBI GI: 87240953 NCBI Desc: zinc finger, ring-type [medicago truncatula]
  misc_feature (1)..(344): NCBI GI: 30681003 NCBI Desc: zinc finger (c3hc4-type ring finger) family protein [arabidopsis thaliana]
  misc_feature (10)..(382): NCBI GI: 30102494 NCBI Desc: at5g19080/t16g12_120 [arabidopsis thaliana]
  misc_feature (10)..(382): NCBI GI: 21928149 NCBI Desc: at5g19080/t16g12_120 [arabidopsis thaliana]
  misc_feature: The plant produces a reduced number of seeds.
  misc_feature: Useful for biocontainment applications
  misc_feature: Useful for making plants with altered alkaloid content
  misc_feature: Useful for making plants with altered terpenoid content
  misc_feature: Useful for making plants with modulated nitrogen use efficiency
  misc_feature: GREAT-hit functional homolog of the protein sequence given in SEQ ID NO 13151
  misc_feature: Functional homolog of the protein sequence given in SEQ ID NO 13201
  misc_feature: Functional homolog of the protein sequence given in SEQ ID NO 13279
  misc_feature: Useful for biocontainment applications
  misc_feature: Functional homolog of the protein sequence given in SEQ ID NO 13151
  misc_feature: Useful for making plants with altered alkaloid content
  misc_feature: Useful for making plants with altered terpenoid content
  misc_feature: Functional homolog of the protein sequence given in SEQ ID NO 13201
  misc_feature: Useful for making plants with modulated nitrogen use efficiency
  misc_feature: Functional homolog of the protein sequence given in SEQ ID NO 13279
MGNAGSNGGGAAAGHRRRSSSHGHGHHHQAPPPPQPQETAPNRYVFAAATPYPPQYPNPNPPQYYPQYGNYYPPPPPSVPVPLPAPYDHHHRPPTAAPGEFPPPPPAHPHHYPGWAGRYPSYGPHLPMPTPYVEHQKAVTIRNDVNLKKETLRIEPDEECPGHFLVAFTFDATVAGSMTVYFFAKEELNCNLAAMKEDLIKPVTVSFKEGLGQKFRQPSGTGIDFSVFEESDLLKQGDMDVYPLVVKAETALSADHPSEGDDQKMKTPNSQITQAVFEKKENGDYQVRVVCQILWVNGTRYELQEIYGIGNSMEGDADANDPGKECVICLSEPRDTTVLPCRHMCMCSECAKVLRYQTTRCPICRQPVERLLEIKVNNKSEEQQQTPQSPPLPAPAPQQEEV

SEQ ID NO: 12695 - DNA, 1428 bp, Sorghum bicolor
  misc_feature: Ceres ANNOT ID no. 6109049
  misc_feature: Encodes the peptide sequence at SEQ ID NO 12696
atgctagagaaccaaaagcaagcggaggttctctggccgcggctggtggccaacaagctcttccggaagacctcgggcagccacgccttcgtcgccgacttccctgccgccgatgacgacgacgacgacaacaacaacgtcgtctttggaacggagttcgacgacggcgggtgcagccccgacgcggacgccagccgctgcgtgaagcggccgcggccgcaggagcgcaacaagaccctcaagtacaagctgttcgcgagcacgtggaacgtcggcggcgtggcgccaccggacgatctggacctgtcggactggctggacggtggcgaggacgacgacgggccctacgacatgtacgtgctggggttgcaggaggtggtgccgctgcgcgcgcgcaacgtgctgggcgccgacaagaagcgcgtggggctgcggtggatcgagctcatccgcgccgcgctcaaccgccggtcgcactcgcagcggcagaggcagcagggagacggcagcggcaagcagaaggtgcacccggtccgggacggcgggcgcggcgagctggcctgcagggactaccggtgcgtggtgagcaagcagatggtgggcatcctgctcacggtgtgggtgcgctccgacctccgccgcttcgtccgccgccccagcgtctcctgcgtcggatgcggcgtcatgggctgcctcggcaacaagggtgccgtgtccgtccggttctggctgcacgacacgagcttctgcttcgtgtgctgccacctcgcgtcgggcgggcgcgagggcgacgaggcgcaccgcaacgccgacgccacggagatcctctcccggacgaccttcccgcgggggcacgcgctcaacttgccgctgccgcacaagattctagaccacgaccgagtgatcctgctcggggacctcaactacaggatctccctgccggaggccaagacgaggctgctggtggagcggcaggactggaagacgctgctggagaacgaccagctgcgcgccgagctggtgtgccgcggcggcgcgttccagggctggagcgagggcgccatcaccttctccccgacctacaagtactaccccaactccgacgcctactacggctgcgccaccgccggccaaggccacaggagcaacaagcggcgcgcgccggcgtggtgcgaccgcatcctgtggcgcggcgcggggctgaggcagacccgctacggccgctgcgagtcccggctgtcggaccaccgccccgtccgcgccgtcttcacggtggaggtggacgctcccaggaacctcaactcgctcaggagcttcttcatgtccgagaggttcgacagggctggcagcaggagccccggcgccgccgaccagctgctccgcaaggacgacgtcgttaacagcgccagattcggagacactctttga

SEQ ID NO: 12696 - protein, 475 aa, Sorghum bicolor
  misc_feature: Ceres ANNOT ID no. 6109049
  misc_feature (84)..(423): Pfam Id: Exo_endo_phos Pfam Desc: Endonuclease/Exonuclease/phosphatase family
  misc_feature (5)..(447): NCBI GI: 92888214 NCBI Desc: inositol polyphosphate related phosphatase [medicago truncatula]
  misc_feature (69)..(426): NCBI GI: 49389208 NCBI Desc: inositol 1,4,5-trisphosphate 5-phosphatase-like protein [oryza sativa (japonica cultivar-group)]
  misc_feature (191)..(432): NCBI GI: 15220522 NCBI Desc: endonuclease/exonuclease/phosphatase family protein [arabidopsis thaliana]
  misc_feature (191)..(432): NCBI GI: 92883941 NCBI Desc: inositol polyphosphate related phosphatase [medicago truncatula]
  misc_feature (179)..(446): NCBI GI: 7523406 NCBI Desc: inositol-1, 4, 5-trisphosphate 5-phosphatase-like protein [arabidopsis thaliana]
  misc_feature (191)..(432): SWISSPROT Homolog: EC 3.1.3.56 Type I inositol-1,4,5-trisphosphate 5-phosphatase CVP2
MLENQKQAEVLWPRLVANKLFRKTSGSHAFVADFPAADDDDDDNNNVVFGTEFDDGGCSPDADASRCVKRPRPQERNKTLKYKLFASTWNVGGVAPPDDLDLSDWLDGGEDDDGPYDMYVLGLQEVVPLRARNVLGADKKRVGLRWIELIRAALNRRSHSQRQRQQGDGSGKQKVHPVRDGGRGELACRDYRCVVSKQMVGILLTVWVRSDLRRFVRRPSVSCVGCGVMGCLGNKGAVSVRFWLHDTSFCFVCCHLASGGREGDEAHRNADATEILSRTTFPRGHALNLPLPHKILDHDRVILLGDLNYRISLPEAKTRLLVERQDWKTLLENDQLRAELVCRGGAFQGWSEGAITFSPTYKYYPNSDAYYGCATAGQGHRSNKRRAPAWCDRILWRGAGLRQTRYGRCESRLSDHRPVRAVFTVEVDAPRNLNSLRSFFMSERFDRAGSRSPGAADQLLRKDDVVNSARFGDTL

SEQ ID NO: 12697 - DNA, 1119 bp, Sorghum bicolor
  misc_feature: Ceres ANNOT ID no. 6109112
  misc_feature: Encodes the peptide sequence at SEQ ID NO 12698
atgcgtctgcatgctgaggtgcgggatgagatggaagagagcgaggagggggctgtgatgtcttcggcggcgttgtcgccaatcatcggcgcggcggcgccggctccccggctagtggtgggctacgccctcacgaagaagaaggtcaagagcttcctccagcccaagctgctcctgctggcgaggaagaatggaatcagttttgtctcgattgatgagtctcttcccctctcagaacaaggcccttttgatgttattttacacaagattactaggaaggagtggcagcaggttctggaggactatcatgaagaacatccagaagttactgtccttgacccaccaaatgctatcaagcatctgaacaatcgacaatcaatgcttgaagaagtagctgatttgaacctgtcaaatttctatggagaagtttgtaccccacgacaactggtcattacggaagatccatcctctataccaactgctgtagctatggctggactaactttgcccttggttgccaagccattggttgttgatggaacatctaaaggtcacgaactataccttgcatatgatgaggcatccttgtcaatgcttgatccgcctctggttctacaggaattcataaaccatggcgggatcctctttaaggtgtatatcattggcgaaacaatacaggttgtccgcaggttctctcttcctgatgttaacacatatgacttactaaacaatgttggcgtctatcgattgccaagagtttcatgtgctgcagctagtgcggaggatgcagatcttgaccctcttattgcagagcttcctccaaggccacttctagagaaactgggcagggagcttcgtggccggctgggtttgagattgttcaatatagatatgattagagaacttggaaccaaagatcggtactacataattgatatcaactacttcccaggctacggtaaaatgccaggatatgagcgcatgttcacagacttcttactaagtcttgcacaaagcaagtacaaaagacataagcatagcataagccggaggcttgaggaagtcggcaagtcgcagtgtatgtgttcaaaagtggtggcacatgctggactggagtag

SEQ ID NO: 12698 - protein, 372 aa, Sorghum bicolor
  misc_feature: Ceres ANNOT ID no. 6109112
  misc_feature (31)..(335): Pfam Id: Ins134_P3_kin Pfam Desc: Inositol 1, 3, 4-trisphosphate 5/6-kinase
  misc_feature (1)..(343): NCBI GI: 33303695 NCBI Desc: inositol 1,3,4-trisphosphate 5/6-kinase [oryza sativa]
  misc_feature (1)..(343): NCBI GI: 78707605 NCBI Desc: inositol 1, 3, 4-trisphosphate 5/6-kinase [oryza sativa (japonica cultivar-group)]
  misc_feature (10)..(343): NCBI GI: 16323320 NCBI Desc: at4g08170/t12g13_10 [arabidopsis thaliana]
  misc_feature (9)..(346): NCBI GI: 42567363 NCBI Desc: inositol 1,3,4-trisphosphate 5/6-kinase family protein [arabidopsis thaliana]
  misc_feature (10)..(318): NCBI GI: 7267457 NCBI Desc: inositol 1, 3, 4-trisphosphate 5/6-kinase-like protein [arabidopsis thaliana]
MRLHAEVRDEMEESEEGAVMSSAALSPIIGAAAPAPRLVVGYALTKKKVKSFLQPKLLLLARKNGISFVSIDESLPLSEQGPFDVILHKITRKEWQQVLEDYHEEHPEVTVLDPPNAIKHLNNRQSMLEEVADLNLSNFYGEVCTPRQLVITEDPSSIPTAVAMAGLTLPLVAKPLVVDGTSKGHELYLAYDEASLSMLDPPLVLQEFINHGGILFKVYIIGETIQVVRRFSLPDVNTYDLLNNVGVYRLPRVSCAAASAEDADLDPLIAELPPRPLLEKLGRELRGRLGLRLFNIDMIRELGTKDRYYIIDINYFPGYGKMPGYERMFTDFLLSLAQSKYKRHKHSISRRLEEVGKSQCMCSKVVAHAGLE

SEQ ID NO: 12699 - DNA, 981 bp, Sorghum bicolor
  misc_feature: Ceres ANNOT ID no. 6109824
  misc_feature: Encodes the peptide sequence at SEQ ID NO 12700
atgggcgccggcctcctcctcggcgacgccgccagcctgggggcctaccacgccctacgccgccggaggacgcacctctaccgtcgcaactggggctccaagcccctgccgcgcccgccggtctggctcggcgcggccgctcgtgtttcacggaatcgcgacgaccgccgtggccacgtgcccaggttcgccgcctccgcctcgggcggccgtgacgagcccggggagctagccgaggacgaggcgcagaggaagagggagcgggaggcggagctgaatcgccgactgaaggaggccgaggagatggaggagttggagcgcaccgccgagcagctgcagagccaggccgccgccgaggcccccgaggagtcggaggaggagaagcgtgagcgtgtacgccgcgagctccagaaggtggcgaaggagcaggcggaaaggagggagacggcgaagcaaatgtttgaattggggcaaagggcctacgggaaaggaatgtatggacgctcaattgaattcttggaggctgcactcactatcatacgtccctcctctctcctcggtggcgagatccaaatttggcttgcaatggcatatgaagccaataggaggcacaaggattgcattgcattgtacaaagagttggagagtacccaccctatgatcaacatcagacggcaggcagctgaacttagatacattttagaggcacccaagttgaagatatcaaacgacgaggtggtcacaataccacaaattgggagcagctgggattggtatgctggaacatggagcgacaaaatcaaggaacaagaggacaagaaaagaaagatgattgctgctagcaaccaagttcaaccttctccaaacatctttggagacttctctttcttgcgactgccaagtgaatggaagaagagtgcatgggtgattgttactttgtgggtccttttgattggaacagcaatctatctgcaaacatga

SEQ ID NO: 12700 - protein, 326 aa, Sorghum bicolor
  misc_feature: Ceres ANNOT ID no. 6109824
  misc_feature (129)..(325): NCBI GI: 115453635 NCBI Desc: os03g0428800 [oryza sativa (japonica cultivar-group)]
  misc_feature (144)..(252): NCBI GI: 23130056 NCBI Desc: cog1219: atp-dependent protease clp, atpase subunit [nostoc punctiforme pcc 73102]
  misc_feature (51)..(163): NCBI GI: 730888 NCBI Desc: octapeptide-repeat protein t2
  misc_feature (71)..(160): NCBI GI: 124270795 NCBI Desc: polar residue rich protein-b16.1 [hyposoter fugitivus ichnovirus]
  misc_feature (78)..(193): NCBI GI: 82749716 NCBI Desc: bzip factor [human t-lymphotropic virus 1]
MGAGLLLGDAASLGAYHALRRRRTHLYRRNWGSKPLPRPPVWLGAAARVSRNRDDRRGHVPRFAASASGGRDEPGELAEDEAQRKREREAELNRRLKEAEEMEELERTAEQLQSQAAAEAPEESEEEKRERVRRELQKVAKEQAERRETAKQMFELGQRAYGKGMYGRSIEFLEAALTIIRPSSLLGGEIQIWLAMAYEANRRHKDCIALYKELESTHPMINIRRQAAELRYILEAPKLKISNDEVVTIPQIGSSWDWYAGTWSDKIKEQEDKKRKMIAASNQVQPSPNIFGDFSFLRLPSEWKKSAWVIVTLWVLLIGTAIYLQT

SEQ ID NO: 12701 - DNA, 1113 bp, Sorghum bicolor
  misc_feature: Ceres ANNOT ID no. 6109861
  misc_feature: Encodes the peptide sequence at SEQ ID NO 12702
atggaggccgccgccgccgtcctccccgcgctggtgccctccgggagcgcggtggtggtactcgtcgcctacctcgggtatctcgccgccgccggagccatcctcccggggaagctcgtcgatggagctatactctccgactcctcccgcctccactaccgttgcaacggtttgctctcgctcctgctgctgctggggctctcggcgttgggtgtctacatggggtggatgtctcccacggttgtagctgacaggggactcgaacttctgtcagtgaccttcatttttagtgtcattgtctctttcgcactctacttcgccggcatcaagtcccgccacaaaagttcttcttggagaccacatgttagtgggagcttcatacaagattggtggttgggagtgcagcttaatcctcattttatgggaattgacctcaaattcttttttgtgagggcaggaatgatggcatggttatttattaacctctctttgtttgcaaagagctacttagctggttcagctaatctttcggtcattctctaccaatttttttgtgcgtggtatattatagattacttcatccatgaagaattcatgacctcaacgtgggacattattgctgaaagactgggtttcatgctggtgtttggtgatctagttttcatccctttcaccttcactattcagggctggtggcttttgaggaacaaagtagagctgtcccttttggctggtctagctaacttatgcatcttccttatcggctacctagtgttccgaggagctaacaagcaaaaacatgtgttcaagaaggaccccaaagctcctatatggggaagacctcccaaagttgttgggggaaagctactcgcatctggttactggggcatcgcaaggcactgcaattatctaggagatctactgctagcgctttcatttagcttgccctgtggagtcagttccgtgatcccatacttctaccccacgtacctgctcattctactgatatggagggaaaggcgcgacgaggcgaggtgctcgcagaagtacagggagatctgggcagagtactgcaagctcgtgccctggaggatcctgccttatgtgtactga

SEQ ID NO: 12702 - protein, 370 aa, Sorghum bicolor
  misc_feature: Ceres ANNOT ID no. 6109861
  misc_feature (4)..(370): Pfam Id: ERG4_ERG24 Pfam Desc: Ergosterol biosynthesis ERG4/ERG24 family
  misc_feature (4)..(322): NCBI GI: 115436468 NCBI Desc: os01g0354200 [oryza sativa (japonica cultivar-group)]
  misc_feature (8)..(370): NCBI GI: 9714052 NCBI Desc: sterol c-14 reductase (fackel) [arabidopsis thaliana]
  misc_feature (8)..(370): NCBI GI: 22137270 NCBI Desc: at3g52940/f8j2_111 [arabidopsis thaliana]
  misc_feature (230)..(370): NCBI GI: 11358585 NCBI Desc: nuclear envelope membrane protein-like - arabidopsis thaliana
  misc_feature (8)..(231): NCBI GI: 42572649 NCBI Desc: c-14 sterol reductase / delta(14)-sterol reductase / fackel (fk) [arabidopsis thaliana]
  misc_feature (8)..(370): SWISSPROT Homolog: EC 1.3.1.70 Delta(14)-sterol reductase
MEAAAAVLPALVPSGSAVVVLVAYLGYLAAAGAILPGKLVDGAILSDSSRLHYRCNGLLSLLLLLGLSALGVYMGWMSPTVVADRGLELLSVTFIFSVIVSFALYFAGIKSRHKSSSWRPHVSGSFIQDWWLGVQLNPHFMGIDLKFFFVRAGMMAWLFINLSLFAKSYLAGSANLSVILYQFFCAWYIIDYFIHEEFMTSTWDIIAERLGFMLVFGDLVFIPFTFTIQGWWLLRNKVELSLLAGLANLCIFLIGYLVFRGANKQKHVFKKDPKAPIWGRPPKVVGGKLLASGYWGIARHCNYLGDLLLALSFSLPCGVSSVIPYFYPTYLLILLIWRERRDEARCSQKYREIWAEYCKLVPWRILPYVY

SEQ ID NO: 12703 - DNA, 1149 bp, Sorghum bicolor
  misc_feature: Ceres ANNOT ID no. 6110012
  misc_feature: Encodes the peptide sequence at SEQ ID NO 12704
atgggtctcccaccgacgctgcttatccttctatgtctgctggtgcttacggtgctgctgatgacgccggctgcagaggcagcgcgcaagcacagtcacagggccgccggcgatcatagtactgatgatactagcatcggcagcggcgtcggcggcggcagcaacgggtcgtttgcttcgccatcgccaacaacggcccagcagcagcagctgtgggtgtttggtgactcgtacgcggacaccgggaacctcggcgacctcgggcgggagctgacgcacgcgtggtacgacccctacggcgccaccttcccaggacgccccaccggccgcttctccgacggccgcgtcctcaccgacttcatagcttcggccatgagaatgccaacgccggtggcgtacaagctgcgccggggcgctgcccgcaggctgttggcgcgcggcatgaacttcgccgttggcggcgcgggcgtccttgacaccggcaacttccagcgcaatatcagcgcgcagatcgacctgttccaggcgcagcagcagcaccctgtggcggcagcagcccacggcaacggggtggcgctcgtcgtcgtctccggcaacgattactcctacgccgccgacaaggacaacagcacaagcgccgcgatcgcgtacatcccgacggtggtgcgcgagctcggggagcagctccggcggctgcgcgacgacgtcgggatgcgcagggtggtggtcaccaacctgcacccgctggggtgcacgccgctcttcacccaggcgctcaactacagcggctgcgacccgctggccaacgcgggagccgcgcagcacaacgcggcgctccagtccgtgctcgccgcgctcgacccggccaaccgcaccttcctcctcctcgacctcaacgcgcccttcgcggctttcgccgacgcgccagcggcggcaagcaggttcgctgagccgaggcgcccgtgctgcgagaccgccgccggcggatactgcggccagcaggacgacgacgggaggaggcagtacgcgctgtgcgacgaccccagcaaacacttctactgggacaacgtccaccccacgcaggccgcctgggccgcagtcgccgagacattcaggcccaagatccgcgagttcctactctccagttga

SEQ ID NO: 12704 - protein, 382 aa, Sorghum bicolor
  misc_feature: Ceres ANNOT ID no. 6110012
  misc_feature (71)..(371): Pfam Id: Lipase_GDSL Pfam Desc: GDSL-like Lipase/Acylhydrolase
  misc_feature (3)..(379): NCBI GI: 115480743 NCBI Desc: os09g0567800 [oryza sativa (japonica cultivar-group)]
  misc_feature (40)..(379): NCBI GI: 52077212 NCBI Desc: gdsl-lipase -like [oryza sativa (japonica cultivar-group)]
  misc_feature (70)..(373): NCBI GI: 145330374 NCBI Desc: hydrolase, acting on ester bonds [arabidopsis thaliana]
  misc_feature (72)..(372): NCBI GI: 115467232 NCBI Desc: os06g0229400 [oryza sativa (japonica cultivar-group)]
  misc_feature (71)..(361): NCBI GI: 30695607 NCBI Desc: gdsl-motif lipase/hydrolase family protein [arabidopsis thaliana]
MGLPPTLLILLCLLVLTVLLMTPAAEAARKHSHRAAGDHSTDDTSIGSGVGGGSNGSFASPSPTTAQQQQLWVFGDSYADTGNLGDLGRELTHAWYDPYGATFPGRPTGRFSDGRVLTDFIASAMRMPTPVAYKLRRGAARRLLARGMNFAVGGAGVLDTGNFQRNISAQIDLFQAQQQHPVAAAAHGNGVALVVVSGNDYSYAADKDNSTSAAIAYIPTVVRELGEQLRRLRDDVGMRRVVVTNLHPLGCTPLFTQALNYSGCDPLANAGAAQHNAALQSVLAALDPANRTFLLLDLNAPFAAFADAPAAASRFAEPRRPCCETAAGGYCGQQDDDGRRQYALCDDPSKHFYWDNVHPTQAAWAAVAETFRPKIREFLLSS

SEQ ID NO: 12705 - DNA, 1812 bp, Sorghum bicolor
  misc_feature: Ceres ANNOT ID no. 6110208
  misc_feature: Encodes the peptide sequence at SEQ ID NO 12706
atgaacgcatccaggaaatccaaccatgtttccagcaaggacagtgcagaaaccgcgagggatatcatcaccacgtccggccaaatccaacccctcaaaatcccagacgctgttgctgcgcttgcgcaggctgctgcaaaggcaaatggtgagactgagaaatatcttccagggtggccgttgttctcgcctcctaaggtgcagctggacaagtgtactaagtgttcgagagaattctgttccgcaatcaacttccggaggcatacacgtgttcatcgtagaaccctcaagatagatagggattttcccaagaatagagaccttctcgctgcattctggaataaactgactgtggatgatgccagcacaattttgtccttgacaggtgttgttgtagagggtgtaactggctcatcaattttaatagcactatcatcatggatgtgtaaaccagggtatgcttcattgccaatggcatatgccagagctggcagtgagcttctggatctgattcaaacaaaggctgcaatgcatctgcctgtgtcatcggatgaattatttagcttgctcgatgaagcaagcgagaaaacatttctttgcacaaatacagctgcttgtatacagaagtttttatttgacggagaggtagacaaaattgcaactgagttgaaaaatgttgtttcgtgcattagttacatgcttgaacaaaagctggttgaagcatggtgtgctgataagactgctgaagcattaagatgccagaagttgctggaggaggaagaggaagctgctcagaaaaggcaagccgaactgatggaaaggaagcggatgaagaaacttaggcagaaagaacagaggttaaaaaacctcaaggatgaggatgtgacagttcagtcacctgaaattatggatgatgcaacatgttctactgccattcaaagtgtcaagtccatttctgatcctgaccgttttgagcaagaagaatcacagtatcttcaatttccagcaccaattacttcagaaattgacaatggttttaatgtggacctatcagtagaagatatcagttgtgatttggggcttgaaatggataaaggtgttgtattaaggcaacacgtttcaaggcgtcgtttaggcagaacagagaggctcgctgaaaatagcattgtacctggtcctgtagttacttcaaagcatccagcttttgtgaggccttcaaattacaaggatccaaatgtctgttctacgccaagtagaaacaaatcttgcgcattgaaattgcaatctgagattgaagaacagtgccaaaaacatgagttagatgtagatgaacatggcatgggtcctagcaaaaactctcgtgtgctaataggatctataagtgttgcaattgaagatggtagtgaacacttgcaggacattcgttccaagaatgatccagtccctcctagttcaaagacagtgaaacatgcatcagtcaaggtgatgcaacctgttacccatgagggtaacagaaatgaaggcattcctcatagtgatagtaatagtacgccagcagctgagaactgttctcaatccagtgttactacagatgaaatcagttattcaacctactgcagtgcagatttggcagtggatgaacatttacaacgcaccatgttttccagtaaagaagcgacagcctttctttctcaaaggtggaaagaagcaatagctgcagatcatgtgaaacttggtgctatgaaagtttggaggtcaagtttgtgttgcggcatgagtgattgtaaaatggcgggtgcattttgcagctga

SEQ ID NO: 12706 - protein, 603 aa, Sorghum bicolor
  misc_feature: Ceres ANNOT ID no. 6110208
MNASRKSNHVSSKDSAETARDIITTSGQIQPLKIPDAVAALAQAAAKANGETEKYLPGWPLFSPPKVQLDKCTKCSREFCSAINFRRHTRVHRRTLKIDRDFPKNRDLLAAFWNKLTVDDASTILSLTGVVVEGVTGSSILIALSSWMCKPGYASLPMAYARAGSELLDLIQTKAAMHLPVSSDELFSLLDEASEKTFLCTNTAACIQKFLFDGEVDKIATELKNVVSCISYMLEQKLVEAWCADKTAEALRCQKLLEEEEEAAQKRQAELMERKRMKKLRQKEQRLKNLKDEDVTVQSPEIMDDATCSTAIQSVKSISDPDRFEQEESQYLQFPAPITSEIDNGFNVDLSVEDISCDLGLEMDKGVVLRQHVSRRRLGRTERLAENSIVPGPVVTSKHPAFVRPSNYKDPNVCSTPSRNKSCALKLQSEIEEQCQKHELDVDEHGMGPSKNSRVLIGSISVAIEDGSEHLQDIRSKNDPVPPSSKTVKHASVKVMQPVTHEGNRNEGIPHSDSNSTPAAENCSQSSVTTDEISYSTYCSADLAVDEHLQRTMFSSKEATAFLSQRWKEAIAADHVKLGAMKVWRSSLCCGMSDCKMAGAFCS

SEQ ID NO: 12707 - DNA, 2103 bp, Sorghum bicolor
  misc_feature: Ceres ANNOT ID no. 6110222
  misc_feature: Encodes the peptide sequence at SEQ ID NO 12708
atgggcgacgtcccagtcccagccccagctccccctgttcccgacatcgatatgaccccaagccgccgccgtgagccctccgagccccgcagcgacagcgactgggacgctggatccagtcgcgagggttctcccgacctcctccgccgcgcgcccgccgtgcagatctcgcgcgcctcctcttcctcgtcctcctggctccgcgagatcgagcgcgaccgtgtgcgcctcgtcagggagtgggtccacatggccgcccgcgaccgcgacgacgatgccgggcccccaccatcccccgtccctgaacacgcgcgcagggacgctccccggatccgtggccgccaggcgcgcctcgagctcgtcatgcgcatggccgccgaccgccaagccgagctccaccgtctctcgcagcaccgcgccgtctccgacttcccgcaccgcaacagaatccacgcgctgctccggggtcggtttctgcgcaatggcggcttgccggaggagaggagacccccatctgtggccgcaagggagcttggccagctgcgacaacgtcatcctgtctctggtttgagagaagagttccgcttcagattggagaatcttgtccgtggtcaagcagatagccaagtggaagcttcttcagctcgtgatgttgaattatctacaaatgatcgttctgaattaagaccttctgaaactactcaggagagacatgagtggacaagtgagaatataagtcttcagcaaattgacagtacggcaacaacatcaggatttgaaagtggcagccctagcattgctgaagtcttctgtggatctcatagtcaagcagaaagtcaggaagatttggaacatgacagaagagactggcaacaattttcccaggccgtgattggagaggaatctgaaagaagttggcatgacaatgcagacatctcttctcgtgaggggacagcagttgaagaggataataacgagcatcttccagaagcaaatgaagagtcaaccagtgttgatcatcttcctgaaggacttgaagagtccatcagcaatggtagtcttcctgaagcgcaagaagatcatcatgacagtgatcatcttcctgcagtgcttgaagagctgcatgacagtaatcactttcaggaatcacatggggaatggagcagagatgatcgtcctattgaagtctatgatgagtggcagagtgatgatcatctccctgaagtaaatgaagagtggcataacgatgacgagtctaatgatactgcagacaattggcatgataataattctgaccaaccaattgaccatgatgctgctcttattagaagagctaatacattcatccctggggatgatgataatgtgtacagcacagaattgagggaacttctaagcagaaggagcgtttctaaccttcttcacagtgcttttcgtgaaaacttggatcggcttatccggtcatatgttgaacggcaaggtcgtggtcctctcccttgggatctggaaggaacaactcctgcccctccctcaccagatcaaaatcaggagcagcaaagagatgatgaggatcaggaactgcagaacactgtgaacaggcctcctttagtgataccacctccacctatgcctcctcgtcagccactctggcattcagagttgcatcgtaataattggatcagacaaaacattcatcgttcatcttctgatattgaatgggaagccatcaatgatttaagagctgatatggctagacttcagcaaggcatgagccatatgcaaaggatgttggaagcttgcatggatatgcagctagagttgcagcgttctgtaaggcaggaagtatcagcagccttgaatcgtttcattggggagcaaggtggtgaaagtagagaaataattgacgatggttcgaaatggataaatgtgagaaaagggacctgctgcatatgctgtgagactccaattgactctcttctgtacagatgtgggcacatgtgcacatgctcgaaatgtgcgaacgaattggttcgaggtggagggaaatgcccgctgtgccgcgcacccataatcgaggtgatccgagcatacttcatcatgtag

SEQ ID NO: 12708 - protein, 700 aa, Sorghum bicolor
  misc_feature: Ceres ANNOT ID no. 6110222
  misc_feature (238)..(700): NCBI GI: 115480787 NCBI Desc: os09g0570500 [oryza sativa (japonica cultivar-group)]
  misc_feature (277)..(700): NCBI GI: 48716309 NCBI Desc: ubiquitin-protein ligase-like [oryza sativa (japonica cultivar-group)]
  misc_feature (523)..(697): NCBI GI: 115472235 NCBI Desc: os07g0499800 [oryza sativa (japonica cultivar-group)]
  misc_feature (642)..(698): NCBI GI: 4926833 NCBI Desc: t17h7.18 [arabidopsis thaliana]
  misc_feature (636)..(697): NCBI GI: 535314 NCBI Desc: neuralized protein [drosophila virilis]
MGDVPVPAPAPPVPDIDMTPSRRREPSEPRSDSDWDAGSSREGSPDLLRRAPAVQISRASSSSSSWLREIERDRVRLVREWVHMAARDRDDDAGPPPSPVPEHARRDAPRIRGRQARLELVMRMAADRQAELHRLSQHRAVSDFPHRNRIHALLRGRFLRNGGLPEERRPPSVAARELGQLRQRHPVSGLREEFRFRLENLVRGQADSQVEASSARDVELSTNDRSELRPSETTQERHEWTSENISLQQIDSTATTSGFESGSPSIAEVFCGSHSQAESQEDLEHDRRDWQQFSQAVIGEESERSWHDNADISSREGTAVEEDNNEHLPEANEESTSVDHLPEGLEESISNGSLPEAQEDHHDSDHLPAVLEELHDSNHFQESHGEWSRDDRPIEVYDEWQSDDHLPEVNEEWHNDDESNDTADNWHDNNSDQPIDHDAALIRRANTFIPGDDDNVYSTELRELLSRRSVSNLLHSAFRENLDRLIRSYVERQGRGPLPWDLEGTTPAPPSPDQNQEQQRDDEDQELQNTVNRPPLVIPPPPMPPRQPLWHSELHRNNWIRQNIHRSSSDIEWEAINDLRADMARLQQGMSHMQRMLEACMDMQLELQRSVRQEVSAALNRFIGEQGGESREIIDDGSKWINVRKGTCCICCETPIDSLLYRCGHMCTCSKCANELVRGGGKCPLCRAPIIEVIRAYFIM

SEQ ID NO: 12709 - DNA, 1572 bp, Sorghum bicolor
  misc_feature: Ceres ANNOT ID no. 6110354
  misc_feature: Encodes the peptide sequence at SEQ ID NO 12710
atggcgagacgccttctctcccgcgcccgcctcattaagctcgaccgccccatcctacctcccgcgctcacccgcctactttcccgccgaccgcccactccgacgactagcgaatcggaggacaagggcaaaaaagcggcggcggcggcggctgtcctggtggaggcggccgccacgaaccgcagagaggacgcggaggtcgggagggatgggtcggaggaggacgacgaggacgccggcctcccgtggaggagctggaggccggacgtcgcgtggctctccaaggcgctcgagcccgcactggacctctacaagcaatatagctggaagcctttcgcgtcttctggtcgtgcggagaacatccctgcaagcactcggacatttagcgagattctaagtgaccttcagcgaagtaagataagcatacaggactggagcctcagtgatctcaccgttggcctgtacctcatttatctcagccaagcatcctcaaaaaacgaaactttcaagggagttcagatatcctccaataagatggttcaagaactaatttaccaccttgaacttgcaagaggctgttataaaggtaatgcaaatggacttgcaaggtatagcatgcttcggaagagaaatgttgtaaagtttgtgaaagattctagtattttgagacctggatattacattggcattgacccgcgagctaagttggtgattcttgggattcgcgggactcatacagtctatgatcttgttactgatttgattgctctaagcgataagaaagtatcacctaaaggtttctcaacacactttggaacatatgaggcagctcgttggtaccttcgccatgagttgggtataatcagaaaatgtttggaaaaacacaaggtgaggagtttgaagcaggactacaagttacggttggtaggtcactcccttggaggagcatcggcggcattgcttgctataatgctacggaagaagtcaaaggaagagcttggtttcagtccggacattatttctgccgttggatttggaacaccaccttgcatatcaaaggaagctgcagaaagttgtgcaggctatgtctctactgttgtgctccaggatgatattatacctaggctcagtgcagcttctttggcaagactgcgaaatgaaatactcaaaacagattgggtaagtgttctggaaaaggaagacttgaagcatatagtggatatcgtgactaatgctaagcttgttgtttcgtcaattcaagatgtggcgcgtaaacttggtgattatgctaaaattgtatcagtgtcaacaaattatgatagtagaaatgatgtgtttgtgcctgaggatctcttccttcctgggactctgtattacctgcagagggatattgaggatataaacggcgttgaagatgagtcatacatgctctggaaaggtgatccaggggaaaattttcagaggatattgctgtctggtaatttgatatctgatcacagatgcgaaagcatatactacgctctgagagatgtgctcaagacactgcccccatcccaggcccaggatgaatga

SEQ ID NO: 12710 - protein, 523 aa, Sorghum bicolor
  misc_feature: Ceres ANNOT ID no. 6110354
  misc_feature (238)..(381): Pfam Id: Lipase_3 Pfam Desc: Lipase (class 3)
  misc_feature (38)..(430): NCBI GI: 42569869 NCBI Desc: lipase class 3 family protein [arabidopsis thaliana]
  misc_feature (156)..(458): NCBI GI: 115480801 NCBI Desc: os09g0571500 [oryza sativa (japonica cultivar-group)]
  misc_feature (115)..(407): NCBI GI: 47497398 NCBI Desc: lipase class 3 protein-like [oryza sativa (japonica cultivar-group)]
  misc_feature (115)..(404): NCBI GI: 27764916 NCBI Desc: at3g14070/mag2_2 [arabidopsis thaliana]
  misc_feature (117)..(418): NCBI GI: 22328699 NCBI Desc: lipase class 3 family protein [arabidopsis thaliana]
MARRLLSRARLIKLDRPILPPALTRLLSRRPPTPTTSESEDKGKKAAAAAAVLVEAAATNRREDAEVGRDGSEEDDEDAGLPWRSWRPDVAWLSKALEPALDLYKQYSWKPFASSGRAENIPASTRTFSEILSDLQRSKISIQDWSLSDLTVGLYLIYLSQASSKNETFKGVQISSNKMVQELIYHLELARGCYKGNANGLARYSMLRKRNVVKFVKDSSILRPGYYIGIDPRAKLVILGIRGTHTVYDLVTDLIALSDKKVSPKGFSTHFGTYEAARWYLRHELGIIRKCLEKHKVRSLKQDYKLRLVGHSLGGASAALLAIMLRKKSKEELGFSPDIISAVGFGTPPCISKEAAESCAGYVSTVVLQDDIIPRLSAASLARLRNEILKTDWVSVLEKEDLKHIVDIVTNAKLVVSSIQDVARKLGDYAKIVSVSTNYDSRNDVFVPEDLFLPGTLYYLQRDIEDINGVEDESYMLWKGDPGENFQRILLSGNLISDHRCESIYYALRDVLKTLPPSQAQDE

SEQ ID NO: 12711 - DNA, 507 bp, Sorghum bicolor
  misc_feature: Ceres ANNOT ID no. 6111485
  misc_feature: Encodes the peptide sequence at SEQ ID NO 12712
atgcaggagcagccggcgagctcgcggccttccagcagcgagaggtcgtctagctccgcgcaccacatggacatggaggtcaaggaagggatggagagcgacgaggagataaggagagtgccggagctgggcctggagctgccgggagcttccacgtcgggcagggaggttggcccgggcgccgccggcgcagaccgcgccctggcccagtcgtccacggcgcaggccagcgcgcgccgccgcgtccgcagccccgccgacaaggagcacaagcgcctcaaaagattactgaggaaccgggtgtcagctcaacaggcaagagagaggaagaaggcttatttgactgatctggaggtgaaggtgaaggacctggagaagaagaactcggagatggaagagaggctctccaccctccagaacgagaaccagatgctccgacagatactgaagaacaccactgtaagcagaagaggttcaggaagcactgctagtggagagggccaatag

SEQ ID NO: 12712 - protein, 168 aa, Sorghum bicolor
  misc_feature: Ceres ANNOT ID no. 6111485
  misc_feature (87)..(150): Pfam Id: bZIP_1 Pfam Desc: bZIP transcription factor
  misc_feature (87)..(141): Pfam Id: bZIP_2 Pfam Desc: Basic region leucine zipper
  misc_feature (30)..(158): NCBI GI: 115444913 NCBI Desc: os02g0203000 [oryza sativa (japonica cultivar-group)]
  misc_feature (1)..(166): NCBI GI: 2251085 NCBI Desc: hy5 [arabidopsis thaliana]
  misc_feature (1)..(153): NCBI GI: 6018699 NCBI Desc: thy5 protein [lycopersicon esculentum]
  misc_feature (2)..(161): NCBI GI: 2934884 NCBI Desc: tgacg-motif binding factor [glycine max]
  misc_feature (6)..(161): NCBI GI: 2934885 NCBI Desc: tgacg-motif-binding factor [glycine max]
  misc_feature: The sequence is a functional homolog of SEQ ID NO 1363 in the 10/374,780US patent application
  misc_feature: The sequence is a functional homolog of SEQ ID NO 1364 in the 10/374,780US patent application
  misc_feature: The sequence is a functional homolog of SEQ ID NO 1483 in the 10/412,699US patent application
  misc_feature: The sequence is a functional homolog of SEQ ID NO 20 in the 10/225,066US patent application
  misc_feature: The sequence is a functional homolog of SEQ ID NO 206 in the 10/225,066US patent application
  misc_feature: The sequence is a functional homolog of SEQ ID NO 2356 in the 10/374,780US patent application
  misc_feature: The sequence is a functional homolog of SEQ ID NO 2844 in the 10/374,780US patent application
  misc_feature: The sequence is a functional homolog of SEQ ID NO 827 in the 11/479,226US patent application
  misc_feature: The sequence is a functional homolog of SEQ ID NO 933 in the 10/374,780US patent application
  misc_feature: Useful for making plants with modulated growth and phenotype characteristics
  misc_feature: The sequence is a functional homolog of SEQ ID NO 1483 in the 20040045049 US patent application
  misc_feature: The sequence is a functional homolog of SEQ ID NO 20 in the 20050160493 US patent application
  misc_feature: The sequence is a functional homolog of SEQ ID NO 206 in the 20050160493 US patent application
  misc_feature: The sequence is a functional homolog of SEQ ID NO 933 in the 20060162006 US patent application
  misc_feature: The sequence is a functional homolog of SEQ ID NO 206 in the 10/225,066 US patent application
  misc_feature: The sequence is a functional homolog of SEQ ID NO 2356 in the 10/374,780 US patent application
  misc_feature: The sequence is a functional homolog of SEQ ID NO 827 in the 11/479,226 US patent application
  misc_feature: Useful for making plants with modulated light quality sensitivity
  misc_feature: The sequence is a functional homolog of SEQ ID NO. 337 in the 11/188,298 US application
  misc_feature: The sequence is a functional homolog of SEQ ID NO. 512 in the 11/188,298 US application
MQEQPASSRPSSSERSSSSAHHMDMEVKEGMESDEEIRRVPELGLELPGASTSGREVGPGAAGADRALAQSSTAQASARRRVRSPADKEHKRLKRLLRNRVSAQQARERKKAYLTDLEVKVKDLEKKNSEMEERLSTLQNENQMLRQILKNTTVSRRGSGSTASGEGQ

SEQ ID NO: 12713 - DNA, 684 bp, Sorghum bicolor
  misc_feature: Ceres ANNOT ID no. 6111566
  misc_feature: Encodes the peptide sequence at SEQ ID NO 12714
atgggaggtgtaatgagtggtgactcgccaaggcacagctcaccggcatcgaagttagagaagaagatggttgaagccatgaagcagagagcattaaaaggaacctctatgaaatcattcaatagtgtcatcatgaaatttcctaaaatcgacgagaatttgagaaactgcaggactatctttcagcaatttgatgaagattccaatggtgaaatagatcaactggaactcaagcattgtttccaaaagttaggcatcgaatcaaccgatgaggagataaaagctctgtttcaggcatgtgacatttatgaacacatgggcatgaagttcaatgagtttatcgtcttcctgtgtcttgtttatcttctaaatgatcctgcagtgtctgaaagaaaaagaatgggattaggtaaccttgaaccaacatttgagacattggtcgagtcatttgtcttcttggacaagaacaaagatgggtatgtcagtaaaagtgagatgatacaagcaataaatgagaccattggaggagagcgctcttctgggcgcataggcgtgaaaagatttgaggaaatggattgggacaagaatggaacagtgaccttcaaggaattccttttcgcttttactcgctgggtggggatcgataatgaagacgacgacgaggacgatgaagaagcagcatga

SEQ ID NO: 12714 - protein, 227 aa, Sorghum bicolor
  misc_feature: Ceres ANNOT ID no. 6111566
  misc_feature (56)..(84): Pfam Id: efhand Pfam Desc: EF hand
  misc_feature (145)..(173): Pfam Id: efhand Pfam Desc: EF hand
  misc_feature (1)..(224): NCBI GI: 49388350 NCBI Desc: calcium-binding ef hand-like protein [oryza sativa (japonica cultivar-group)]
  misc_feature (1)..(223): NCBI GI: 62867639 NCBI Desc: at4g26470 [arabidopsis thaliana]
  misc_feature (12)..(224): NCBI GI: 48095044 NCBI Desc: similar to cg11638-pa [apis mellifera]
  misc_feature (51)..(205): NCBI GI: 1945533 NCBI Desc: fast skeletal troponin c alpha [xenopus laevis]
  misc_feature (51)..(205): NCBI GI: 2589014 NCBI Desc: troponin c [lethenteron japonicum]
MGGVMSGDSPRHSSPASKLEKKMVEAMKQRALKGTSMKSFNSVIMKFPKIDENLRNCRTIFQQFDEDSNGEIDQLELKHCFQKLGIESTDEEIKALFQACDIYEHMGMKFNEFIVFLCLVYLLNDPAVSERKRMGLGNLEPTFETLVESFVFLDKNKDGYVSKSEMIQAINETIGGERSSGRIGVKRFEEMDWDKNGTVTFKEFLFAFTRWVGIDNEDDDEDDEEAA

SEQ ID NO: 12715 - DNA, 1377 bp, Sorghum bicolor
  misc_feature: Ceres ANNOT ID no. 6111590
  misc_feature: Encodes the peptide sequence at SEQ ID NO 12716
atgggggataggacatggcagcaaccacatgagcagcctcaagcttacccagacgcagggacgatggtccaagcttcatcctcctccgtccatggcagcatcatagagaatgtcatgctcagaaaggaacctggaggcggatatgacatggccgaattcgatcaagcgctcttcctctatcttaacagccaggatcaagcatcagttattcaagatcaacctcaaactctcaacatcttcccttctcagccaatgcacgtcgtcgagcctgcaccaaagggaggatccatgggaactaacaacacggcatcgaacgccgccgccgtcgctggctcgtcgtccaagcagcagcagcagccgccgccgccgccgccaccgccaaataaggacggcggcaagccggccgccgtcaagagagaagggagcggcggcggcgccgccatgggaagcgggacgccatcgacgtcgaataatcgacaggagggccgccccaggacttcagacgccaagacgctaagaaggctcgcgcagaacagggaggccgccaggaaaagcaggctcagaaagaagaacctagagacaagcaggattaggctgacccagctggagcaagacttacactacagatccagaactcaggaggagcacggcaagatgatgcgccacctgcgggcggcgctggaggcggagcacgcggcgtcggcggcgtcgacgtctacggcggcggaggcacagctcctccggcagctggtggacgcggccgcggcgcaccacggcgtgctggcggagctgaaggccgtggcggcgagggccgacgcgttccacctcgtgtccggcgcgtgggcgtccgccgccgagcgctgcttcctctggatcggcggcttccgcccttcagagctcatcaagatagcggcccggcacgcggagcccctgacggagcagcaggcgatgggcgtctgcggcgtgcagcagtgggcgagggacgcggaggcggcgctggaccacgagctgcaggcgatgcaccgctccgtctcggaggccgtctcctccgacgcggcggcgctgctctgcccctactccgacgtgcccggcttcatggccaccatgtccctcgccatcagcaagctcgcctccctcgaagccttcgtcagacaagcggacgcgcttaggctgcaggcgctgcaccggctgccgcagatcctgacggcgcggcagtcggcgcggtgcttcctcgccatcgccgactactcccaccgcctccgtgcgctcagcgaactctggcacacccggccaggccaagatccagcggcgagcaacctggcggccgggcccagcagccagagaccgccctaccaaagtagggacggtttactatag

SEQ ID NO: 12716 - protein, 458 aa, Sorghum bicolor
  misc_feature: Ceres ANNOT ID no. 6111590
  misc_feature (205)..(435): NCBI GI: 115479881 NCBI Desc: os09g0489500 [oryza sativa (japonica cultivar-group)]
  misc_feature (205)..(434): NCBI GI: 30681632 NCBI Desc: bzip family transcription factor [arabidopsis thaliana]
  misc_feature (205)..(434): NCBI GI: 145334313 NCBI Desc: bzip family transcription factor [arabidopsis thaliana]
  misc_feature (205)..(434): NCBI GI: 14329655 NCBI Desc: bzip transcription factor [arabidopsis thaliana]
  misc_feature (179)..(434): NCBI GI: 115464157 NCBI Desc: os05g0443900 [oryza sativa (japonica cultivar-group)]
  misc_feature: The sequence is a functional homolog of SEQ ID NO 114 in the 10/666,642US patent application
  misc_feature: The sequence is a functional homolog of SEQ ID NO 1496 in the 10/374,780US patent application
  misc_feature: The sequence is a functional homolog of SEQ ID NO 1498 in the 10/374,780US patent application
  misc_feature: The sequence is a functional homolog of SEQ ID NO 156 in the 10/412,699US patent application
  misc_feature: The sequence is a functional homolog of SEQ ID NO 1566 in the 10/412,699US patent application
  misc_feature: The sequence is a functional homolog of SEQ ID NO 1568 in the 10/412,699US patent application
  misc_feature: The sequence is a functional homolog of SEQ ID NO 164 in the 10/412,699US patent application
  misc_feature: The sequence is a functional homolog of SEQ ID NO 1754 in the 10/412,699US patent application
  misc_feature: The sequence is a functional homolog of SEQ ID NO 1978 in the 10/374,780US patent application
  misc_feature: The sequence is a functional homolog of SEQ ID NO 2362 in the 10/374,780US patent application
  misc_feature: The sequence is a functional homolog of SEQ ID NO 353 in the 11/479,226US patent application
  misc_feature: The sequence is a functional homolog of SEQ ID NO 369 in the 11/479,226US patent application
  misc_feature: The sequence is a functional homolog of SEQ ID NO 376 in the 10/412,699US patent application
  misc_feature: The sequence is a functional homolog of SEQ ID NO 40 in the 10/374,780US patent application
  misc_feature: The sequence is a functional homolog of SEQ ID NO 608 in the 10/225,066US patent application
  misc_feature: The sequence is a functional homolog of SEQ ID NO 776 in the 10/225,066US patent application
  misc_feature: The sequence is a functional homolog of SEQ ID NO 848 in the 11/435,388US patent application
  misc_feature: The sequence is a functional homolog of SEQ ID NO 871 in the 11/479,226US patent application
  misc_feature: Useful for making plants with modulated growth and phenotype characteristics
  misc_feature: The sequence is a functional homolog of SEQ ID NO 156 in the 20040045049 US patent application
  misc_feature: The sequence is a functional homolog of SEQ ID NO 1566 in the 20040045049 US patent application
  misc_feature: The sequence is a functional homolog of SEQ ID NO 1568 in the 20040045049 US patent application
  misc_feature: The sequence is a functional homolog of SEQ ID NO 376 in the 20040045049 US patent application
MGDRTWQQPHEQPQAYPDAGTMVQASSSSVHGSIIENVMLRKEPGGGYDMAEFDQALFLYLNSQDQASVIQDQPQTLNIFPSQPMHVVEPAPKGGSMGTNNTASNAAAVAGSSSKQQQQPPPPPPPPNKDGGKPAAVKREGSGGGAAMGSGTPSTSNNRQEGRPRTSDAKTLRRLAQNREAARKSRLRKKNLETSRIRLTQLEQDLHYRSRTQEEHGKMMRHLRAALEAEHAASAASTSTAAEAQLLRQLVDAAAAHHGVLAELKAVAARADAFHLVSGAWASAAERCFLWIGGFRPSELIKIAARHAEPLTEQQAMGVCGVQQWARDAEAALDHELQAMHRSVSEAVSSDAAALLCPYSDVPGFMATMSLAISKLASLEAFVRQADALRLQALHRLPQILTARQSARCFLAIADYSHRLRALSELWHTRPGQDPAASNLAAGPSSQRPPYQSRDGLL

SEQ ID NO: 12717 - DNA, 1062 bp, Sorghum bicolor
  misc_feature: Ceres ANNOT ID no. 6111598
  misc_feature: Encodes the peptide sequence at SEQ ID NO 12718
atggcgggggagcggggggagagcagcggcgagcggcaggggacggtggagcggcggatgctgcggtcgcggtaccacgccgtgaagagcctcatcagcgatgagcgggatgagatggcgagggcggattcggacaggttcacggccatcatccagcaggtggattgcctgcacgagctcgtgcaaaagcccagggagcaaattgcggatgcagaagctctgcttggcattgcaagcactttggtaacttcggtgaggtcccagtcaagtgaaggaatcaccccttctgatttcataacagctttactcaagaagtttgggcagcaagggagccttgatgatgaggctgtctcattgcaatggggtgatctcgggctttctgtttcacatatcttcaggcctatgcctggatgctgtaccatgcttggtcctatggatactgaagtaaagcaacggaaagttgcggctgttggtagaaaacggactgcacggccaacagaaaatacttgtcctgaagagcttgctgattcttcagaggaagtaaagtcagacactgacaggaatgtcttagttatttttgatgtcctgaggcgaaagaagagtgcaaagcttgaaaaccttgttttgaataggctttcatttgcccaaacagttgaaaatatttttgcactgtctttcttagtgaaagatggtagggtggaaataaatatagatgacaacgggcatcatatagtacgtccaaggaatgcacctgctgctagtgccatagcctccggagaagtctcctacagtcattttgttttcagatttgatttcaaagactggaagcttatgaaagaagctgtcaaggagggggaagagttgttgccacacaggacttcccagagcgctctttgcaatgaagagaattatcaaccaaatatggaggcacgtgcgcaagtaacacctatcaggaaactctcccggaaccgaggcttgatcttacaggataatgtagttgaggaaactcctgaggagaaccaagcgtctaagcgcaggcgccttttcagagatcaagattga

SEQ ID NO: 12718 - protein, 353 aa, Sorghum bicolor
  misc_feature: Ceres ANNOT ID no. 6111598
  misc_feature (13)..(292): Pfam Id: Nse4 Pfam Desc: Nse4
  misc_feature (58)..(245): NCBI GI: 115444795 NCBI Desc: os02g0194300 [oryza sativa (japonica cultivar-group)]
  misc_feature (15)..(304): NCBI GI: 51035841 NCBI Desc: rad62 [schizosaccharomyces pombe]
  misc_feature (131)..(290): NCBI GI: 44984210 NCBI Desc: afl198wp [eremothecium gossypii]
  misc_feature (131)..(290): NCBI GI: 45198323 NCBI Desc: afl198wp [eremothecium gossypii]
  misc_feature (150)..(279): NCBI GI: 38382955 NCBI Desc: chromosome 10 open reading frame 86 [homo sapiens]
MAGERGESSGERQGTVERRMLRSRYHAVKSLISDERDEMARADSDRFTAIIQQVDCLHELVQKPREQIADAEALLGIASTLVTSVRSQSSEGITPSDFITALLKKFGQQGSLDDEAVSLQWGDLGLSVSHIFRPMPGCCTMLGPMDTEVKQRKVAAVGRKRTARPTENTCPEELADSSEEVKSDTDRNVLVIFDVLRRKKSAKLENLVLNRLSFAQTVENIFALSFLVKDGRVEINIDDNGHHIVRPRNAPAASAIASGEVSYSHFVFRFDFKDWKLMKEAVKEGEELLPHRTSQSALCNEENYQPNMEARAQVTPIRKLSRNRGLILQDNVVEETPEENQASKRRRLFRDQD

SEQ ID NO: 12719 - DNA, 804 bp, Sorghum bicolor
  misc_feature: Ceres ANNOT ID no. 6111602
  misc_feature: Encodes the peptide sequence at SEQ ID NO 12720
  misc_feature: Up-regulated in shoot tissues in response to methyl jasmonate treatment
  misc_feature: Up-regulated in root tissues in response to methyl jasmonate treatment
atggcagcaatgaataccgatatgggaggcttaggtggcaggccgacaaatcaacaagcaaatccttttggaactgccttgcatggtgctgggccaggactgatccgtactgggctagaagcatatggggggaggtttttagattcaagttctgagtttatgcagagcaatataacacaatatttgtccgaccctcagtactactttcaagtcaacagccagtatgtgaggaacaaactgaaggtcatcttgttccctttcttgcacaggggtcactggacaagaataactgaaccagtaggaggaaggctgtcctacaaacctccagtccaggatatcaatgcaccggacttgtacatccctttgatggcatttggcacctacattgtagttgctgggtacgccttgggtgttcttggaaggtttacccctgaggcactgaccctacagttctctaaagggatacttggctggtttctgcaagtcatcctcatcaaaggtctgctctactccctgggcagcagtgaagctccattgctggacattgtggcatatgctggatatggtttcgctggcacttcccttgcaatgctggcccgcatcttctggagctatctgtattacttcatcatgccatggttctgcatctgcacgggagtcttccttgtgaagaccatgaagagggttcttctgggcgggccaaggagctacgagagacaccccagccggaaccactacttcctgctcttcttggcggttgtgcaattccctatgctgttctggctcggcaacatcagtggctga

SEQ ID NO: 12720 - protein, 267 aa, Sorghum bicolor
  misc_feature: Ceres ANNOT ID no. 6111602
  misc_feature (34)..(263): Pfam Id: YIF1 Pfam Desc: YIF1
  misc_feature (1)..(267): NCBI GI: 115468982 NCBI Desc: os06g0620600 [oryza sativa (japonica cultivar-group)]
  misc_feature (12)..(265): NCBI GI: 38346458 NCBI Desc: osjnba0019g23.6 [oryza sativa (japonica cultivar-group)]
  misc_feature (12)..(265): NCBI GI: 90265113 NCBI Desc: h0806h05.8 [oryza sativa (indica cultivar-group)]
  misc_feature (4)..(266): NCBI GI: 30695009 NCBI Desc: integral membrane hrf1 family protein [arabidopsis thaliana]
  misc_feature (17)..(266): NCBI GI: 33589682 NCBI Desc: at3g59500 [arabidopsis thaliana]
  misc_feature: Up-regulated in shoot tissues in response to methyl jasmonate treatment
  misc_feature: Up-regulated in root tissues in response to methyl jasmonate treatment
MAAMNTDMGGLGGRPTNQQANPFGTALHGAGPGLIRTGLEAYGGRFLDSSSEFMQSNITQYLSDPQYYFQVNSQYVRNKLKVILFPFLHRGHWTRITEPVGGRLSYKPPVQDINAPDLYIPLMAFGTYIVVAGYALGVLGRFTPEALTLQFSKGILGWFLQVILIKGLLYSLGSSEAPLLDIVAYAGYGFAGTSLAMLARIFWSYLYYFIMPWFCICTGVFLVKTMKRVLLGGPRSYERHPSRNHYFLLFLAVVQFPMLFWLGNISG

SEQ ID NO: 12721 - DNA, 1188 bp, Sorghum bicolor
  misc_feature: Ceres ANNOT ID no. 6111734
  misc_feature: Encodes the peptide sequence at SEQ ID NO 12722
atgatccaccttcggaagcgcatcgtctccctcctcccccggacaccaacccgcgtcccttgcccccacaactccccgctcttctatccccaccgccttctctccgccaccaaatgcgtcgctacaactacaaaccagttcgccgtcgaggactacctcgtcgccacctgcggcctcacccgagcacaggcgctcaaggcgtcgttgagaatctcccatctgaaggacgcctcgaggcccgacgcggtcgtggccttcctctccaacctcggtctctccagcgccgaggtcaccgctgtcgtcaccagggaccccaaggtcctctgctccgacgtggaacgaaccctcaccgcccgcgtcgccgagctcaccgacctcgggctgtcacgtccggagatcatccgcctcctcatcgttggcatgaaccacttccgccacggctcgcttcgcctcaatgttgagttttggatctcggtctttggctccctagacgagctcatgcgggtgctcagaattaacaacgttctcctcagcaaaaacattgagaaggtgtgcaagcccaacttggcgctcattcagaaatgtggtatagatgtttctgagatccccaaaagcttcatgtcccgggtgctcaccgtggaccctaagaggctgctggaagctttggctcaccttcatgagtatagaatccagcagggctcgcaattgttcatccgcgggctctatacatttgcgatccttggcagtgagaagataaccaagaggatacagctgtttgagaagcttggatggtcaaaggatcatatagtatcagcggtaaagagtgacccaaatatattgggtttcaccgaggaaagggttcgaagaagcatggaattcttgatcggggtcgttggattggaggtacaatacattgcacaaaggccagcactgataacttgtagcattgaccgacggttgctgccacggaactgtctgatgaattttctcagggcaaaggggctgttcaatgacaagcctaccttcttttctgttgcctctttaagcgataagaaatttcgacgtcgatacgtgcatccttacgaggagagatttccaggccttgctgctgcttttgcttctagcagtgctggagaacaccaatgggaacggctatataagatgacaggcgaaaatagagagagctga

SEQ ID NO: 12722 - protein, 395 aa, Sorghum bicolor
  misc_feature: Ceres ANNOT ID no. 6111734
  misc_feature (34)..(355): Pfam Id: mTERF Pfam Desc: mTERF
  misc_feature (1)..(387): NCBI GI: 51536063 NCBI Desc: mitochondrial transcription termination factor-like [oryza sativa (japonica cultivar-group)]
  misc_feature (1)..(379): NCBI GI: 51536067 NCBI Desc: mitochondrial transcription termination factor-like [oryza sativa (japonica cultivar-group)]
  misc_feature (3)..(379): NCBI GI: 51536066 NCBI Desc: mitochondrial transcription termination factor-like [oryza sativa (japonica cultivar-group)]
  misc_feature (3)..(356): NCBI GI: 115467180 NCBI Desc: os06g0224500 [oryza sativa (japonica cultivar-group)]
  misc_feature (1)..(379): NCBI GI: 115467186 NCBI Desc: os06g0224900 [oryza sativa (japonica cultivar-group)]
  misc_feature: Useful for making plants with altered alkaloid content
  misc_feature: Useful for making plants with altered terpenoid content
  misc_feature: Functional homolog of the protein sequence given in SEQ ID NO 13002
  misc_feature: Functional homolog of the protein sequence given in SEQ ID NO 13332
MIHLRKRIVSLLPRTPTRVPCPHNSPLFYPHRLLSATKCVATTTNQFAVEDYLVATCGLTRAQALKASLRISHLKDASRPDAVVAFLSNLGLSSAEVTAVVTRDPKVLCSDVERTLTARVAELTDLGLSRPEIIRLLIVGMNHFRHGSLRLNVEFWISVFGSLDELMRVLRINNVLLSKNIEKVCKPNLALIQKCGIDVSEIPKSFMSRVLTVDPKRLLEALAHLHEYRIQQGSQLFIRGLYTFAILGSEKITKRIQLFEKLGWSKDHIVSAVKSDPNILGFTEERVRRSMEFLIGVVGLEVQYIAQRPALITCSIDRRLLPRNCLMNFLRAKGLFNDKPTFFSVASLSDKKFRRRYVHPYEERFPGLAAAFASSSAGEHQWERLYKMTGENRES

SEQ ID NO: 12723 - DNA, 807 bp, Sorghum bicolor
  misc_feature: Ceres ANNOT ID no. 6111824
  misc_feature: Encodes the peptide sequence at SEQ ID NO 12724
atgtggacggacagcccgctgctccgggacgccggcgccgccgtgctcaccggagtggccgcggctgtcgtgctccgcatctgggaagaggtcgccaaccgcgcgctgctggaccagaaactctgcaggaaactggtgcacataactgtaggattagtgtatttcctgatgtggcctttgttcagtccagatgacgtgtttgctccatttcttgctccccttatcatcgtcatcaacatcataaaggtgacagtgattggacttggtttggtgaaagatgaaggtgtgattaactcgatgaccaggcatggagaccacagagaactactcaagggcccgttgtattatgcttgtgctataactctgacaacaatagttttctggaggacatcacccatctcaatcgccgtgatctgcaatttgtgtgctggagatggtgttgctgacatatttgggagacgatttgggcatgtgaagctccctcacaaccctgaaaaatcatatgccggaagcatcgcgatgttcttggcaggtttcgtcgcatcagtgatcatttttgggtttgttgagaagagctggaccatggttgctgcctttggtgtcatatccctagttgcagcagttgtggagtcgctcccgatcagtacacgccttgacgataatctgacggttcctgtcgcatcggtgctacttggcgccctggttttctattccattggagccacaaacctgtgctgcatgagcagcgaggacaggagaagtatttcagcaaccgttggaatggtgtttgcaggcagcagcagctga

SEQ ID NO: 12724 - protein, 268 aa, Sorghum bicolor
  misc_feature: Ceres ANNOT ID no. 6111824
  misc_feature (41)..(239): Pfam Id: CTP_transf_1 Pfam Desc: Cytidylyltransferase family
  misc_feature (1)..(259): NCBI GI: 115483745 NCBI Desc: os11g0105800 [oryza sativa (japonica cultivar-group)]
  misc_feature (4)..(265): NCBI GI: 115486890 NCBI Desc: os12g0105500 [oryza sativa (japonica cultivar-group)]
  misc_feature (5)..(236): NCBI GI: 92039815 NCBI Desc: probable phytol kinase 2, chloroplast precursor
  misc_feature (5)..(236): NCBI GI: 115440847 NCBI Desc: os01g0832000 [oryza sativa (japonica cultivar-group)]
  misc_feature (6)..(235): NCBI GI: 76443939 NCBI Desc: phytol kinase [glycine max]
  misc_feature: Useful for making plants with modulated nitrogen use efficiency
  misc_feature: Functional homolog of the protein sequence given in SEQ ID NO 13064
  misc_feature: Useful for making plants with modulated nitrogen use efficiency
  misc_feature: Functional homolog of the protein sequence given in SEQ ID NO 13064
MWTDSPLLRDAGAAVLTGVAAAVVLRIWEEVANRALLDQKLCRKLVHITVGLVYFLMWPLFSPDDVFAPFLAPLIIVINIIKVTVIGLGLVKDEGVINSMTRHGDHRELLKGPLYYACAITLTTIVFWRTSPISIAVICNLCAGDGVADIFGRRFGHVKLPHNPEKSYAGSIAMFLAGFVASVIIFGFVEKSWTMVAAFGVISLVAAVVESLPISTRLDDNLTVPVASVLLGALVFYSIGATNLCCMSSEDRRSISATVGMVFAGSSS

SEQ ID NO: 12725 - DNA, 519 bp, Sorghum bicolor
  misc_feature: Ceres ANNOT ID no. 6111867
  misc_feature: Encodes the peptide sequence at SEQ ID NO 12726
atggacggggaggagaacatcggcccgttccgccggaccagcgcccgcacgcgccggatggcctcgcgcatggcttccgcgctcgccagctctgacaaccgcgcccaggctgctttagctcgccttgaagctcttgagagcgacaatgccggggttgaggtggtacatcttaatgatgatgagtacggatccacggatgaggaagaccctgtccttatgcaaaagaagcagtcgaagattatgaaacgcaagacaaggcaagggaaagctttggagaaaaaggcagcaagatcattcatgggtgtcttacaagaagcaaatctggaatcccttcctcctcatgtcccaacatatttgagggctgccatgggtccacctagcacttcatctcgacggcactactgctcagtttgtggtagttctgcaaactacacatgtgtgatgtgcggaacacggttctgttcttgccgctgtcaagtcatacacaatgatacacgctgcctgaaatttgtggcttga

SEQ ID NO: 12726 - protein, 172 aa, Sorghum bicolor
  misc_feature: Ceres ANNOT ID no. 6111867
  misc_feature (131)..(160): Pfam Id: zf-HIT Pfam Desc: HIT zinc finger
  misc_feature (1)..(172): NCBI GI: 115453167 NCBI Desc: os03g0367800 [oryza sativa (japonica cultivar-group)]
  misc_feature (1)..(172): NCBI GI: 58892587 NCBI Desc: zinc finger protein [nicotiana benthamiana]
  misc_feature (31)..(170): NCBI GI: 89266741 NCBI Desc: zinc finger, hit domain containing 1 [xenopus tropicalis]
  misc_feature (31)..(170): NCBI GI: 111305747 NCBI Desc: zinc finger, hit domain containing 1 [xenopus tropicalis]
  misc_feature (11)..(170): NCBI GI: 119570594 NCBI Desc: zinc finger, hit type 1, isoform cra_d [homo sapiens]
MDGEENIGPFRRTSARTRRMASRMASALASSDNRAQAALARLEALESDNAGVEVVHLNDDEYGSTDEEDPVLMQKKQSKIMKRKTRQGKALEKKAARSFMGVLQEANLESLPPHVPTYLRAAMGPPSTSSRRHYCSVCGSSANYTCVMCGTRFCSCRCQVIHNDTRCLKFVA

SEQ ID NO: 12727 - DNA, 522 bp, Sorghum bicolor
  misc_feature: Ceres ANNOT ID no. 6111869
  misc_feature: Encodes the peptide sequence at SEQ ID NO 12728
atggatggggaggaggagaatgtcgggccgttccgccggaccagcgcccgcacgcgccgtatggcctcacgcatggcgtctgcgctcgccagctcggacaaccgtgcccaggctgctttagctcgccttgaagctcttgagagtgacaatgccggtgttgaggtggtagatcttaatgatgatgagtatggatccacggacgaggaagaccctgttctcatgcaaaagaagcagtccaagattatgaaacgcaagacaaggcaagggaaagctttggagaagagggcagcaagatcattcatggatgtcttacaagaagcaaatctggaatccctgcctcctcatgtcccaacatatttgagggctgctgtgggtccaccgagcacttcatctcgacggcactactgctcagtctgtggtagttctgcaaactacacgtgcgtgaggtgtggaacccggttttgttcttgccgctgtcaagtcatacacaatgatacgcgctgcctgaaatttgtggcttga

SEQ ID NO: 12728 - protein, 173 aa, Sorghum bicolor
  misc_feature: Ceres ANNOT ID no. 6111869
  misc_feature (132)..(161): Pfam Id: zf-HIT Pfam Desc: HIT zinc finger
  misc_feature (1)..(173): NCBI GI: 115453167 NCBI Desc: os03g0367800 [oryza sativa (japonica cultivar-group)]
  misc_feature (4)..(173): NCBI GI: 58892587 NCBI Desc: zinc finger protein [nicotiana benthamiana]
  misc_feature (32)..(171): NCBI GI: 89266741 NCBI Desc: zinc finger, hit domain containing 1 [xenopus tropicalis]
  misc_feature (32)..(171): NCBI GI: 111305747 NCBI Desc: zinc finger, hit domain containing 1 [xenopus tropicalis]
  misc_feature (32)..(171): NCBI GI: 45768243 NCBI Desc: loc407699 protein [danio rerio]
MDGEEENVGPFRRTSARTRRMASRMASALASSDNRAQAALARLEALESDNAGVEVVDLNDDEYGSTDEEDPVLMQKKQSKIMKRKTRQGKALEKRAARSFMDVLQEANLESLPPHVPTYLRAAVGPPSTSSRRHYCSVCGSSANYTCVRCGTRFCSCRCQVIHNDTRCLKFVA

SEQ ID NO: 12729 - DNA, 2049 bp, Sorghum bicolor
  misc_feature: Ceres ANNOT ID no. 6111925
  misc_feature: Encodes the peptide sequence at SEQ ID NO 12730
atggaggacgacgccgcgcacctccagcgcccgacgccgctcctcgccgtcaaccccaccgccgccgagtacgtccacgcacagggctacagtgtcgttctccctgagaaattgcaaactggcaggtggaacgtgtaccggtctgcgcattcacctctgaggttgataagtagatatcctgacaccccagacattggaacactgcatgataatttcacgtacgcagttgagacatttacagactgtagatacctgggaacaagaatcagaacagatggaacaattggagactacaaatggatgacatacggagaagctagcacgagcaggactgcagtaggttctggtcttatctatcatggagttcgtgaaggtgcatgcattggtctgtattttataaacagacctgagtgggttatagttgaccatgcttgttctgcatattcatatgtatctgtgccactttatgacactctcggcccagatgctgttcaattcattgtgaaccacgcagcggtggaagttatattctgtgtgcctcaaactctaagcattctgttaagttttatagctcaaatgccatgtgttcggcttatagtggtagttggtggagacgatgcaaatatgccatcaacgccagtaactactggagtggaaatcataacttactccaagctgctcatccagggaaagatcagtcctcaacattttcgtccgccaaagcctgaagatgttgccactatctgttacactagtggcactactggcacgccaaagggagttgttctttctcatgagaacttaattgcaaatgtagcaggatcaagcctgaacattaagttttacccctccgatgtgtatatctcatatcttcctttggctcacatctacgagagggttaaccagattgctgcgctgcactgtggcgttgccattggattctaccaaggggataatttgaagctcatggatgatctggctgctttgagaccgacaatattcgcaagtgtcccccggttatataacagaatttataccgcaattacaaatgctgtgaaggagtctggtgggctgaaagaaaaattgtttcatactgcatacaatgtcaagagacaagcaatccttaatgggaaaaatccatccccagtgtgggataagttggtatttaacaaaataaaagctaggcttggtggacgagtgagacttatgagttcaggtgcctctccactgtcagcagatgtcatggaattcctgaggatatgctttggtggtgaagttcttgaaggctatggaatgacggagacatcctgtattatatctgcaatggatgttggtgacagatcaattggtcatgttggatctccgattgcatcttgtgaggtgaaacttgtggatgtcccagaaatgaattatacgtccgaagatcaaccttatcctcgtggagaaatttgtgttagaggacctatagtattccatggttactataaagatgaagttcaaacaaaagaagtcattgatgaagatggttggttgcacactggagacataggtctgtggctacctggagggcgtttaaagattattgataggaaaaagaacattttcaagttagctcaaggagaatacatagctccagagaagattgaaaatgtttatgccaaatgcaagttcattgcccaatgttttatatatggtgacagtttaaactctttcttagttggtattgttgcagttgaaccagaggttttgaaggcttgggctgcatctgaaggaatccagtgtgaagacttgagacagctttgtgcagaccctagagcaagagctgctgtcctggctgatatggattctgttgggaaggaagcgcagctaagaggttttgagtttgctaaagctgttcggcttgttgctgagccattcacagtggagaatggtctcctcaccccaacattcaaggtcaaaagaccgcaagccaagacgtactttgcaaaggaaatttcagatatgtatgcagagttgcgggaggcagaggcacccaggtcgaagttgtga

SEQ ID NO: 12730 - protein, 682 aa, Sorghum bicolor
  misc_feature: Ceres ANNOT ID no. 6111925
  misc_feature (102)..(563): Pfam Id: AMP-binding Pfam Desc: AMP-binding enzyme
  misc_feature (5)..(682): NCBI GI: 77553663 NCBI Desc: long-chain acyl-coa synthetase [oryza sativa (japonica cultivar-group)]
  misc_feature (15)..(682): NCBI GI: 77548672 NCBI Desc: long-chain acyl-coa synthetase [oryza sativa (japonica cultivar-group)]
  misc_feature (15)..(682): NCBI GI: 83320525 NCBI Desc: acs2 [ricinus communis]
  misc_feature (10)..(672): NCBI GI: 13516481 NCBI Desc: long-chain acyl-coa synthetase [arabidopsis thaliana]
  misc_feature (10)..(672): NCBI GI: 20453099 NCBI Desc: at3g05970/f2o10_9 [arabidopsis thaliana]
MEDDAAHLQRPTPLLAVNPTAAEYVHAQGYSVVLPEKLQTGRWNVYRSAHSPLRLISRYPDTPDIGTLHDNFTYAVETFTDCRYLGTRIRTDGTIGDYKWMTYGEASTSRTAVGSGLIYHGVREGACIGLYFINRPEWVIVDHACSAYSYVSVPLYDTLGPDAVQFIVNHAAVEVIFCVPQTLSILLSFIAQMPCVRLIVVVGGDDANMPSTPVTTGVEIITYSKLLIQGKISPQHFRPPKPEDVATICYTSGTTGTPKGVVLSHENLIANVAGSSLNIKFYPSDVYISYLPLAHIYERVNQIAALHCGVAIGFYQGDNLKLMDDLAALRPTIFASVPRLYNRIYTAITNAVKESGGLKEKLFHTAYNVKRQAILNGKNPSPVWDKLVFNKIKARLGGRVRLMSSGASPLSADVMEFLRICFGGEVLEGYGMTETSCIISAMDVGDRSIGHVGSPIASCEVKLVDVPEMNYTSEDQPYPRGEICVRGPIVFHGYYKDEVQTKEVIDEDGWLHTGDIGLWLPGGRLKIIDRKKNIFKLAQGEYIAPEKIENVYAKCKFIAQCFIYGDSLNSFLVGIVAVEPEVLKAWAASEGIQCEDLRQLCADPRARAAVLADMDSVGKEAQLRGFEFAKAVRLVAEPFTVENGLLTPTFKVKRPQAKTYFAKEISDMYAELREAEAPRSKL

SEQ ID NO: 12731 - DNA, 1119 bp, Sorghum bicolor
  misc_feature: Ceres ANNOT ID no. 6111983
  misc_feature: Encodes the peptide sequence at SEQ ID NO 12732
atggaggtgacctcctcctcctcctcctcttcctcgccgtcgccgccatcggtgctgcgttccgtgctgctgtcgtacgcgtacgtggggatctggatgagcctgagcttcgcggtgatcgtctacaacaagtacatcctggaccccaagctctacaactggccgttcccgatcacgctcaccatgatccacatggccttctgcgcgtcgctcgccttcttcctcgtccgcgtcctccgcgtcgtcgacgtcccgtcgtcgtcgtcgtccatgacgcgccgcctctacgtctcctccgtgctccccatcggcgcgctgtacgcgctctccctctgcttctcaaactccgcctacatctacctctccgtctccttcatccagatgctcaaggcgctcatgcccgtcgccgtctactccctcgccgtcgcgctccgcaccgacgccttccgccgcgccacgctgctcaacatgctcgccatctccgcgggcgtcgccgtcgccgcctacggcgaggcgcgcttcgacgcgttcggcgtcacgctccagctgctcgccgtcgccgccgaggccacccgcctcgtcctcatccagatcctcctcacctcacggggagtgtcgctcaaccccatcacctcgctctactacgtcgcgccatgctgcctcgcgttcctcaccgtcccatggtacgccgtcgagctgcctcggctgcgcgccgccgccgccggcgcggggctcgtcacaagccccgacgtcgtgttcgtcttcgggaccaactcggtcgtcgccttcgcgctcaacctcgccgtgttcctgctggtgggcaagacgtccgcgctcaccatgaacgtcgccggcgtcgtcaaggactggctgctcatcgccttctcgtggacggtcatcaaggacaccgtcaccgccgtcaacctcgccggctacggcatcgccttcctcggcgtcgcttactacaaccacgccaagctgcaggcgctcaagaccaaggaggccgagaggaaggcggcggcgacgtcagcgaccaggccggacgatgacgccgaggcaggcgcgcggctgctgctgcggccggacaacaaggacgccggcggtgatcacaaaaactga

SEQ ID NO: 12732 - protein, 372 aa, Sorghum bicolor
  misc_feature: Ceres ANNOT ID no. 6111983
  misc_feature (178)..(324): Pfam Id: TPT Pfam Desc: Triose-phosphate Transporter family
  misc_feature (7)..(340): NCBI GI: 61651606 NCBI Desc: plastidic phosphate translocator-like protein1 [mesembryanthemum crystallinum]
  misc_feature (18)..(367): NCBI GI: 18420914 NCBI Desc: phosphate translocator-related [arabidopsis thaliana]
  misc_feature (18)..(358): NCBI GI: 124484353 NCBI Desc: phosphate translocator protein [chlamydomonas reinhardtii]
  misc_feature (20)..(331): NCBI GI: 15221115 NCBI Desc: phosphate translocator-related [arabidopsis thaliana]
  misc_feature (5)..(351): NCBI GI: 145354837 NCBI Desc: dmt family transporter: phosphate/phosphoenolpyruvate [ostreococcus lucimarinus cce9901]
  misc_feature: The sequence is a functional homolog of SEQ ID NO. 360 in the 11/188,298 US application
  misc_feature: The sequence is a functional homolog of SEQ ID NO. 484 in the 11/188,298 US application
MEVTSSSSSSSSPSPPSVLRSVLLSYAYVGIWMSLSFAVIVYNKYILDPKLYNWPFPITLTMIHMAFCASLAFFLVRVLRVVDVPSSSSSMTRRLYVSSVLPIGALYALSLCFSNSAYIYLSVSFIQMLKALMPVAVYSLAVALRTDAFRRATLLNMLAISAGVAVAAYGEARFDAFGVTLQLLAVAAEATRLVLIQILLTSRGVSLNPITSLYYVAPCCLAFLTVPWYAVELPRLRAAAAGAGLVTSPDVVFVFGTNSVVAFALNLAVFLLVGKTSALTMNVAGVVKDWLLIAFSWTVIKDTVTAVNLAGYGIAFLGVAYYNHAKLQALKTKEAERKAAATSATRPDDDAEAGARLLLRPDNKDAGGDHKN

SEQ ID NO: 12733 - DNA, 696 bp, Sorghum bicolor
  misc_feature: Ceres ANNOT ID no. 6112020
  misc_feature: Encodes the peptide sequence at SEQ ID NO 12734
atgctcatggccgccgccacgcacctggccggatctgcccactcctcatcctcctccatctcgccgcagtcgccgccgccctggcacccagtcgtactcgtgcccaaccacaaccagcaccaccaggccctccacgacctggacgtcctcgtcacgccgtccttgtccccgtcgccagcaacagcaacgccgccgccgccgccgacgacgacaacgcagcgcctcctccgccccgcggaagcccggcgcgcgggcaagcagcgccgtcgtcccaggccgtcgcggaagctgccgaccacgtacatcagcgccgacgccgctagcttccggcgcatggtgcaccaggtcacgggcgccgacgacgtagtagcagctcaccaagccacgtcggagctcctctgccgcccggccccggcgcactcccgcgcttccctggcgacgacgacgctgctgctgccgacgctggacacgtcggcgttcctgctcggcgcggcacgcgggggtcgggacagtggtggagcgacgcccggccgccatggctccgctgtggcggttggtgatccgggtgccgcgttgcaggcctgtggccgtggcggcgtacgaggaggaggaggaggaagctgcagcgccggcgggttccggatcccgagcttggagtcgtgggatgacgccgacgctctcttccagcaggagtag

SEQ ID NO: 12734 - protein, 231 aa, Sorghum bicolor
  misc_feature: Ceres ANNOT ID no. 6112020
  misc_feature (95)..(125): Pfam Id: VQ Pfam Desc: VQ motif
  misc_feature (43)..(222): NCBI GI: 115487138 NCBI Desc: os12g0127800 [oryza sativa (japonica cultivar-group)]
  misc_feature (43)..(222): NCBI GI: 115483987 NCBI Desc: os11g0131100 [oryza sativa (japonica cultivar-group)]
  misc_feature (56)..(178): NCBI GI: 115435962 NCBI Desc: os01g0278000 [oryza sativa (japonica cultivar-group)]
  misc_feature (3)..(162): NCBI GI: 87241016 NCBI Desc: vq [medicago truncatula]
MLMAAATHLAGSAHSSSSSISPQSPPPWHPVVLVPNHNQHHQALHDLDVLVTPSLSPSPATATPPPPPTTTTQRLLRPAEARRAGKQRRRPRPSRKLPTTYISADAASFRRMVHQVTGADDVVAAHQATSELLCRPAPAHSRASLATTTLLLPTLDTSAFLLGAARGGRDSGGATPGRHGSAVAVGDPGAALQACGRGGVRGGGGGSCSAGGFRIPSLESWDDADALFQQE

SEQ ID NO: 12735 - DNA, 1947 bp, Sorghum bicolor
  misc_feature: Ceres ANNOT ID no. 6112118
  misc_feature: Encodes the peptide sequence at SEQ ID NO 12736
atggacgcctgggaggccaccaaggcggtgttcgaccgggtgcgcgcgctggacccggacaacgcgtccaagatcatgggcctgctgctcatccaggacaacagcgacaaggagctcatccgcctcgccttcggccccgaccacctcctccacgccttcgtcgccgccgcgcgcgccgacctcgccgcctcatccaagccggcctccccgccctcgcccgtgctcggcccgctccaccagcccgcctcgccctggggcccaccgccatccgaccaccaccaccagcaccagtcccccttctccgccgccgaccacgcgctcgggtacgactacgacggcgccgctgccgctgccgcccccgcctccgcagacgccttcttccccgacgactacgactgctggtccccggcaggcggcgcaaccgcccaccgccgcagcttctcgctcagtgacgccgaggtcgccggcgccgccggcgccggcgcctggaggccctgcatgtacttcgcgcgtgggttctgcaagaacggctcctcctgccgcttcctccacggcttgcccgaggacgacgacgccgccaccgcggagcgcgagatggtcgtcatgcgcgccaaagccctcgccgccgcgcgctcccagcagcagcagcagcagctcatggcgtccgcgtttcccttctcgccgtcgccgtcgccgcccaagggcgtcaacctcaacttcctcctccaccaccacaaccagcagcagcagcagaacgagccccaaagggcggcggctgcggcggcggcggccatgctgcttcagggcggcggcggcgacgacatgcacggcaggttcccggtgcggtcgccccggatggaccgcggcgagctcatgtccagccccgccgctcggcagatctacctcaccttcccggccgactccaccttcagcgaggaggacgtctccaactacttcagcatgtacgggccggtgcaggacgtgcgcatcccgtaccagcagaagcgcatgttcggcttcgtcaccttcgtctacgccgagacggtgaagatcatcctcagcaagggcaacccgcacttcgtgtgcgacgcgcgcgtcctcgtcaagccttacaaggagaagggcaaggtccccgacaggttcaggaagctgcagcacccgcaccatggcgacttcgccggctgcacgtcgcccaccggattgctggattccagagaccccttcgacctgcagcagccgcagattggaccaaggatgatgtacgggaacattgccaaccacgaggcgtttctgaggaggaagctggaggagcagcaccaggcggcggagctgcagcaggccatcgagctggaggggcgccgcttcatggggctgcacctcctcgacctcaagagcaggggccaccacctcggctcctccacggccgccatggggcaaggcgagggcggcaaaggcaatggcaatgccgtccagcaagaggatgccaacatccaagcagatactcctaccaagacgatgaacagtaacagccttgcaatgagtgcgcctgcagccgatgcaggaggcgagcacgaggagcagcagggagaagaggatggggatggggatgggggtggcagtcccaagcaggcagtcaaccctggggaagaggagaagacggaatctggtcctgtcactgctgctactacacccattgttgcttgtggattccaagaaagtggcctggtggagcacattttgcctgacagcccctttgcatcccccaccaaggccacctccactgatacagctccagcagctcaaaatggaaacatcagcaatggcagccctcaccatgtggcttcatccctcttcccacctgcatccaccattgagctgcccccatacaactcctgcttctttcaggcgcccaggttttctcctgggcatgaagccattgggctgtga

SEQ ID NO: 12736 - protein, 648 aa, Sorghum bicolor
  misc_feature: Ceres ANNOT ID no. 6112118
  misc_feature (161)..(186): Pfam Id: zf-CCCH Pfam Desc: Zinc finger C-x8-C-x5-C-x3-H type (and similar)
  misc_feature (60)..(588): NCBI GI: 115474123 NCBI Desc: os07g0682400 [oryza sativa (japonica cultivar-group)]
  misc_feature (69)..(469): NCBI GI: 22331232 NCBI Desc: rna recognition motif (rrm)-containing protein [arabidopsis thaliana]
  misc_feature (255)..(380): NCBI GI: 79316196 NCBI Desc: rna binding / nucleic acid binding [arabidopsis thaliana]
  misc_feature (124)..(540): NCBI GI: 30684113 NCBI Desc: zinc finger (ccch-type) family protein [arabidopsis thaliana]
  misc_feature (297)..(377): NCBI GI: 27817837 NCBI Desc: rrm-containing protein-like [oryza sativa (japonica cultivar-group)]
MDAWEATKAVFDRVRALDPDNASKIMGLLLIQDNSDKELIRLAFGPDHLLHAFVAAARADLAASSKPASPPSPVLGPLHQPASPWGPPPSDHHHQHQSPFSAADHALGYDYDGAAAAAAPASADAFFPDDYDCWSPAGGATAHRRSFSLSDAEVAGAAGAGAWRPCMYFARGFCKNGSSCRFLHGLPEDDDAATAEREMVVMRAKALAAARSQQQQQQLMASAFPFSPSPSPPKGVNLNFLLHHHNQQQQQNEPQRAAAAAAAAMLLQGGGGDDMHGRFPVRSPRMDRGELMSSPAARQIYLTFPADSTFSEEDVSNYFSMYGPVQDVRIPYQQKRMFGFVTFVYAETVKIILSKGNPHFVCDARVLVKPYKEKGKVPDRFRKLQHPHHGDFAGCTSPTGLLDSRDPFDLQQPQIGPRMMYGNIANHEAFLRRKLEEQHQAAELQQAIELEGRRFMGLHLLDLKSRGHHLGSSTAAMGQGEGGKGNGNAVQQEDANIQADTPTKTMNSNSLAMSAPAADAGGEHEEQQGEEDGDGDGGGSPKQAVNPGEEEKTESGPVTAATTPIVACGFQESGLVEHILPDSPFASPTKATSTDTAPAAQNGNISNGSPHHVASSLFPPASTIELPPYNSCFFQAPRFSPGHEAIGL

SEQ ID NO: 12737 - DNA, 678 bp, Sorghum bicolor
  misc_feature: Ceres ANNOT ID no. 6112234
  misc_feature: Encodes the peptide sequence at SEQ ID NO 12738
atggctctcgagtctgttcctacatatctcagcgatttgggatcccaccaggctgccagagcccagcagcaaagaatcaggaaagatgagcgcatctggacctcagacacatatgctccctacgacgacgggcaccagtggaggaagtatggcgagaagaagctctccaactccaacttcccaaggttctattacagatgcacctacaagaacgacatgaagtgcccggctacaaagcaagtccaacagaaggacacaagcgacccaccgttgttctctgtcacttacttcaaccatcacacctgcagcagcatctcaaatcccataggaagcacgagagacgttgccgcacaatcggcctcgagcaaagcggtgtcaatctgcttcagcccgcattattctttcagagatgagccacagtcaccgattgcacattctttcagaggcaaccagcagccagctgagaggagcgcctatgcaacaagccagtttcagtggaccgccgcatcgtctccgtctcctaccagtaatgacagtccggttaagatggaggttgacactttttcaggagcaagcgcttcttcatccagctccagcagcatgggttctctcccgaggacgaggacgttgctaccgatcggtcagtccagatgcatcgagtacttccatttcttgtga

SEQ ID NO: 12738 - protein, 225 aa, Sorghum bicolor
  misc_feature: Ceres ANNOT ID no. 6112234
  misc_feature (41)..(104): Pfam Id: WRKY Pfam Desc: WRKY DNA -binding domain
  misc_feature (1)..(225): NCBI GI: 115483857 NCBI Desc: os11g0116900 [oryza sativa (japonica cultivar-group)]
  misc_feature (1)..(225): NCBI GI: 125491399 NCBI Desc: wrky transcription factor [triticum aestivum]
  misc_feature (1)..(104): NCBI GI: 46394346 NCBI Desc: tpa: wrky transcription factor 46 [oryza sativa (indica cultivar-group)]
  misc_feature (1)..(68): NCBI GI: 115487014 NCBI Desc: os12g0116400 [oryza sativa (japonica cultivar-group)]
  misc_feature (21)..(171): NCBI GI: 46394290 NCBI Desc: tpa: wrky transcription factor 18 [oryza sativa (japonica cultivar-group)]
  misc_feature: The sequence is a functional homolog of SEQ ID NO 1197 in the 10/666,642US patent application
  misc_feature: The sequence is a functional homolog of SEQ ID NO 1198 in the 10/666,642US patent application
  misc_feature: The sequence is a functional homolog of SEQ ID NO 1745 in the 11/479,226US patent application
  misc_feature: Useful for making plants with modulated growth and phenotype characteristics
  misc_feature: The sequence is a functional homolog of SEQ ID NO 1745 in the 20070022495 US patent application
  misc_feature: The sequence is a functional homolog of SEQ ID NO 1197 in the 20070033671 US patent application
MALESVPTYLSDLGSHQAARAQQQRIRKDERIWTSDTYAPYDDGHQWRKYGEKKLSNSNFPRFYYRCTYKNDMKCPATKQVQQKDTSDPPLFSVTYFNHHTCSSISNPIGSTRDVAAQSASSKAVSICFSPHYSFRDEPQSPIAHSFRGNQQPAERSAYATSQFQWTAASSPSPTSNDSPVKMEVDTFSGASASSSSSSSMGSLPRTRTLLPIGQSRCIEYFHFL

SEQ ID NO: 12739 - DNA, 744 bp, Sorghum bicolor
  misc_feature: Ceres ANNOT ID no. 6112284
  misc_feature: Encodes the peptide sequence at SEQ ID NO 12740
atgggttccaaagcgcctttatgtctcacgctcctcttgctgctgctcgtcgctgcctgcggacctgctgcagaggccaggcgtcttgtactacctgctgcgcaggccaacgatgctgttgaactcccagatcatggctcaaccttgaaggaacaaatttcttcaatgaagactcctgtccatctcaagagtagcggccaaatatgcttagcctgtgagaacttcatgagcgaagctgtcaattatctcagtgagaaacagacacaagataaggtcatggaattccttcatgacgcttgctctaagtcattctcctttgaagagaagtgtgttgaattgatggactcttatgcaacactcctttttgccaagattacagagatcgaaccagaagcgttctgcaaacagtatggcctgtgcaggaacacagctcttttctctggtgtgagaagtaacagcacatgtgtgttttgccaccatctgcttgatgaaattatgtccaaactgaaagatccagatgcggagattgagataattgagattcttatcaaggagtgcaataagattgaaggtcacgtccagcagtgcaagagactggtcctgcaatacattcccctcatcctggtgaacggtgagaagttcctcgagaagaatgatgtctgcgcgctcgtccaggcgtgtccagccagccagaagaagaccttcagctcagtcttgcagggagcgttgctgagtgacgcttga

SEQ ID NO: 12740 - protein, 247 aa, Sorghum bicolor
  misc_feature: Ceres ANNOT ID no. 6112284
  misc_feature (66)..(105): Pfam Id: SapB_1 Pfam Desc: Saposin-like type B, region 1
  misc_feature (152)..(190): Pfam Id: SapB_1 Pfam Desc: Saposin-like type B, region 1
  misc_feature (193)..(227): Pfam Id: SapB_2 Pfam Desc: Saposin-like type B, region 2
  misc_feature (10)..(247): NCBI GI: 115486970 NCBI Desc: os12g0112200 [oryza sativa (japonica cultivar-group)]
  misc_feature (34)..(242): NCBI GI: 115434718 NCBI Desc: os01g0166700 [oryza sativa (japonica cultivar-group)]
  misc_feature (51)..(175): NCBI GI: 115463263 NCBI Desc: os05g0334800 [oryza sativa (japonica cultivar-group)]
  misc_feature (16)..(232): NCBI GI: 61362197 NCBI Desc: prosaposin [synthetic construct]
  misc_feature (16)..(232): NCBI GI: 337765 NCBI Desc: cerebroside sulfate activator protein
MGSKAPLCLTLLLLLLVAACGPAAEARRLVLPAAQANDAVELPDHGSTLKEQISSMKTPVHLKSSGQICLACENFMSEAVNYLSEKQTQDKVMEFLHDACSKSFSFEEKCVELMDSYATLLFAKITEIEPEAFCKQYGLCRNTALFSGVRSNSTCVFCHHLLDEIMSKLKDPDAEIEIIEILIKECNKIEGHVQQCKRLVLQYIPLILVNGEKFLEKNDVCALVQACPASQKKTFSSVLQGALLSDA

SEQ ID NO: 12741 - DNA, 1038 bp, Sorghum bicolor
  misc_feature: Ceres ANNOT ID no. 6112333
  misc_feature: Encodes the peptide sequence at SEQ ID NO 12742
atggaggactccggcctgttcatgcagtgggcgatgactacactgcagcatgatgaggacctgacggtggcggtgggggtggcccctatcgacgacggccgaggtggcgctacctttccctcgctccaagcactccgcgaggcctcgcaagctgcagaaatgatccaggagctgatcggcgaaccccaacctcacgcggcaaacgactgctgctccggtgacgatggtggcactgcaggcaatacctcatcaggaaccgcgccaagaaggagcagcagcagcagtagtgccaccacccagcctgtgagctggaattttggcgccgcccctgtaccgcctgatcaggccgctgccacggtgagcctgctgccagatatggtgtgcaggtcgccgccgacgaggagggccgtcttaaagaccgtgggatccatctatgcacaggaccacatcatcgcggagaggaagcggcgagagaagatcaaccagcgcttcatcgagctctccaccgtcatccccggcctcaagaagatggacaaggctacgatcctttctgacgcgacgagatacgtgaaggagctccaagagaagctcaagacgcttgaagacgacggcggcagtggcagtaacgaccggggcgtcatggaatcctgggtgcttgtcaagaagccgtgcatcgcagcagtgcccgaggatgctgctggctcgtccccatcgtgggactcgtcggggacgtcgccggcgaggaatccactgccggagatagaagctcggttcttgaacaagaacgtgatggtgaggatccactgcgtggatggcaagggagtggccgtgagggtgctcgccgagttggaggagctccacctcagcatcgtccacgccaatgtcatgccattccaggcttgcactttgatcataaccatcacggcgaaggtggacgaaggcttcacagtcacggcggaggagatcgttggcagactcaagtctgcagcaataatgcaccagcaaagccgctgcaacagcactgaagaaactgcatga

SEQ ID NO: 12742 - protein, 345 aa, Sorghum bicolor
  misc_feature: Ceres ANNOT ID no. 6112333
  misc_feature (145)..(194): Pfam Id: HLH Pfam Desc: Helix-loop-helix DNA-binding domain
  misc_feature (263)..(328): Pfam Id: ACT Pfam Desc: ACT domain
  misc_feature (147)..(329): NCBI GI: 3399777 NCBI Desc: symbiotic ammonium transporter; nodulin [glycine max]
  misc_feature (125)..(328): NCBI GI: 144922982 NCBI Desc: helix-loop-helix dna-binding [medicago truncatula]
  misc_feature (146)..(329): NCBI GI: 92883256 NCBI Desc: basic helix-loop-helix dimerisation region bhlh [medicago truncatula]
  misc_feature (142)..(341): NCBI GI: 4206118 NCBI Desc: transporter homolog [mesembryanthemum crystallinum]
  misc_feature (133)..(326): NCBI GI: 91806240 NCBI Desc: basic helix-loop-helix family protein [arabidopsis thaliana]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1238 in the 10/412,699US patent application
  misc_feature: The sequence is a functional homolog of SEQ ID NO 1272 in the 10/666,642US patent application
  misc_feature: The sequence is a functional homolog of SEQ ID NO 1273 in the 10/666,642US patent application
  misc_feature: The sequence is a functional homolog of SEQ ID NO 1274 in the 10/666,642US patent application
  misc_feature: The sequence is a functional homolog of SEQ ID NO 1275 in the 10/666,642US patent application
  misc_feature: The sequence is a functional homolog of SEQ ID NO 1276 in the 10/666,642US patent application
  misc_feature: The sequence is a functional homolog of SEQ ID NO 1701 in the 10/374,780US patent application
  misc_feature: The sequence is a functional homolog of SEQ ID NO 1702 in the 10/374,780US patent application
  misc_feature: The sequence is a functional homolog of SEQ ID NO 1703 in the 10/374,780US patent application
  misc_feature: The sequence is a functional homolog of SEQ ID NO 1704 in the 10/374,780US patent application
  misc_feature: The sequence is a functional homolog of SEQ ID NO 1705 in the 10/374,780US patent application
  misc_feature: The sequence is a functional homolog of SEQ ID NO 2 in the 10/374,780US patent application
  misc_feature: The sequence is a functional homolog of SEQ ID NO 42 in the 11/375,241US patent application
  misc_feature: The sequence is a functional homolog of SEQ ID NO 464 in the 11/435,388US patent application
  misc_feature: The sequence is a functional homolog of SEQ ID NO 943 in the 10/374,780US patent application
  misc_feature: The sequence is a functional homolog of SEQ ID NO 96 in the 10/374,780US patent application
  misc_feature: The sequence is a functional homolog of SEQ ID NO 960 in the 10/374,780US patent application
  misc_feature: Useful for making plants with altered alkaloid content
  misc_feature: Useful for making plants with modulated growth and phenotype characteristics
  misc_feature: Functional homolog of the protein sequence given in SEQ ID NO 13317
  misc_feature: The sequence is a functional homolog of SEQ ID NO 12 in the 20040045049 US patent application
  misc_feature: The sequence is a functional homolog of SEQ ID NO 1238 in the 20040045049 US patent application
  misc_feature: The sequence is a functional homolog of SEQ ID NO 1701 in the 20060162006 US patent application
  misc_feature: The sequence is a functional homolog of SEQ ID NO 1702 in the 20060162006 US patent application
  misc_feature: The sequence is a functional homolog of SEQ ID NO 1703 in the 20060162006 US patent application
  misc_feature: The sequence is a functional homolog of SEQ ID NO 1704 in the 20060162006 US patent application
  misc_feature: The sequence is a functional homolog of SEQ ID NO 1705 in the 20060162006 US patent application
  misc_feature: The sequence is a functional homolog of SEQ ID NO 96 in the 20060162006 US patent application
  misc_feature: The sequence is a functional homolog of SEQ ID NO 960 in the 20060162006 US patent application
  misc_feature: The sequence is a functional homolog of SEQ ID NO 1275 in the 10/666,642 US patent application
  misc_feature: The sequence is a functional homolog of SEQ ID NO 1704 in the 10/374,780 US patent application
  misc_feature: The sequence is a functional homolog of SEQ ID NO. 483 in the 11/188,298 US application
  misc_feature: The sequence is a functional homolog of SEQ ID NO. 414 in the 11/188,298 US application
MEDSGLFMQWAMTTLQHDEDLTVAVGVAPIDDGRGGATFPSLQALREASQAAEMIQELIGEPQPHAANDCCSGDDGGTAGNTSSGTAPRRSSSSSSATTQPVSWNFGAAPVPPDQAAATVSLLPDMVCRSPPTRRAVLKTVGSIYAQDHIIAERKRREKINQRFIELSTVIPGLKKMDKATILSDATRYVKELQEKLKTLEDDGGSGSNDRGVMESWVLVKKPCIAAVPEDAAGSSPSWDSSGTSPARNPLPEIEARFLNKNVMVRIHCVDGKGVAVRVLAELEELHLSIVHANVMPFQACTLIITITAKVDEGFTVTAEEIVGRLKSAAIMHQQSRCNSTEETA

SEQ ID NO: 12743 - DNA, 960 bp, Sorghum bicolor
  misc_feature: Ceres ANNOT ID no. 6112376
  misc_feature: Encodes the peptide sequence at SEQ ID NO 12744
atgctgccgctcgcataccccgccggccacagccaactccatctccatctccacctccctcccgcagcgctgcagcgcgctgccgctccgggtcgagcctaccttcccagtcgccgcggcgcccgaaccttcgccggagcgcgccctcccggttccagcgcgggggcggccggaactgagaccacctctaccactagcggcagcgtcttgtcgttcctgtgtccgctcctcaaactcctcgggggaggcgatccttcgcagcagcgcaacgacgttgtggaggtcacgacatcttcaatttcaagtttagctagactgcaatggggatcaaaagtggctactagcagtggggagaacatagattcggcaataagcactccaactcttcaattgagagttcgggaggccatgaccgagcttgacctttctgcagaggtttatccatgtccaaaagggtcactaaggcacagagatgtggtcaagaaaattggagggaaggagcagtttccactccttattgacgctagtactggtatctcaatgtatgaaagtggagatattgtgaagtacctgttcaggcagtatggacaaggaaagagtccttctcctggacttcttgagagtacaattttcacaggatgggtgcccactcttcttagagctggaagaggaatgacactgtggaacaaagctggtgctgtacctgcagagaagttggagctgttctcatatgagaataattcttatgcaaggatagttcgagaggctctctgtgaattggagcttccttatgttctccagaacgttggagagggatcatcaaagacagatttgcttctaaggaagtcgggctctaagcaggtgccatatctgattgaccctaacactggattccagtcgaacgaccataagaagatactagcttacttattccagcagtactcacttagtagccagtag

SEQ ID NO: 12744 - protein, 319 aa, Sorghum bicolor
  misc_feature: Ceres ANNOT ID no. 6112376
  misc_feature (132)..(271): NCBI GI: 120555110 NCBI Desc: glutathione s-transferase, n-terminal domain [marinobacter aquaeolei vt8]
  misc_feature (110)..(315): NCBI GI: 119358800 NCBI Desc: ccd-arp undefined product (ic) [ostreococcus tauri]
  misc_feature (132)..(201): NCBI GI: 83584367 NCBI Desc: plastid auxin-regulated protein [prototheca wickerhamii]
  misc_feature (157)..(204): NCBI GI: 55379246 NCBI Desc: glutathione s-transferase [haloarcula marismortui atcc 43049]
  misc_feature (132)..(202): NCBI GI: 109627302 NCBI Desc: probable glutaredoxin [haloquadratum walsbyi]
MLPLAYPAGHSQLHLHLHLPPAALQRAAAPGRAYLPSRRGARTFAGARPPGSSAGAAGTETTSTTSGSVLSFLCPLLKLLGGGDPSQQRNDVVEVTTSSISSLARLQWGSKVATSSGENIDSAISTPTLQLRVREAMTELDLSAEVYPCPKGSLRHRDVVKKIGGKEQFPLLIDASTGISMYESGDIVKYLFRQYGQGKSPSPGLLESTIFTGWVPTLLRAGRGMTLWNKAGAVPAEKLELFSYENNSYARIVREALCELELPYVLQNVGEGSSKTDLLLRKSGSKQVPYLIDPNTGFQSNDHKKILAYLFQQYSLSSQ

SEQ ID NO: 12745 - DNA, 1140 bp, Sorghum bicolor
  misc_feature: Ceres ANNOT ID no. 6112390
  misc_feature: Encodes the peptide sequence at SEQ ID NO 12746
atggaaaatataccacttctgagtccttatgaaacaaaaagattcaggttttcacacagaactgtgctggcacccttgacaagagccagatcatatggtaatcttccacaatcgcatgccattttgtactactcacagagggcaacagagggcggtcttctgattgctgaagccacaggggtgtcatctgatgctcaaggtatgagtttaattccacacaccccagggatttggaccaaggaacaagtagaggcctggaagcctgttgtggatgcagtgcatgcaaaaggtggaatattcttctgccagatttggcatgtaggaagggcatctgatatggagaaagaacccatctccagcacagataagccagtggaaaagaatggagatgaccacatggatttccccatcccaagatgcttaaccgtagaagagatccccgatgtaatcaatcatttcagaattgctgcaagaaatgctgtggatgctggttttgatggggttgaaatccatggtgctcatggcttccttctcgagcaattcatgaaagacagtgtcaatgaccgcactgacaagtacggaggcagcatacagaatcgctgtcgctttgcccttgaggtagttgatgctgtggtggctgaggttgggtcagaccgtgtggggatccgcctctctccttatgccaattaccttggctgtcatgactcggacccagacaggttgggtgtctacatggctcaggagctgaacagatacaacatcctgtactgcagtgcggtggaacctgagatggtcatggtggatggcaagatgaaaatcccacacagtctgcaagaaatgaggaaggccttcaacggaactttcatggttggtggaggttacgacagggaagagggtaacagagttgtagctgatggatatgctgacatggttgtatatggccgcttattcttggcgaatcctgacctgccgaggcgattccagctgaatgctcccttgaacaagtatgatcgatcaacattctacaccgatgatcctgtcgttggctacacggattacccatttcttgagaactctgaaccactaaactccctaactagacggggagggatctaccaaaacaaagaagggatgatctga

SEQ ID NO: 12746 - protein, 379 aa, Sorghum bicolor
  misc_feature: Ceres ANNOT ID no. 6112390
  misc_feature (5)..(334): Pfam Id: Oxidored_FMN Pfam Desc: NADH:flavin oxidoreductase / NADH oxidase family
  misc_feature (4)..(359): NCBI GI: 40645459 NCBI Desc: ledi-5c protein [lithospermum erythrorhizon]
  misc_feature (2)..(357): NCBI GI: 63021719 NCBI Desc: 12-oxo-phytodienoic acid reductase [zea mays]
  misc_feature (2)..(364): NCBI GI: 89029801 NCBI Desc: 12-oxophytodienoic acid reductase 1 [setaria italica]
  misc_feature (4)..(357): NCBI GI: 60687503 NCBI Desc: cis-12-oxo-phytodienoic acid-reductase 1 - rice
  misc_feature (117)..(360): NCBI GI: 115467086 NCBI Desc: os06g0216000 [oryza sativa (japonica cultivar-group)]
  misc_feature (2)..(359): SWISSPROT Homolog: EC 1.3.1.42 12-oxophytodienoate reductase 2
  misc_feature: Useful for making plants with modulated water use efficiency
  misc_feature: Functional homolog of the protein sequence given in SEQ ID NO 13609
MENIPLLSPYETKRFRFSHRTVLAPLTRARSYGNLPQSHAILYYSQRATEGGLLIAEATGVSSDAQGMSLIPHTPGIWTKEQVEAWKPVVDAVHAKGGIFFCQIWHVGRASDMEKEPISSTDKPVEKNGDDHMDFPIPRCLTVEEIPDVINHFRIAARNAVDAGFDGVEIHGAHGFLLEQFMKDSVNDRTDKYGGSIQNRCRFALEVVDAVVAEVGSDRVGIRLSPYANYLGCHDSDPDRLGVYMAQELNRYNILYCSAVEPEMVMVDGKMKIPHSLQEMRKAFNGTFMVGGGYDREEGNRVVADGYADMVVYGRLFLANPDLPRRFQLNAPLNKYDRSTFYTDDPVVGYTDYPFLENSEPLNSLTRRGGIYQNKEGMI

SEQ ID NO: 12747 - DNA, 1380 bp, Sorghum bicolor
  misc_feature: Ceres ANNOT ID no. 6112591
  misc_feature: Encodes the peptide sequence at SEQ ID NO 12748
atggaggctttcctgaagaagttcttcccgggcttgctcaagagcacggcgcgcggcggcaacaaggacgtgtactgcatctacaacaaccaggcgctaacggccttcacgtcgtcgctgtacgcgttcggcatggtggggacgctgctggcgagccgcgtcacccggcgcctggggcgccaggccgtgatgctgatcggcggcagcctgttcctggctggcgccctcgtgaacgccgccgcggcgaacctcgccatgctcatcgtcgggcggatgctgctcggcctgggcctcgggttctccggccaggccacgcccgtgtacctcgccgaggtgtcgcccccgcgctggcgcggggggttcatctcggcgttcccgctcttcatcagcatcggctacctggtcgccaacctcatcaactacggcacctcgcggatccccgactggggctggcgcctgtcgctgggcctggccgccgtccccgccgccgtcatggtggcgggcgctgcgttcatcccggacacacccagcagcctcgtcctccgcgggaagcacgacgacgcgcgcgccgcgctgcagcgggtgcgcggcaagggcgtggacatcggcgccgagttcgcggacatcctcgccgcggcggagagcgaccggcggaacgaggagggcgcgttccgccggatcctgcgccgcgagtaccggccgtacctggtgatggccgtggcgttcccggtgttcctgaacctcacgggggtcgccgtcaccgccttcttctcgccgatcctgttccggaccgtcgggttcgagagcgacgccgcgctcatgggcgccgtcatcctgggcctcatgaacatcggcggcatcctcgcgtcgggcttcgccatggaccgctacggccggaagctgctcttcgtcatcggtggcgcgctcatgttcacttgccaggtggccatggcgagcatcatcggatcacagctgggcaacgggagcaagatgcccaaggggtacgcggtgacggtgctggtggtgacgctggtcttctcggcgagcttcagctggtcgtggggcgcgctgtactggaccatccccggcgagatataccccgtggaggtgcggtcggcggggcagggcgcggcggtggcgctcaacctggggctcaacttcctgcaggcgcagttcttcctggcgatgctgtgctgcttcaagtacggcaccttcctcttctacgcgtcatggctggtggtgatgaccgccttcgccgtggcgttcgtgccggagaccaagggcgtgccgctcgagtccatggcgcacgtcttcgcgcgccactggtactggggcaggttcgtcaaggaccaccagaagtttggcgaagagtccacctag

SEQ ID NO: 12748 - protein, 459 aa, Sorghum bicolor
  misc_feature: Ceres ANNOT ID no. 6112591
  misc_feature (1)..(438): Pfam Id: Sugar_tr Pfam Desc: Sugar (and other) transporter
  misc_feature (3)..(390): Pfam Id: MFS_1 Pfam Desc: Major Facilitator Superfamily
  misc_feature (1)..(459): NCBI GI: 115458714 NCBI Desc: os04g0453400 [oryza sativa (japonica cultivar-group)]
  misc_feature (1)..(459): NCBI GI: 116309960 NCBI Desc: h0505f09.6 [oryza sativa (indica cultivar-group)]
  misc_feature (1)..(449): NCBI GI: 32489200 NCBI Desc: osjnba0027g07.27 [oryza sativa (japonica cultivar-group)]
  misc_feature (1)..(449): NCBI GI: 116309779 NCBI Desc: osigba0093k19.7 [oryza sativa (indica cultivar-group)]
  misc_feature (1)..(453): NCBI GI: 115458708 NCBI Desc: os04g0452700 [oryza sativa (japonica cultivar-group)]
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
  misc_feature: The sequence is a functional homolog of SEQ ID NO. 418 in the 11/188,298 US application
MEAFLKKFFPGLLKSTARGGNKDVYCIYNNQALTAFTSSLYAFGMVGTLLASRVTRRLGRQAVMLIGGSLFLAGALVNAAAANLAMLIVGRMLLGLGLGFSGQATPVYLAEVSPPRWRGGFISAFPLFISIGYLVANLINYGTSRIPDWGWRLSLGLAAVPAAVMVAGAAFIPDTPSSLVLRGKHDDARAALQRVRGKGVDIGAEFADILAAAESDRRNEEGAFRRILRREYRPYLVMAVAFPVFLNLTGVAVTAFFSPILFRTVGFESDAALMGAVILGLMNIGGILASGFAMDRYGRKLLFVIGGALMFTCQVAMASIIGSQLGNGSKMPKGYAVTVLVVTLVFSASFSWSWGALYWTIPGEIYPVEVRSAGQGAAVALNLGLNFLQAQFFLAMLCCFKYGTFLFYASWLVVMTAFAVAFVPETKGVPLESMAHVFARHWYWGRFVKDHQKFGEEST

SEQ ID NO: 12749 - DNA, 1389 bp, Sorghum bicolor
  misc_feature: Ceres ANNOT ID no. 6112662
  misc_feature: Encodes the peptide sequence at SEQ ID NO 12750
atggccaatggtggagcggcgtcgcgtggccctcccgacggctcgccggccgcgctggtgcagcagcccctcctccacgcctacgaggcgcgcaaggaggacccggcggcgtgcgacggagaggcgcacggcttcggccccgcagagcccgacggcggcgcgagcttcgtgcggacctgcttcaatggcctcaacggcctctccggcgtcgggctgctgtccatcccgtacgcgctgtcggagggcgggtggctgagcctggcgctcctgctcgtcgtcgcggcggtgtgctgctacacgggcctgctcctgcagcggtgcatggacgcgtccccggccgtgcggggctacccggacatcggcgcgctcgcgttcgggcgcggcggccgcctcgccgcgtccgcgttcctctacgccgagctctacctcgtcgccatcggcttcctcatcctggaaggggacaacctggacaagctgttcccgggcaccagcctcagcctcggactcggcctcggcgacggtggcgccgccctcctcgtggtctccgggaagaagctcttcgtcgtgctcgtcgccctcgtcatcctgcccaccacgtggctccggagcctcggcgtgctcgcctacgtgtccgccagcggcgtgctcgcgtcggccgtcgtcgtcgtctgcgtgctgtggacggccgtggccgacggcgtcgggttccacgccagggggaggatgctcaacgtcagtggcctccccactgctctgggcctctacaccttctgctactgcggccatgccattttccccacgctctgcaactccatgaaggagaagaaaaggttctccagggtgcttgtcatatgcttcgtcttgtgcactctcaactacggatccatggcgatcctcggctacctcatgtacggcgacgacgtcaagtcccaggtgacgctgaacctgcccgagggcaagatcggctcgaagctagcgatctacaccacgctgatcaaccccttctccaagtacgccctgatggtgacgccgctcgcgacggcggtggaggagaggctgcagctcgccgccggctccggctccgggtctggccgcggcagcagcagcaagaggtccgtgaacgtgctggtcaggacgctgctggtcgtcagcacggtcgtcgtcgcgatcgccgtgcccttcttcggccacctcatggcgctcgtcggctcgctcctcagcgtcatggccgcgatgctgctcccctgcatcttctacctcaagatcttcggcgtggcgcgctgcagcagggcggaggtcgcgctcatcgccaccattattgttctgggctccgtggttgccgcggccgggacgtacgcttctgtgaagaagattgttctcgactactga

SEQ ID NO: 12750 - protein, 462 aa, Sorghum bicolor
  misc_feature: Ceres ANNOT ID no. 6112662
  misc_feature (52)..(456): Pfam Id: Aa_trans Pfam Desc: Transmembrane amino acid transporter protein
  misc_feature (4)..(462): NCBI GI: 38344962 NCBI Desc: osjnba0072f16.7 [oryza sativa (japonica cultivar-group)]
  misc_feature (4)..(462): NCBI GI: 116310060 NCBI Desc: osigba0097p08.12 [oryza sativa (indica cultivar-group)]
  misc_feature (58)..(459): NCBI GI: 38344961 NCBI Desc: osjnba0072f16.6 [oryza sativa (japonica cultivar-group)]
  misc_feature (58)..(459): NCBI GI: 116310059 NCBI Desc: osigba0097p08.11 [oryza sativa (indica cultivar-group)]
  misc_feature (19)..(451): NCBI GI: 53791379 NCBI Desc: amino acid transporter-like [oryza sativa (japonica cultivar-group)]
  misc_feature: The sequence is a functional homolog of SEQ ID NO. 438 in the 11/188,298 US application
MANGGAASRGPPDGSPAALVQQPLLHAYEARKEDPAACDGEAHGFGPAEPDGGASFVRTCFNGLNGLSGVGLLSIPYALSEGGWLSLALLLVVAAVCCYTGLLLQRCMDASPAVRGYPDIGALAFGRGGRLAASAFLYAELYLVAIGFLILEGDNLDKLFPGTSLSLGLGLGDGGAALLVVSGKKLFVVLVALVILPTTWLRSLGVLAYVSASGVLASAVVVVCVLWTAVADGVGFHARGRMLNVSGLPTALGLYTFCYCGHAIFPTLCNSMKEKKRFSRVLVICFVLCTLNYGSMAILGYLMYGDDVKSQVTLNLPEGKIGSKLAIYTTLINPFSKYALMVTPLATAVEERLQLAAGSGSGSGRGSSSKRSVNVLVRTLLVVSTVVVAIAVPFFGHLMALVGSLLSVMAAMLLPCIFYLKIFGVARCSRAEVALIATIIVLGSVVAAAGTYASVKKIVLDY

SEQ ID NO: 12751 - DNA, 678 bp, Sorghum bicolor
  misc_feature: Ceres ANNOT ID no. 6112666
  misc_feature: Encodes the peptide sequence at SEQ ID NO 12752
atgtccatcctccgatcctttctcccaatagtagcaagatcaaatggttggagatgcttttctactggggttccttctgatatgatagcagagcttaataaggaaatggagtcagtatttggtgaatctccgtcatccagtcctttgggctcaagtccatcccagcaaccagctcaacccagttatggagctgaggattcacatctagtgcttacccatactgatagtagcggacaggcaaagatggttgatgtctctccaaaagaagacagtaagagagtcgctatagctagctgcagggtcttgctaggccaaaaggtgtacaatttggtggcatctaatgagattgcaaaaggagatgttcttactgttgcaaagattgctggaataactggtgcaaagcaaaccagtaatcttatacccttgtgccacaacattaatctttcacatgttcgtgttgatctcactctcaatgaagaggattctagtgtcatgatagaaggggaagccgctaccagtggaaagacaggggttgagatggaagcattgactgctgtaaccattgctggcctcacagtctatgacatgtgcaaagctgcttcaaaggacatttgtataacagatgtctgtctccaacacaagtccggggggaagagtggaagctggtccaggaattaa

SEQ ID NO: 12752 - protein, 225 aa, Sorghum bicolor
  misc_feature: Ceres ANNOT ID no. 6112666
  misc_feature (82)..(217): Pfam Id: MoaC Pfam Desc: MoaC family
  misc_feature (1)..(225): NCBI GI: 115458782 NCBI Desc: os04g0460500 [oryza sativa (japonica cultivar-group)]
  misc_feature (29)..(223): NCBI GI: 92866946 NCBI Desc: molybdopterin cofactor biosynthesis moac region [medicago truncatula]
  misc_feature (51)..(224): NCBI GI: 105829726 NCBI Desc: at1g01290 [arabidopsis thaliana]
  misc_feature (71)..(218): NCBI GI: 28574490 NCBI Desc: cg33048-pc, isoform c [drosophila melanogaster]
  misc_feature (71)..(218): NCBI GI: 24209680 NCBI Desc: molybdenum cofactor synthesis/low xanthine dehydrogenase [drosophila melanogaster]
MSILRSFLPIVARSNGWRCFSTGVPSDMIAELNKEMESVFGESPSSSPLGSSPSQQPAQPSYGAEDSHLVLTHTDSSGQAKMVDVSPKEDSKRVAIASCRVLLGQKVYNLVASNEIAKGDVLTVAKIAGITGAKQTSNLIPLCHNINLSHVRVDLTLNEEDSSVMIEGEAATSGKTGVEMEALTAVTIAGLTVYDMCKAASKDICITDVCLQHKSGGKSGSWSRN

SEQ ID NO: 12753 - DNA, 2559 bp, Sorghum bicolor
  misc_feature: Ceres ANNOT ID no. 6112680
  misc_feature: Encodes the peptide sequence at SEQ ID NO 12754
atgcctgcagccatgcccagtttctccagacgccgcttgctctgcctcttcttggtcgcatgcctcgccgctcttctcttctcgatcgccgaccgcgccgggaggaccaaggaaactgataatggcgaagcgaggttcagagtgctgcgtggtcttgacactctcggcctgaggcagaagcagcagcgtcacgctcacggccatggaatctctccggccccggctccggcgcgtgcccgcctacctctgctccacaaggacgcgcggctaccggtccccggaaaagtcgcccacaacgacaaccatacgagaggaggaaatgccacggcagcgaggcagagcccgccgcgcggcgggggaggcgaacaaggaagcaagaagaaaagcacgccgctggtggtcgtcgccgcggcggccgctctgtcgggggcggcgctagtgctcctcgcagtcctggtggtgttcctgacgtgcaggaagttccagggcaggcgcggggccggcggcggcggtgaccagagcggcggcaccaacaaggtgagcttcgagcccggcccgggcatgttctacctggacgccatcaagccgtacctcgacgacgccggccgcgacggcgggggaaaggcggcgctggagatggccgggcccaagggcgaggagcccaagtgcgacgacgaggaaggcggcggtggagcttgctccgaggacgacggcgccgagtcggtccactcctcgtgctgcttccagtcgtcacatttctcctactccgagctggcgaagggcggccagggcgacggcgtgtcgccgtcgccgtccgtccggtccaagcggcgaggctctgccccgacgacgccttcagacaagacgaaggttgcgagcccgtattcgcctctgggcccgcgcacgccgagcagtgacgaacggggccgccgcgcgcactccccgtcgagcacgtcggcgtccgtgttgacggagcagtcgttcaatgaccatgagctccagggaaccgctcattccgtcaggtctctgaaattccagagcggcggcagcgcgtgccacgcaaaagaagcaggagcagagaccgacgccgcaagtagaaaaacagcaccacctccaccgccaccgccgccaccgccaccaccaccacccccgccacctccgccaccggtgatggttaaacagcagcagaacgttcagaaaagctgtggtggtccggccgttgctccaccgcccccgccgccaccgccgctgctaataccgcaacaacagaatgctaagaggatgaacggccccatcctcccgccgccgcaggcaccgccgggactgttcaggcagaccgcgcctgtgggcaagaacggcgcgccgctgccgaagctgaagcccctgcactgggacaaggtgcgcgccgcgcccaaccggcggatggtgtgggacaggatccgctccagctcgttcgagctggacgaacagatgatcgagtcgctgttcgggtacaacgccgccgcgaggtgctcggcggcgaagctcgaggaaggccagagccggagcccctcgctcggacaccatgtcctggaccccaagaggctgcagaacatcaccatcctgatgaaggccgtcaacgccaccgccgaccaaatctacgccgcgctgctgcaagggaacggcctgtcggtgcagcagctggaggcactgatcaagatggcgccgaccaaggaagaggtcgagaagctcgagagctacgacggcgacgtcggcagcctggtcgcggcggaaaggctcctcaaggtggcgctcacgataccgtgcgcgttcgcgcgcgtcgaggccatgctgtaccgggagaccttcgccgatgaagtcagccacatcaggaagtcgttcgcgatgctcgaggacgcgtgcagggagctgatgtcgagcaagctgttcctgaagctgctggaggccgtgctgaagaccgggaaccggatgaacgtcgggacggcgcggggcggcgccatggcgttcaagctggacactctgctcaagctcgccgacgtcaagggcacggacgggaagacgacgctgctgcacttcgtggtccaggagatggtccgctcccggaagccaccaccggcgcgcgccgcggaggggcagccggacatcgtgaccgggctcgccgccgagctcaccaacgtcaggaagacggcgaccgtcgacctggacgtgctcaccacctcggtgtcgagcctctcgcacggcctgtcccggatcaaggcgctactggggaccgaccagctggcggcaggcgacgataagggccagcgcttcgtcgccgtcatggccccgttcgtgtgccaggccgaggaggtgatccgggagctggaggacggcgagcgccgggtcctggcgcacgtcagggacatcaccgagtactaccacggcgacgtcggcaaggaggaggccagcccgctccggatcttcgtcatcgtcagggacttcttggcgatgctggagagggtgtccaaggaggtgaggggagccaggggttgccacggatcaaaccaaacgctaccctga

SEQ ID NO: 12754 - protein, 852 aa, Sorghum bicolor
  misc_feature: Ceres ANNOT ID no. 6112680
  misc_feature (450)..(832): Pfam Id: FH2 Pfam Desc: Formin Homology 2 Domain
  misc_feature (13)..(851): NCBI GI: 38567708 NCBI Desc: b1358b12.6 [oryza sativa (japonica cultivar-group)]
  misc_feature (394)..(700): NCBI GI: 92882246 NCBI Desc: actin-binding fh2 [medicago truncatula]
  misc_feature (311)..(838): NCBI GI: 110741802 NCBI Desc: formin-like protein ahf1 [arabidopsis thaliana]
  misc_feature (367)..(839): NCBI GI: 37694426 NCBI Desc: formin-like protein atfh6 [arabidopsis thaliana]
  misc_feature (335)..(758): NCBI GI: 47716755 NCBI Desc: formin homology 2 domain-containing protein 5 [arabidopsis thaliana]
MPAAMPSFSRRRLLCLFLVACLAALLFSIADRAGRTKETDNGEARFRVLRGLDTLGLRQKQQRHAHGHGISPAPAPARARLPLLHKDARLPVPGKVAHNDNHTRGGNATAARQSPPRGGGGEQGSKKKSTPLVVVAAAAALSGAALVLLAVLVVFLTCRKFQGRRGAGGGGDQSGGTNKVSFEPGPGMFYLDAIKPYLDDAGRDGGGKAALEMAGPKGEEPKCDDEEGGGGACSEDDGAESVHSSCCFQSSHFSYSELAKGGQGDGVSPSPSVRSKRRGSAPTTPSDKTKVASPYSPLGPRTPSSDERGRRAHSPSSTSASVLTEQSFNDHELQGTAHSVRSLKFQSGGSACHAKEAGAETDAASRKTAPPPPPPPPPPPPPPPPPPPPVMVKQQQNVQKSCGGPAVAPPPPPPPPLLIPQQQNAKRMNGPILPPPQAPPGLFRQTAPVGKNGAPLPKLKPLHWDKVRAAPNRRMVWDRIRSSSFELDEQMIESLFGYNAAARCSAAKLEEGQSRSPSLGHHVLDPKRLQNITILMKAVNATADQIYAALLQGNGLSVQQLEALIKMAPTKEEVEKLESYDGDVGSLVAAERLLKVALTIPCAFARVEAMLYRETFADEVSHIRKSFAMLEDACRELMSSKLFLKLLEAVLKTGNRMNVGTARGGAMAFKLDTLLKLADVKGTDGKTTLLHFVVQEMVRSRKPPPARAAEGQPDIVTGLAAELTNVRKTATVDLDVLTTSVSSLSHGLSRIKALLGTDQLAAGDDKGQRFVAVMAPFVCQAEEVIRELEDGERRVLAHVRDITEYYHGDVGKEEASPLRIFVIVRDFLAMLERVSKEVRGARGCHGSNQTLP

SEQ ID NO: 12755 - DNA, 1413 bp, Sorghum bicolor
  misc_feature: Ceres ANNOT ID no. 6113003
  misc_feature: Encodes the peptide sequence at SEQ ID NO 12756
atgcctccttgcgctctcaccgtcgactccctaaatccaaaggtgctggcgctcgcggatcacctcggcggcgacgccattgcccgccgcgcgcagtgcatccaaaatgagatagaaacaaaaccggggtcacaccctttcgacgagataatctattgcagcctcagcaatccacaatccatgggacagcagccaaacaagttcttccgagaggttcttgccttgtgcgactatccccatcttctagaacagagtgaaaccaattccttgttcagctccgatgcaatagcaagggcacgggagattctagacctctttcctgggagagcaacaggaggatatagtcactgtcagggtattgaaggtttgcgcaatataatcgctgctggaattgcctctcgagataatttcccatgtgatgcagaggacattttcctgacagatggagcagctccaccggttcacatgatgatgcacctactgatacgggatcaaaaagatggtatcctctgcccaattccatcacattccttgtacacaagttatatggttctccagggcgctactcttgtgccatattaccttgacgaatccagaggctggggagtgagcatatcagatctgaagaagcagctggatggtgcccgatcaatgggtgtcgttgtgaggggacttgtggttataaatccaggcaaccctactggacatgtacttatggaggaaaatcagtgtgaaattgtggatttctgtaggaatgaagaccttgttcttctagcagatgaggtttatcaagaaaatgtttacacagatgaaaagaaatttcactctttcaagaaaatagcacggtccatggggtacggcgaaggagacatatctttagtgtccttccattcgatttctaatggatattatggagaatgtgggagaaggggaggctacatggaagtcacaggctttaattgtgaagtaaagaaacaagtgtacaaagttgcatccctaagctcatgctccaacatcactggccagatcctcatgagcctagtcatgaacccaccacaggttggagatgagtcatacacctcttatcaggcagaaagagatagcatcctgtcatcttttgctcgctgtgcagaggccatggtgtgcacatttaaccgtctggaaggggttacttgtagcaaggctgaaggagcaatgtttgtattcccttcagttcgtctgccaaagaaggcaattgcagctgctgaggaatgtaacacacagccagatgcattctatgctgtccgccttcttgaaaccacagggatcgttgttgtgcctggttctgtttttggacaagaagagaagttaccactaatcatctcccgttttatggcatttcatgaagtgttcatggaagaatttcgcgactaa

SEQ ID NO: 12756 - protein, 470 aa, Sorghum bicolor
  misc_feature: Ceres ANNOT ID no. 6113003
  misc_feature (79)..(457): Pfam Id: Aminotran_1_2 Pfam Desc: Aminotransferase class I and II
  misc_feature (6)..(470): NCBI GI: 296204 NCBI Desc: alanine aminotransferase [panicum miliaceum]
  misc_feature (5)..(470): NCBI GI: 115481822 NCBI Desc: os10g0390500 [oryza sativa (japonica cultivar-group)]
  misc_feature (5)..(470): NCBI GI: 4730886 NCBI Desc: alanine aminotransferase [oryza sativa]
  misc_feature (5)..(470): NCBI GI: 3694807 NCBI Desc: alanine aminotransferase [zea mays]
  misc_feature (6)..(470): NCBI GI: 1703227 NCBI Desc: alanine aminotransferase 2 (gpt) (glutamic--pyruvic transaminase 2) (glutamic--alanine transaminase 2) (alaat-2)
  misc_feature (6)..(470): SWISSPROT Homolog: EC 2.6.1.2 Alanine aminotransferase 2
  misc_feature: Useful for making plants with modulated nitrogen use efficiency
  misc_feature: Functional homolog of the protein sequence encoded by LOCUS at1g72330
  misc_feature: Useful for making plants with modulated nitrogen use efficiency
  misc_feature: Functional homolog of the protein sequence given in SEQ ID NO 13731
  misc_feature: The sequence is a functional homolog of SEQ ID NO. 526 in the 11/188,298 US application
MPPCALTVDSLNPKVLALADHLGGDAIARRAQCIQNEIETKPGSHPFDEIIYCSLSNPQSMGQQPNKFFREVLALCDYPHLLEQSETNSLFSSDAIARAREILDLFPGRATGGYSHCQGIEGLRNIIAAGIASRDNFPCDAEDIFLTDGAAPPVHMMMHLLIRDQKDGILCPIPSHSLYTSYMVLQGATLVPYYLDESRGWGVSISDLKKQLDGARSMGVVVRGLVVINPGNPTGHVLMEENQCEIVDFCRNEDLVLLADEVYQENVYTDEKKFHSFKKIARSMGYGEGDISLVSFHSISNGYYGECGRRGGYMEVTGFNCEVKKQVYKVASLSSCSNITGQILMSLVMNPPQVGDESYTSYQAERDSILSSFARCAEAMVCTFNRLEGVTCSKAEGAMFVFPSVRLPKKAIAAAEECNTQPDAFYAVRLLETTGIVVVPGSVFGQEEKLPLIISRFMAFHEVFMEEFRD

SEQ ID NO: 12757 - DNA, 1626 bp, Sorghum bicolor
  misc_feature: Ceres ANNOT ID no. 6113551
  misc_feature: Encodes the peptide sequence at SEQ ID NO 12758
atggcgacggcgatgtcggtttcggcggtgacaccggccgccgcggcggtcgcgcggccgcggacgatggtctgcgtgccggcgacggcgcgggcgccgcgggagatggcggaggagctggccgccgccgcggcgctcggcgccgacgtggcggagctccgcctcgactgcctcgccgggttcgcgccgcgcagggacctgcccgtcatcctcgccaagccccgcccgctccccgccctcgtcacctacaggcccaagtgggaagggggcgaatacgaaggcgatgacgaatcacgcttcgaggctctgctattggcaatggagctgggagctgaatatgtggatgttgagtttaaggtggctgacaaatttatgaaacttatttctgggaagaaaccagataactgtaaacttatagtttcatcccacaactatgagaacactccatcatccgaggaacttgcaaatttggtggctcagattcaagcaacgggggctgatattgtgaaaatagctacaacggctactgaaattgttgatgtggcaaagatgtttcaaatacttgttcattgccaggaaaagcaggtgccaatcattgggctggtgatgaatgacagaggttttatttctcgggttctttgcccaaaatatggtggattccttacttttgggtctctcaagaaaggaaaagagtctgcacctgcacagccaacggctgcagacttgataaatgtgtacaatattaggcagataggcccagacactaaggtctttggtatcattgggaagccggttggccatagcaaaagcccaattttgcataatgaagctttcagatcagtgggttccaatgctgtgtatgtgccatttttagtggatgacttggctaaatttcttaatacatactcttcaccagattttgctggcttcagttgcacaattcctcataaagaagctgctgttaggtgctgtgatgaggttgatcccattgccagggacattggagctgttaacacaatcgttagaagacctgatggaaaacttgttggctataatactgactatgttggagctatatctgctattgaggatggaataagagcatccgaacaaacggattcggacacatcaccactggctggaaggctttttgttgtcatcggggctggtggcgcgggaaaagcactggcatatggagcaaaagagaagggagcaagagttgtaattgcaaaccgtacttttgcacgtgcacaagaacttggcaacttaattggtgggcctgcattgactctggcggatttggaaaactaccatccagaggaagggatgattcttgcaaatacaacagccattggaatgcatccaaatgtgaatgaaactcctttatctaagcaagcactcaaatcttatgctgttgtgtttgatgcggtctacacaccaaaagagaccagacttctccgagaagctgcagaatgtggagctacagttgttagtggtctggagatgtttattcggcaagctatgggccagtttgagcatttcacgggcatgccagtggatgattacaaattccgagcgattgcaagttcattggacaatcctaacaccatgaagcctcgtctgtga

SEQ ID NO: 12758 - protein, 541 aa, Sorghum bicolor
  misc_feature: Ceres ANNOT ID no. 6113551
  misc_feature (24)..(245): Pfam Id: DHquinase_I Pfam Desc: Type I 3-dehydroquinase
  misc_feature (260)..(340): Pfam Id: Shikimate_dh_N Pfam Desc: Shikimate dehydrogenase substrate binding domain
  misc_feature (358)..(486): Pfam Id: Shikimate_DH Pfam Desc: Shikimate / quinate 5-dehydrogenase
  misc_feature (22)..(529): NCBI GI: 115436640 NCBI Desc: os01g0375200 [oryza sativa (japonica cultivar-group)]
  misc_feature (17)..(518): NCBI GI: 109157947 NCBI Desc: chain a, crystal structure of arabidopsis dehydroquinate dehydratase- shikimate dehydrogenase in complex with tartrate and shikimate
  misc_feature (22)..(518): NCBI GI: 58041010 NCBI Desc: dehydroquinate dehydratase/shikimate dehydrogenase [arabidopsis thaliana]
  misc_feature (17)..(518): NCBI GI: 45773760 NCBI Desc: at3g06350 [arabidopsis thaliana]
  misc_feature (16)..(517): NCBI GI: 535771 NCBI Desc: dehydroquinate dehydratase/shikimate dehydrogenase
MATAMSVSAVTPAAAAVARPRTMVCVPATARAPREMAEELAAAAALGADVAELRLDCLAGFAPRRDLPVILAKPRPLPALVTYRPKWEGGEYEGDDESRFEALLLAMELGAEYVDVEFKVADKFMKLISGKKPDNCKLIVSSHNYENTPSSEELANLVAQIQATGADIVKIATTATEIVDVAKMFQILVHCQEKQVPIIGLVMNDRGFISRVLCPKYGGFLTFGSLKKGKESAPAQPTAADLINVYNIRQIGPDTKVFGIIGKPVGHSKSPILHNEAFRSVGSNAVYVPFLVDDLAKFLNTYSSPDFAGFSCTIPHKEAAVRCCDEVDPIARDIGAVNTIVRRPDGKLVGYNTDYVGAISAIEDGIRASEQTDSDTSPLAGRLFVVIGAGGAGKALAYGAKEKGARVVIANRTFARAQELGNLIGGPALTLADLENYHPEEGMILANTTAIGMHPNVNETPLSKQALKSYAVVFDAVYTPKETRLLREAAECGATVVSGLEMFIRQAMGQFEHFTGMPVDDYKFRAIASSLDNPNTMKPRL

SEQ ID NO: 12759 - DNA, 1047 bp, Sorghum bicolor
  misc_feature: Ceres ANNOT ID no. 6113853
  misc_feature: Encodes the peptide sequence at SEQ ID NO 12760
atgtcgcggccgccgtcgccgatgctctcggtcccggagaagaagaccgccgccgccgagctcttccgcgaccgccacttcttcggcgccgcctccttctccgaaatccgcgacgcccgcgccgtcgtcgccgtcccgaacccgcaggcgcagccaccggcctcccgccgcgccctcctcctccgctaccaccggctcctcttctccgcgcgcgacgacccctgcgccttcgacgagacgctgtccttcgcctggcacgacgccttccgcccccaccttaagcacgccgccgcctccctccgcttcgagaaggccgccctcgtgttcaacgtcggcgcggccgcctcgaggatcgcggcggccgtgagccgcgccacggaggaaggggtgagggcggcgtgcggagagttccagcgcgccgcgggggcgttccgcgcggtgggggagatgatggaagaggaagaggcgacgacggtggatatgagttctcaggcctcggcgatgctggagcgcctcatgctcgcgcaggcgcaggagtgctgttttgagcgcgctctcgccgcggggagatcaccgccggtgtgctccaaagtggctaggcaggctgccctgtactatgaagaagcttatgctgcactagtggctcctccgctgcagaaccactttgaaagatcatgggtatcccatgtccaattgaaggctgctctgttcaatgcagaagcttgctataggtacagtattgaactccatgggaagacagaaattggtgaggagatatctcgattgcaggtcggaattaaggcacttgtcgatgcaaagcgaactgcaagaggagctcctggacccctgtatgactatgctttcagactagaacaagatatgaacaagagcatggagacagcgaaagaggagaattatcgtgtatatctttttcgcattccggctgccgaatcattggcctctctaccagcagcttcactcgtccgttctgcatccttgagtgagatcttggatccgaagacagaaagtagcactcaatctccataa

SEQ ID NO: 12760 - protein, 348 aa, Sorghum bicolor
  misc_feature: Ceres ANNOT ID no. 6113853
  misc_feature (7)..(348): Pfam Id: BRO1 Pfam Desc: BRO1-like domain
  misc_feature (1)..(347): NCBI GI: 49388715 NCBI Desc: alg2-interacting protein x-like [oryza sativa (japonica cultivar-group)]
  misc_feature (53)..(342): NCBI GI: 46389755 NCBI Desc: alg2-interacting protein x [nicotiana tabacum]
  misc_feature (53)..(342): NCBI GI: 15218061 NCBI Desc: hydroxyproline-rich glycoprotein family protein [arabidopsis thaliana]
  misc_feature (53)..(342): NCBI GI: 23297205 NCBI Desc: at1g15130/f9l1_7 [arabidopsis thaliana]
  misc_feature (53)..(342): NCBI GI: 144923834 NCBI Desc: helix-turn-helix, fis-type; bro1 [medicago truncatula]
MSRPPSPMLSVPEKKTAAAELFRDRHFFGAASFSEIRDARAVVAVPNPQAQPPASRRALLLRYHRLLFSARDDPCAFDETLSFAWHDAFRPHLKHAAASLRFEKAALVFNVGAAASRIAAAVSRATEEGVRAACGEFQRAAGAFRAVGEMMEEEEATTVDMSSQASAMLERLMLAQAQECCFERALAAGRSPPVCSKVARQAALYYEEAYAALVAPPLQNHFERSWVSHVQLKAALFNAEACYRYSIELHGKTEIGEEISRLQVGIKALVDAKRTARGAPGPLYDYAFRLEQDMNKSMETAKEENYRVYLFRIPAAESLASLPAASLVRSASLSEILDPKTESSTQSP

SEQ ID NO: 12761 - DNA, 1269 bp, Sorghum bicolor
  misc_feature: Ceres ANNOT ID no. 6113875
  misc_feature: Encodes the peptide sequence at SEQ ID NO 12762
atgtcagcgccaccgccggccggcggcggcggcggcggcggcagcgccctcatcaacgaggtcctcacggacgacgagctacgcgcggtgctcacgcggctgggccccgaggcggagcgggacgcgttcgggctcgtgtgccgccgctggctccggatccagagctccgagcggcggcgcctgcgcgcgcgcgccggcccggacatgctgcgccgcctcgccgcgcggttccctggagtcctggagctcgacctctctcagtcgccctcccgctccttctaccccggcgtcatcgacgacgacctcagcgttatcgccggcagcttccgcaacctgcgcgtcctcgcgctgcagaattgcaaaggtatctctgatgttggagttaccaaattgggagatggactgccatctctgcagtcccttgatgtttctcgctgcataaagctgagtgacaaaggtttgaaggcggttgcactagggtgcaaaaaattgagtcagctgcaaatcatggattgcaaattaataacagataatttattgactgctctatcaaagagctgcctacagttggtagaacttggagctgcgggatgtaacagaataacagatgctggtatatgtgctctggctgatggctgtcatcacataaaatcactagacataagcaaatgcaataaagttagtgatcctggagtctgtaagattgctgaggtttcttcatcgtgcttggtgtcaataaagctattggactgcagcaaggtgggagataagtccatctattcgttagctaagttctgccgtagcctagagactcttgtcattagtggatgtcagaacattagcgatgcttccatacaagcacttgctcttgcttgctccagcagcttacggagcctgagaatggactggtgcttgaaaataacagacacatcattgcaaagcctgctgtctaagtgtaaacttcttgtggctattgatgttggatgttgtgaccagataaccgatgatgcattccctgacggggaaggatatgggtttcagtctgaactgagagttttgaagatcagcagctgtgttcggctcacagttacaggggtcagcagattgattgaagccttcaaggctctcgagtacttggatgttcggtcatgtccgcaggttacaagggacagctgcgagcaagctggagtgcagtttcctgttggctgtaaggtgaatttcgatgggaatttgctggaatctgatccatctgctgagaggttcttctag

SEQ ID NO: 12762 - protein, 422 aa, Sorghum bicolor
  misc_feature: Ceres ANNOT ID no. 6113875
  misc_feature (223)..(422): NCBI GI: 115447487 NCBI Desc: os02g0636400 [oryza sativa (japonica cultivar-group)]
  misc_feature (96)..(388): NCBI GI: 115486415 NCBI Desc: os11g0641200 [oryza sativa (japonica cultivar-group)]
  misc_feature (96)..(388): NCBI GI: 77552216 NCBI Desc: f-box protein family, atfbl4 [oryza sativa (japonica cultivar-group)]
  misc_feature (102)..(400): NCBI GI: 116123427 NCBI Desc: ensangp00000010053 [anopheles gambiae str. pest]
  misc_feature (99)..(400): NCBI GI: 48130459 NCBI Desc: similar to ensangp00000010053 [apis mellifera]
MSAPPPAGGGGGGGSALINEVLTDDELRAVLTRLGPEAERDAFGLVCRRWLRIQSSERRRLRARAGPDMLRRLAARFPGVLELDLSQSPSRSFYPGVIDDDLSVIAGSFRNLRVLALQNCKGISDVGVTKLGDGLPSLQSLDVSRCIKLSDKGLKAVALGCKKLSQLQIMDCKLITDNLLTALSKSCLQLVELGAAGCNRITDAGICALADGCHHIKSLDISKCNKVSDPGVCKIAEVSSSCLVSIKLLDCSKVGDKSIYSLAKFCRSLETLVISGCQNISDASIQALALACSSSLRSLRMDWCLKITDTSLQSLLSKCKLLVAIDVGCCDQITDDAFPDGEGYGFQSELRVLKISSCVRLTVTGVSRLIEAFKALEYLDVRSCPQVTRDSCEQAGVQFPVGCKVNFDGNLLESDPSAERFF

SEQ ID NO: 12763 - DNA, 1722 bp, Sorghum bicolor
  misc_feature: Ceres ANNOT ID no. 6113876
  misc_feature: Encodes the peptide sequence at SEQ ID NO 12764
atgaggctaagtattggacaagtccatcgaaatgttcttgcgctggcatcttcgcggtcatgttttgttctgggagatcgtctttcgttcaggatgctgtcacagccacgggtagctggatttcatcagactgcttggcgtggtagtcaaattttagaagataatagcaggggaggaccattaactcttgctagcctagaagtgcaaagcagggttggatatgggaagaaggagaaagtggcacgaactgcagttccaaagccaagttcaagagcttcttctctcaatgtgaaaccaaaggtttcttcgaatgtcaaaccagcaaagagtgccttgatgaagtcagctggaataaagaagacactgaaggtagatgaggctatgttttcggccaagtcatttgaagaacttggtttgccacctttgcttgttgaccagttgaacaaggaaggtctgactgctccaactgaggtccaatccgctgctattcctataatagcacaaaagcatgatgtagtgatccaatcatatactggctcagggaaaactcttgcttatcttcttccaattctttctgagataggccccctgaagaggactatggaacaagataattctgagaaaagatcaggtgtagaagcagtcattgttgctccttccagagaattaggaatgcagattgtgcgagaagtggagaagattttgggtcctagtgataaaagactggtccagcaacttgttggtggagctaatcgttccaggcaagaagaagcattgaagaaaaacaagccactcattgttgttggaacacctggccgtatttctgaaatttcagcagcaggtaagctacacacccatggctgccgttttcttgtactggatgaagtcgaccagcttttgtcttttaattaccgtgaagatatgcatagaattttggagcatgttggaaggagatctggtgccacatctagggatgttcttggcccactagctaggcgatctgagcgtcagactatcttggtttctgcaacaataccattttcagttatacgagcagcaaggagttggggtcatgatccagttctcattagagctaagagtgtagttccacttgattcagtcactgtcccaagacctgcgttatcccaaagtgatgctaactccacctctccatcacagtcagtgaaccaagctgctgttggcagcttgccaccatctttggaacactactattgtacagccaaggcgcaacacaaggttgacacattacggagatgcatccatgctctggaagcacagacagtgattgcatttatgaacaacaccaagccactgaaggatgttgtattcaagttggaggcacgcggtatcaaagccactgagctacatggagatcttggaaagctcgcaaggtctacagttttgaaaaagttcaaggatggtgaattcagagttctcgttacgaatgagctgtctgccagaggactggacgtgccagaatgtgaccttgtggttaatctggaccttccaactgactctacacattacgcccacagagctggtagaaccgggcgtcttgggcggaaagggattgtggtcacaatatgcgaagaaaacgagggatttgttgtaagaaaaatgcgcaagcagttagctgtggccatcaagccatgcgagttcactgaaggcgagcttgttgttcacaaggaggatgtggaataa

SEQ ID NO: 12764 - protein, 573 aa, Sorghum bicolor
  misc_feature: Ceres ANNOT ID no. 6113876
  misc_feature (156)..(353): Pfam Id: DEAD Pfam Desc: DEAD/DEAH box helicase
  misc_feature (451)..(527): Pfam Id: Helicase_C Pfam Desc: Helicase conserved C-terminal domain
  misc_feature (1)..(573): NCBI GI: 49387967 NCBI Desc: dead/deah box helicase-like [oryza sativa (japonica cultivar-group)]
  misc_feature (14)..(571): NCBI GI: 21387213 NCBI Desc: atp-dependent rna helicase-like protein [arabidopsis thaliana]
  misc_feature (132)..(300): NCBI GI: 28211493 NCBI Desc: atp-dependent rna helicase [clostridium tetani e88]
  misc_feature (373)..(573): NCBI GI: 110683252 NCBI Desc: atp-dependent rna helicase, dead/deah box family [clostridium perfringens sm101]
  misc_feature (373)..(573): NCBI GI: 110674727 NCBI Desc: atp-dependent rna helicase, dead/deah box family [clostridium perfringens atcc 13124]
MRLSIGQVHRNVLALASSRSCFVLGDRLSFRMLSQPRVAGFHQTAWRGSQILEDNSRGGPLTLASLEVQSRVGYGKKEKVARTAVPKPSSRASSLNVKPKVSSNVKPAKSALMKSAGIKKTLKVDEAMFSAKSFEELGLPPLLVDQLNKEGLTAPTEVQSAAIPIIAQKHDVVIQSYTGSGKTLAYLLPILSEIGPLKRTMEQDNSEKRSGVEAVIVAPSRELGMQIVREVEKILGPSDKRLVQQLVGGANRSRQEEALKKNKPLIVVGTPGRISEISAAGKLHTHGCRFLVLDEVDQLLSFNYREDMHRILEHVGRRSGATSRDVLGPLARRSERQTILVSATIPFSVIRAARSWGHDPVLIRAKSVVPLDSVTVPRPALSQSDANSTSPSQSVNQAAVGSLPPSLEHYYCTAKAQHKVDTLRRCIHALEAQTVIAFMNNTKPLKDVVFKLEARGIKATELHGDLGKLARSTVLKKFKDGEFRVLVTNELSARGLDVPECDLVVNLDLPTDSTHYAHRAGRTGRLGRKGIVVTICEENEGFVVRKMRKQLAVAIKPCEFTEGELVVHKEDVE

SEQ ID NO: 12765 - DNA, 309 bp, Sorghum bicolor
  misc_feature: Ceres ANNOT ID no. 6113877
  misc_feature: Encodes the peptide sequence at SEQ ID NO 12766
atgatggcttcacgagggactagtgccgtgctttcaagagctgctcggatgaggcaaaaactgcagtctgtcttggaggccagtgccctagatattgaagatgtttcttaccaacatgccgggcatgcagctgtcaaggacaatgcaaacgagacgcacttcaacgtcaaggtagtttcaccaaaatttgaggggcagagccttgtgaagcgtcacaggatggtgtatgatcttctgagggatgagcttagctcagggctccatgctgtctccattgttgcaaaaaccccgaaagagttaggatcttga

SEQ ID NO: 12766 - protein, 102 aa, Sorghum bicolor
  misc_feature: Ceres ANNOT ID no. 6113877
  misc_feature (20)..(100): Pfam Id: BolA Pfam Desc: BolA-like protein
  misc_feature (7)..(99): NCBI GI: 23505763 NCBI Desc: at1g55800/f14j16_13 [arabidopsis thaliana]
  misc_feature (7)..(99): NCBI GI: 51968914 NCBI Desc: bola like protein [arabidopsis thaliana]
  misc_feature (7)..(99): NCBI GI: 51969538 NCBI Desc: bola like protein [arabidopsis thaliana]
  misc_feature (7)..(99): NCBI GI: 51969256 NCBI Desc: bola like protein [arabidopsis thaliana]
  misc_feature (7)..(97): NCBI GI: 89901175 NCBI Desc: bola-like protein [rhodoferax ferrireducens dsm 15236]
MMASRGTSAVLSRAARMRQKLQSVLEASALDIEDVSYQHAGHAAVKDNANETHFNVKVVSPKFEGQSLVKRHRMVYDLLRDELSSGLHAVSIVAKTPKELGS

SEQ ID NO: 12767 - DNA, 1029 bp, Sorghum bicolor
  misc_feature: Ceres ANNOT ID no. 6113970
  misc_feature: Encodes the peptide sequence at SEQ ID NO 12768
atggcggcgaccgagggcgtgctcctggggatgggcaaccccctcctcgacatctccgccgtcgtcgacgacgccttcctggcaaagtatgacatcaagctgaacaatgccattctcgctgaggagaagcacttgcctatgtatgatgagttggctagcaagagcaatgttgaatatattgctggaggagccacccaaaactctatcagggttgcccaatggatgcttcaaactcctggtgcaacaagttacatgggatgcattggaaaggacaagtttggtgaggagatgaagaaaaatgctcaagctgcaggagttactgctcattactacgaggatgagactgctcctactggcacatgtgctgtatgtgttgttggtggtgaaaggtcattgattgcaaatctgtcggcggcaaactgttacaaatctgagcatctaaagaaaccagagaactgggcactagttgagaaggcaaaatacatctacattgctggatttttccttacggtgtcgcctgattctatccagctagttgctgagcatgctgcagcaaataacaaggtgttcctgatgaacctctctgctcccttcatctgtgagtttttccgtgatgcccaagagaaggtcctcccatatgctgactacatcttcggcaatgaaactgaggcaaagatcttcgccaaagtccgaggatgggagactgagaatattgaggagattgctttgaagatctctcaacttcctttggcttctggcaagcaaaagaggattgctgtgattactcaaggtgccgacccagtggttgttgctgaggacgggaaggtgaaaacattccctgtgatcctattgcccaaggagaagcttgttgacaccaacggcgcaggtgatgctttcgttggaggcttcctctcacagttggctcagggcaagagcattgaagattccgtgagggctggttgctatgccgcgaatgttatcatccagcgcccaggctgtacttacccggagaagcctgacttcaactag

SEQ ID NO: 12768 - protein, 342 aa, Sorghum bicolor
  misc_feature: Ceres ANNOT ID no. 6113970
  misc_feature (24)..(340): Pfam Id: PfkB Pfam Desc: pfkB family carbohydrate kinase
  misc_feature (3)..(342): NCBI GI: 29367547 NCBI Desc: adenosine kinase-like protein [oryza sativa (japonica cultivar-group)]
  misc_feature (12)..(342): NCBI GI: 4582787 NCBI Desc: adenosine kinase [zea mays]
  misc_feature (5)..(342): NCBI GI: 115459446 NCBI Desc: os04g0518000 [oryza sativa (japonica cultivar-group)]
  misc_feature (5)..(342): NCBI GI: 116310218 NCBI Desc: osigba0145m07.10 [oryza sativa (indica cultivar-group)]
  misc_feature (5)..(341): NCBI GI: 92880884 NCBI Desc: adenosine kinase [medicago truncatula]
  misc_feature (5)..(342): SWISSPROT Homolog: EC 2.7.1.20 Adenosine kinase 2
  misc_feature: The sequence is a functional homolog of SEQ ID NO. 349 in the 11/188,298 US application
  misc_feature: The sequence is a functional homolog of SEQ ID NO. 302 in the 11/188,298 US application
  misc_feature: The sequence is a functional homolog of SEQ ID NO. 299 in the 11/188,298 US application
MAATEGVLLGMGNPLLDISAVVDDAFLAKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKKPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLAQGKSIEDSVRAGCYAANVIIQRPGCTYPEKPDFN

SEQ ID NO: 12769 - DNA, 195 bp, Sorghum bicolor
  misc_feature: Ceres ANNOT ID no. 6114026
  misc_feature: Encodes the peptide sequence at SEQ ID NO 12770
atgtatctccagtactacatcaacgagaagggggacaaggtctacaccaccaagaaggagtcgcctcttggggtgccgacacagtctgctcacccagctcgcttctcaccagatgacaagtactctcgccagcggtacctattgaagaagagatttgcacttttgccaactcagcagccagcaccaaagtactga

SEQ ID NO: 12770 - protein, 64 aa, Sorghum bicolor
  misc_feature: Ceres ANNOT ID no. 6114026
  misc_feature (3)..(53): Pfam Id: Nop10p Pfam Desc: Nucleolar RNA-binding protein, Nop10p family
  misc_feature (1)..(64): NCBI GI: 47847676 NCBI Desc: nucleolar rna-binding nop10p-like protein [oryza sativa (japonica cultivar-group)]
  misc_feature (1)..(64): NCBI GI: 79322535 NCBI Desc: nop10; rna binding [arabidopsis thaliana]
  misc_feature (1)..(62): NCBI GI: 8923942 NCBI Desc: nucleolar protein family a, member 3 [homo sapiens]
  misc_feature (1)..(62): NCBI GI: 123225485 NCBI Desc: nucleolar protein family a, member 3 [mus musculus]
  misc_feature (1)..(62): NCBI GI: 51467984 NCBI Desc: nucleolar protein family a, member 3 [danio rerio]
MYLQYYINEKGDKVYTTKKESPLGVPTQSAHPARFSPDDKYSRQRYLLKKRFALLPTQQPAPKY

SEQ ID NO: 12771 - DNA, 2073 bp, Sorghum bicolor
  misc_feature: Ceres ANNOT ID no. 6114066
  misc_feature: Encodes the peptide sequence at SEQ ID NO 12772
atggcttcgacgaacaaccactggctgggtttctcgctctcgggccaggataacccgcagcctaatcatcaggacagctcgcctgccgccgccggcatcgacatctccggcgccagcgacttctatggcttgcccacgcagcagggctccgacgggaatctcggcgtgccgggcctgcgggacgatcacgcttcttatggcatcatggaggccttcaacagggttcctcaagaaacccaagattggaacatgaggggattggactacaacggcggtggctcggaactctcgatgcttgtggggtccagcggcggcggcgggggcggcggcaagagggccgtggaagacagcgagcccaagctcgaagatttcctcggcggcaactcgttcgtctccgagcatgatcagtccggcggttacctgttctctggagtcccgatggccagcagcaccaacagcaacagcgggagcaacaccatggagctctccatgatcaagacctggctccggaacaaccaggtgccccagccgcagccgccagcagctccgcatcaggcgccgcagactgaggagatgagcaccgacgccaacgccagcgccagcagctttggctgctcggattcgatggggaggaacggcacggtggcggctgctgggagctcccagagcctggcgctctcgatgagcacgggctcgcacctgccgatggttgtggccggcggcggcgccagcggagcggcctcggagagcacgtcatcggagaacaagcgagcgagcggcgccatggattcgcccggcagcgcggtagaagccgtcccgaggaagtccatcgacacgttcgggcaaaggacctctatatatcgaggtgtaacaagacatagatggacagggcgatatgaggctcatctatgggataatagttgtagaagagaagggcagagtcgcaagggtaggcaaggtggctatgacaaggaagacaaggcagcaagggcttatgatttggcagctctcaagtattggggcactactacaacaacaaatttccctataagcaactatgaaaaggagctagaggaaatgaaacatatgactaggcaggagtatattgcatacctaagaagaaatagcagtggattttctcgtggcgcatcaaaatatcgtggagtaactagacatcatcagcatgggagatggcaagcaaggatagggagagttgcaggaaacaaggatctctacttgggcacattcagcaccgaggaggaggcggcggaggcctacgacatcgccgcgatcaagttccgcggtctgaacgccgtcaccaacttcgacatgagccgctacgacgtcaagagcatcctcgagagcagcacgctgcctgtcggcggcgcggccaggcgcctcaaggatgccgtggaccacgtggaggccggcgccaccatctggcgcgccgacatggacggcggcgtgatctcccagctcgccgaagccgggatgggcggctacgcctcgtacgggcaccacgcctggccgaccatcgcgttccagcagccgtcgccgctctccgtccactacccgtacgggcagccgccgtcccgcgggtggtgcaagcccgagcaggacgcggccgtcgccgccgccgcgcacagcctgcaggacctccagcagctgcacctcggcagcgcggcacacaacttcttccaggcgtcgtcgagctcggcagtctacaacagcggcggcggcggcgctagcggcgggtaccaccagggcctcggtggcggcagcagctccttcctcatgccgtcgagcactgtcgtggcgggggccgaccaggggcacagcagcagcacggccaaccaggggagcacgtgcagctacggggacgatcaccaggaagggaagctcatcgggtacgacgccatggtggcggcgaccgcagccggcggggacccgtacgccgcggcgaggagcgggtaccagttctcgtcgcagggctcgggatccacggtgagcatcgcgagggcgaacgggtactctaacaactggagctctcctttcaacggcggcatggggtga

SEQ ID NO: 12772 - protein, 690 aa, Sorghum bicolor
  misc_feature: Ceres ANNOT ID no. 6114066
  misc_feature (285)..(342): Pfam Id: AP2 Pfam Desc: AP2 domain
  misc_feature (384)..(436): Pfam Id: AP2 Pfam Desc: AP2 domain
  misc_feature (1)..(643): NCBI GI: 32490266 NCBI Desc: osjnbb0116k07.8 [oryza sativa (japonica cultivar-group)]
  misc_feature (350)..(643): NCBI GI: 70663930 NCBI Desc: osjnba0014k14.16 [oryza sativa (japonica cultivar-group)]
  misc_feature (1)..(648): NCBI GI: 115441647 NCBI Desc: os01g0899800 [oryza sativa (japonica cultivar-group)]
  misc_feature (222)..(658): NCBI GI: 144924122 NCBI Desc: pathogenesis-related transcriptional factor and erf [medicago truncatula]
  misc_feature (363)..(690): NCBI GI: 47497657 NCBI Desc: ap2/erebp transcription factor-like protein [oryza sativa (japonica cultivar-group)]
  misc_feature: The plant produces a reduced number of seeds.
  misc_feature: The sequence is a functional homolog of SEQ ID NO 1743 in the 10/374,780US patent application
  misc_feature: Useful for biocontainment applications
  misc_feature: Useful for making plants with modulated asexual embryo production
  misc_feature: Useful for making plants with modulated drought sensitivity
  misc_feature: Useful for making plants with modulated growth and phenotype characteristics
  misc_feature: GREAT-hit functional homolog of the protein sequence given in SEQ ID NO 13419
  misc_feature: GREAT-hit functional homolog of the protein sequence given in SEQ ID NO 13420
  misc_feature: The sequence is a functional homolog of SEQ ID NO 1743 in the 20060162006 US patent application
  misc_feature: Functional homolog of the protein sequence given in SEQ ID NO 13575
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: Useful for biocontainment applications
  misc_feature: Functional homolog of the protein sequence given in SEQ ID NO 13650
  misc_feature: The sequence is a functional homolog of SEQ ID NO. 274 in the 11/188,298 US application
MASTNNHWLGFSLSGQDNPQPNHQDSSPAAAGIDISGASDFYGLPTQQGSDGNLGVPGLRDDHASYGIMEAFNRVPQETQDWNMRGLDYNGGGSELSMLVGSSGGGGGGGKRAVEDSEPKLEDFLGGNSFVSEHDQSGGYLFSGVPMASSTNSNSGSNTMELSMIKTWLRNNQVPQPQPPAAPHQAPQTEEMSTDANASASSFGCSDSMGRNGTVAAAGSSQSLALSMSTGSHLPMVVAGGGASGAASESTSSENKRASGAMDSPGSAVEAVPRKSIDTFGQRTSIYRGVTRHRWTGRYEAHLWDNSCRREGQSRKGRQGGYDKEDKAARAYDLAALKYWGTTTTTNFPISNYEKELEEMKHMTRQEYIAYLRRNSSGFSRGASKYRGVTRHHQHGRWQARIGRVAGNKDLYLGTFSTEEEAAEAYDIAAIKFRGLNAVTNFDMSRYDVKSILESSTLPVGGAARRLKDAVDHVEAGATIWRADMDGGVISQLAEAGMGGYASYGHHAWPTIAFQQPSPLSVHYPYGQPPSRGWCKPEQDAAVAAAAHSLQDLQQLHLGSAAHNFFQASSSSAVYNSGGGGASGGYHQGLGGGSSSFLMPSSTVVAGADQGHSSSTANQGSTCSYGDDHQEGKLIGYDAMVAATAAGGDPYAAARSGYQFSSQGSGSTVSIARANGYSNNWSSPFNGGMG

SEQ ID NO: 12773 - DNA, 309 bp, Sorghum bicolor
  misc_feature: Ceres ANNOT ID no. 6114072
  misc_feature: Encodes the peptide sequence at SEQ ID NO 12774
atggcgagcacagcatgctttgtgattgttagtaagaatgacatcccaatctatgaggctgaagttggatctgctctcaaaaaagaagatttagctcatcagcatcagttcattttgcatgctgcattggatgttgctcaggaccttgcatggtctactaatgcaatgtttctgagatcagttgatagattcagtgacttcgtcgtgtctgtatatatattcctcaatccgctctacttgcctggttctcgcatcacatcttcctattttgataccaaggttaggacgcttgcaaggaaatacctttag

SEQ ID NO: 12774 - protein, 102 aa, Sorghum bicolor
  misc_feature: Ceres ANNOT ID no. 6114072
  misc_feature (9)..(100): Pfam Id: Sedlin_N Pfam Desc: Sedlin, N-terminal conserved region
  misc_feature (1)..(73): NCBI GI: 145337812 NCBI Desc: intracellular transporter [arabidopsis thaliana]
  misc_feature (1)..(73): NCBI GI: 32490260 NCBI Desc: osjnbb0116k07.2 [oryza sativa (japonica cultivar-group)]
  misc_feature (27)..(73): NCBI GI: 115459286 NCBI Desc: os04g0503800 [oryza sativa (japonica cultivar-group)]
  misc_feature (4)..(73): NCBI GI: 6165480 NCBI Desc: spbc11g11.04 [schizosaccharomyces pombe]
  misc_feature (7)..(73): NCBI GI: 84995370 NCBI Desc: endoplasmic reticulum transport protein [theileria annulata strain ankara]
  misc_feature: Useful for biocontainment applications
  misc_feature: Functional homolog of the protein sequence given in SEQ ID NO 12968
  misc_feature: Useful for biocontainment applications
  misc_feature: Functional homolog of the protein sequence given in SEQ ID NO 12968
MASTACFVIVSKNDIPIYEAEVGSALKKEDLAHQHQFILHAALDVAQDLAWSTNAMFLRSVDRFSDFVVSVYIFLNPLYLPGSRITSSYFDTKVRTLARKYL

SEQ ID NO: 12775 - DNA, 1743 bp, Sorghum bicolor
  misc_feature: Ceres ANNOT ID no. 6114104
  misc_feature: Encodes the peptide sequence at SEQ ID NO 12776
atgccggatctgagcaccggctacctccctcccttccctgaattctccctcgacgcggggaccctcaccgtcgaccacgccgaggatgccgccgccgccgccgccgattcggcgcccgcgtacgcgtcgtcgtccgccactgtgggcggcggcggcagcgtcgacctcattatcccagcggaatgccggtggaggagccgtgtccgcaccttcgacgtggcgggcgcggacacgggcgctgtaaccgcttgccccgccgcgcggcgcggcggcgggaagaacttgtccctgattccgtcactcgaaccggcgcggacgcagtcttcagcatcggctccgactctcgaggaacgcgtgagcgagtgggcggctaagaaggcagcggccggtgttccggctcaccactgcgtgctgcctttcctcaccggggcgccaaaagcggttgaatgccgttcgtgctccaagattatttatgctggagaagaaataaaatgttcagttaaaaaatgtctactgatgttccatctcagctgtgttgtgaaagatacttcaaacttcactgctgaaagcttcaggtgccctcaacatgggtgtatggtttgtaagcaaaagatgttcttttggcgctgcggacgttgtacagttgcagcacatacgaaatgtgcaccatggccagtggttcatctaaaagataatcaaggaagtgcaatttgctggaggcatacttctgattggctgctgcaaaatgaggaagtgttctgccggctacctcttccatatgttaacgaagacttaaatattgagtcaacccttgcagagtatgctcaggctgtttacaagccacccccctatacatctatcaggcgcataaaagatgtatatctgataaagaagaagcgcactagtgttcgtgtggatattgggtgcacaaactgcagggctgattctacttgcaaagaagactgtgaatgcaggggtatttctacgagttgttccaagaattgccgctgctcagatctatgtacaaacaggccattccgcaaggataagaaaattaaaattgtgaagacaaagcgatgtggatggggtgctgttgcgttggaaccattggagagaggtgactttgtaatcgagtatgttggtgaagtcattgatgacgcaacatgtgaacaaaggctttgggatataagatatcgtggtgacaaaaacttctacatgtgcgaaatcagcaaagattttacaatagatgcaacatttaagggaaacgtgtcacgttttctaaatcacagttgtgagcccaactgtaaactcgaaaaatggcaggttgatggtgagacaagagttggtgtctttgcctctcgttccatcaaagttggagaacccttaacttatgattacaggtttgtgcattttggagagaaagtgaagtgtcattgcgaggcagtgaactgccagggatacctgggcagccaaataaagaacccaattcaaagcattattgcttctgcaacatcacaagggcagttgcgagaagtttcgtccacacaacaagaagcttcaagattgaagccaataaaacatttattaccctggaccaactgtatagaggtctcttttaacctgagaagcaaaaggaaaattagccggctatgctgggcccacaagaagaagagaacatccctcgaggcatcctcaacaagcatgccaacatcgatgagtgaagttcctgctgcggatatctga

SEQ ID NO: 12776 - protein, 580 aa, Sorghum bicolor
  misc_feature: Ceres ANNOT ID no. 6114104
  misc_feature (344)..(473): Pfam Id: SET Pfam Desc: SET domain
  misc_feature (248)..(578): NCBI GI: 115447251 NCBI Desc: os02g0611300 [oryza sativa (japonica cultivar-group)]
  misc_feature (341)..(486): NCBI GI: 42407424 NCBI Desc: set domain protein-like [oryza sativa (japonica cultivar-group)]
  misc_feature (284)..(495): NCBI GI: 140066339 NCBI Desc: nuclear protein set; set-related region; aws [medicago truncatula]
  misc_feature (284)..(490): NCBI GI: 24021802 NCBI Desc: set domain protein 110 [zea mays]
  misc_feature (280)..(525): NCBI GI: 118572948 NCBI Desc: histone-lysine n-methyltransferase nsd3 (nuclear set domain-containing protein 3) (whsc1-like protein 1) (wolf-hirschhorn syndrome candidate 1-like protein 1 homolog)
  misc_feature (115)..(518): SWISSPROT Homolog: EC 2.1.1.43 Histone-lysine N-methyltransferase ASHR3
MPDLSTGYLPPFPEFSLDAGTLTVDHAEDAAAAAADSAPAYASSSATVGGGGSVDLIIPAECRWRSRVRTFDVAGADTGAVTACPAARRGGGKNLSLIPSLEPARTQSSASAPTLEERVSEWAAKKAAAGVPAHHCVLPFLTGAPKAVECRSCSKIIYAGEEIKCSVKKCLLMFHLSCVVKDTSNFTAESFRCPQHGCMVCKQKMFFWRCGRCTVAAHTKCAPWPVVHLKDNQGSAICWRHTSDWLLQNEEVFCRLPLPYVNEDLNIESTLAEYAQAVYKPPPYTSIRRIKDVYLIKKKRTSVRVDIGCTNCRADSTCKEDCECRGISTSCSKNCRCSDLCTNRPFRKDKKIKIVKTKRCGWGAVALEPLERGDFVIEYVGEVIDDATCEQRLWDIRYRGDKNFYMCEISKDFTIDATFKGNVSRFLNHSCEPNCKLEKWQVDGETRVGVFASRSIKVGEPLTYDYRFVHFGEKVKCHCEAVNCQGYLGSQIKNPIQSIIASATSQGQLREVSSTQQEASRLKPIKHLLPWTNCIEVSFNLRSKRKISRLCWAHKKKRTSLEASSTSMPTSMSEVPAADI

SEQ ID NO: 12777 - DNA, 741 bp, Sorghum bicolor
  misc_feature: Ceres ANNOT ID no. 6114113
  misc_feature: Encodes the peptide sequence at SEQ ID NO 12778
atggctcgcgtctacgttgggaatctggatccgcgtgtgacggcgcgggagatcgaggacgagttccgcacgtttggggttctgaggagtgtatgggttgctaggaaaccaccagggtttgccttcattgactttgatgaccgcagggatgcacaagatgccattcgtgaattggatggtaagaatggttggaaggttgagctgtcaaccaaagctggtggtggccgtggccgagaccgtaacggttctgatatgaagtgctatgagtgtggtgaatctggccactttgcacgtgagtgtcgcttacggattggttcgggaggcctgggtagtggaaggcgtcgcagccgaagtcctagatatcgtagccgaagtcgcagccgcagtccaagatatcgaaggagcccaagctatggcagaaggagctacagcccacgagatcgttctcctaggaggcgaagttacagcaggtcaccaccaggatctcgtgcacggagtctcagcaggtcaccgccgctgccgccgcctcctcccagaaataacagcaggtcaccacggggagcccgagaaatgagcaggtcaccaccaccacctcctcccagaaataacagcaggtcaccaccgggagcccgagacgtgagcaggtcgccgccaccacctcctgatgctagaagaagctatagcagatccccaggacagcagccccagcgcgatgagtccccatatgccaatgacgcctga

SEQ ID NO: 12778 - protein, 246 aa, Sorghum bicolor
  misc_feature: Ceres ANNOT ID no. 6114113
  misc_feature (4)..(70): Pfam Id: RRM_1 Pfam Desc: RNA recognition motif. (a.k.a. RRM, RBD, or RNP domain)
  misc_feature (85)..(102): Pfam Id: zf-CCHC Pfam Desc: Zinc knuckle
  misc_feature (1)..(171): NCBI GI: 68035449 NCBI Desc: pre-mrna processing factor [triticum aestivum]
  misc_feature (1)..(194): NCBI GI: 68035360 NCBI Desc: pre-mrna processing factor [triticum aestivum]
  misc_feature (1)..(194): NCBI GI: 2582645 NCBI Desc: rszp22 protein [arabidopsis thaliana]
  misc_feature (1)..(189): NCBI GI: 3435096 NCBI Desc: srz21 [arabidopsis thaliana]
  misc_feature (1)..(169): NCBI GI: 9369411 NCBI Desc: t23e23.2 [arabidopsis thaliana]
  misc_feature: The plant flowers significantly late compared to wild-type.
  misc_feature: Useful for making plants with modulated flowering time
  misc_feature: GREAT-hit functional homolog of the protein sequence given in SEQ ID NO 13547
  misc_feature: The sequence is a functional homolog of SEQ ID NO. 339 in the 11/188,298 US application
MARVYVGNLDPRVTAREIEDEFRTFGVLRSVWVARKPPGFAFIDFDDRRDAQDAIRELDGKNGWKVELSTKAGGGRGRDRNGSDMKCYECGESGHFARECRLRIGSGGLGSGRRRSRSPRYRSRSRSRSPRYRRSPSYGRRSYSPRDRSPRRRSYSRSPPGSRARSLSRSPPLPPPPPRNNSRSPRGAREMSRSPPPPPPRNNSRSPPGARDVSRSPPPPPDARRSYSRSPGQQPQRDESPYANDA

SEQ ID NO: 12779 - DNA, 720 bp, Sorghum bicolor
  misc_feature: Ceres ANNOT ID no. 6114210
  misc_feature: Encodes the peptide sequence at SEQ ID NO 12780
atggggaacatcttcgtgaagaagcccaagatcactgacgtcgacagggccatcctcaccctcaagacgcagcgccgcaagctcgcccagttccagcagcagcttgagaaggtaatcgaagcagaaaaggaagctgcacgacagctggttcaacagaagaagagagacagagctttgattgctctgaagaagaagaaagctcaggaagagttgttgaaacaagttgacacatggcaaatgaatgttgaacaacagctggcagatattgaactagcaagtaaacaaaaggctgtatttgaaagcctgaaggctggaaacgctgcccttaagtctatacagaatgagataaacattgatgatgtccaaaagctgatggatgacacagccgaggctaaggcttatcaagatgaaataaatgctgttctgggcgagcagctttcagctgaggatgaagaagctgttatggccgagtttgaaaatttggaagctcagcttgccgctgagtctttgccagacgctcctgttactgaagtacgacctgttccggctaacacagaagctgcatctgaggacatcgatgaggtcattgagcttcctgatgtgcctactaaagtgccagagaggcctgaagctccagaaaagaccaaagctagcgccgccgccgccgccgccgccgggccgacgatcgaccggtcaagcgtcaagcccgccgccgcatag

SEQ ID NO: 12780 - protein, 239 aa, Sorghum bicolor
  misc_feature: Ceres ANNOT ID no. 6114210
  misc_feature (16)..(178): Pfam Id: Snf7 Pfam Desc: Snf7
  misc_feature (1)..(216): NCBI GI: 47847826 NCBI Desc: snf7-like protein [oryza sativa (japonica cultivar-group)]
  misc_feature (1)..(190): NCBI GI: 24658229 NCBI Desc: cg4071-pa, isoform a [drosophila melanogaster]
  misc_feature (1)..(180): NCBI GI: 73917759 NCBI Desc: charged multivesicular body protein 6-1 (chromatin modifying protein 6-1)
  misc_feature (1)..(180): NCBI GI: 46250214 NCBI Desc: mgc81346 protein [xenopus laevis]
  misc_feature (1)..(205): NCBI GI: 125808614 NCBI Desc: ga17936-pa [drosophila pseudoobscura]
MGNIFVKKPKITDVDRAILTLKTQRRKLAQFQQQLEKVIEAEKEAARQLVQQKKRDRALIALKKKKAQEELLKQVDTWQMNVEQQLADIELASKQKAVFESLKAGNAALKSIQNEINIDDVQKLMDDTAEAKAYQDEINAVLGEQLSAEDEEAVMAEFENLEAQLAAESLPDAPVTEVRPVPANTEAASEDIDEVIELPDVPTKVPERPEAPEKTKASAAAAAAAGPTIDRSSVKPAAA

SEQ ID NO: 12781 - DNA, 1620 bp, Sorghum bicolor
  misc_feature: Ceres ANNOT ID no. 6114293
  misc_feature: Encodes the peptide sequence at SEQ ID NO 12782
atggcggcggggacgccggaggagcagcagcagcagcagcggagcgttgtggtcagggagaccgtggagctcacggagacggaggagcgcatcttcaaccgccttctcgaggttgttcgccacttcggcctcggcacgcagctccgcgtcgccggtggatgggtccgggacaagctattagggaaagactctgctgacattgacattgcccttgacaatatgacgggccagaatttctgtgagaaagtaaatgagtactcaaagttgataggggagcagcagaaaggaattggtgttatccagtgtaatcctgatcaatccaagcacttggaaactgctaggatgcttattctcgacatctggattgattttgttaacttgaggtctgaacaatatgctgaaaacagtcgtatccctacaatggagattggtactgctaaggaagatgcataccgcagggacttgacaattaatagtttgttctttaatgtcaacaataactcagtggaagattttactggaagaggtattgaggatctcaaaaagggccttattgttactcctttgcctgccaaagctaccttccttgatgacccacttagagttcttcgagcaataagatttgctgctagattcaactttacattagataaagatttgaaagaagctgcatctgatgaaaaggtgaagtcagagcttggtagcaagattagtagagaacgtattggtcacgagattgatctcatgatgtcagacaaacaccctgttagagcaatgtgtgacattcgtgatttggggctattttacgttgtattttcttttcctgaaaagtccaaccctccagtttttgacaagtgtgattggcagtgtgtttcgcatattgaagcagcttgggatcttgcatattctattggcagctctgtgttcagcagcggttctgaccccaagtcacaggatgagcgacgaaggctttgcttatatagttcattattcaatcccctccgaaatacgttctacttggacaaaagatctaagaaggttcctgtttctacctttattatcaaggactcactaaagttgaaaaacagcgatgctgaaatggttgtcaacatacttgctgctagcgaaaaatttgctgaactaattcctctccttgagacaaattctgatgtgtgtacactcaaagagaaattggaagatgaatatcttgagataccagaagacagtgtgaagcgtgtttttgcaggacttatactccgcgaaataaaggacttttggcgggtggcactgcttttatccattatctcctacccagaagctgaaaatgctgctgacaccctcaacaagcaggatgaactgcatcagaggaaagagaaatacatcatagttgagcatttcataactgacctagatcttgatggggtgtggaagttgaagccggtactcgacgggaagtctattatgggagttatgcaggtcaaaggaggtccactgataggaaaatggcaacaacgtgtactgaagtggcagcttgcgcatccaaacggaaccgtggatgagtgcatcgagtggatgaagcagtcacaatcgaaacgacaaaaagtagaatcgagcacctga

SEQ ID NO: 12782 - protein, 539 aa, Sorghum bicolor
  misc_feature: Ceres ANNOT ID no. 6114293
  misc_feature (48)..(186): Pfam Id: PolyA_pol Pfam Desc: Poly A polymerase head domain
  misc_feature (2)..(535): NCBI GI: 77553768 NCBI Desc: trna adenylyltransferase-like protein [oryza sativa (japonica cultivar-group)]
  misc_feature (2)..(535): NCBI GI: 115487576 NCBI Desc: os12g0171200 [oryza sativa (japonica cultivar-group)]
  misc_feature (18)..(514): NCBI GI: 1139585 NCBI Desc: trna nucleotidyltransferase
  misc_feature (7)..(286): NCBI GI: 3287692 NCBI Desc: similar to trna adenylyltransferase gbu15930 from lupinus albus. est gbaa721797 comes from this gene. [arabidopsis thaliana]
  misc_feature (22)..(382): NCBI GI: 44986068 NCBI Desc: agr118wp [eremothecium gossypii]
MAAGTPEEQQQQQRSVVVRETVELTETEERIFNRLLEVVRHFGLGTQLRVAGGWVRDKLLGKDSADIDIALDNMTGQNFCEKVNEYSKLIGEQQKGIGVIQCNPDQSKHLETARMLILDIWIDFVNLRSEQYAENSRIPTMEIGTAKEDAYRRDLTINSLFFNVNNNSVEDFTGRGIEDLKKGLIVTPLPAKATFLDDPLRVLRAIRFAARFNFTLDKDLKEAASDEKVKSELGSKISRERIGHEIDLMMSDKHPVRAMCDIRDLGLFYVVFSFPEKSNPPVFDKCDWQCVSHIEAAWDLAYSIGSSVFSSGSDPKSQDERRRLCLYSSLFNPLRNTFYLDKRSKKVPVSTFIIKDSLKLKNSDAEMVVNILAASEKFAELIPLLETNSDVCTLKEKLEDEYLEIPEDSVKRVFAGLILREIKDFWRVALLLSIISYPEAENAADTLNKQDELHQRKEKYIIVEHFITDLDLDGVWKLKPVLDGKSIMGVMQVKGGPLIGKWQQRVLKWQLAHPNGTVDECIEWMKQSQSKRQKVESST

SEQ ID NO: 12783 - DNA, 672 bp, Sorghum bicolor
  misc_feature: Ceres ANNOT ID no. 6114444
  misc_feature: Encodes the peptide sequence at SEQ ID NO 12784
atggtggacttcgttcgacggcttgcctctgtcctgctcaagtgctgcgatctcgacatacccagtcggccaaagggccttgaggaccctgaacgcttggctagagagactgtttttaatgtgaatgaaatcgaggctctgtatgagctgttcaagaagattagcagcgctgtggttgatgatggcttgattaacaaggaagaattccaattagctctgtttaagaccaacagaaaggatagcatgtttgctgatcgggtatttgacttgtttgacacgaagcacaatggaattcttgaatttgaggaatttgctcgagccctttctgtgttccatccaagtgcaccaattgatgacaaaattgattttgctttcaaactgtatgatctcaaacaacaaggtttcattgaaaagcaggaggtcaagcaaatggtggtcgcaacacttgctgaatcaggaatgaatctttcagatgatattatcgaaggcattattgataagacatttgaggaagcggatacaaagcacgacgggaaaatcgacaaggaggaatggcgtagccttgtcttgaggcatccatctttgttaaaaaatatgaccctcccatatctccgggatatcaccacaacatttccaagctttgtgttcaactcgcaagtagaggatgcgtga

SEQ ID NO: 12784 - protein, 223 aa, Sorghum bicolor
  misc_feature: Ceres ANNOT ID no. 6114444
  misc_feature (83)..(111): Pfam Id: efhand Pfam Desc: EF hand
  misc_feature (164)..(192): Pfam Id: efhand Pfam Desc: EF hand
  misc_feature (4)..(222): NCBI GI: 58397762 NCBI Desc: calcineurin b-like protein [pisum sativum]
  misc_feature (2)..(222): NCBI GI: 133925833 NCBI Desc: calcineurin b-like protein 3 [populus trichocarpa]
  misc_feature (2)..(222): NCBI GI: 115531880 NCBI Desc: calcineurin b-like protein 3 [populus euphratica]
  misc_feature (1)..(222): NCBI GI: 115531878 NCBI Desc: calcineurin b-like protein 2-2 [populus euphratica]
  misc_feature (2)..(222): NCBI GI: 60460514 NCBI Desc: calcineurin b-like protein 3 [gossypium hirsutum]
  misc_feature: Useful for making plants with modulated drought sensitivity
  misc_feature: Functional homolog of the protein sequence given in SEQ ID NO 13665
  misc_feature: Useful for making plants with modulated water use efficiency
  misc_feature: Functional homolog of the protein sequence given in SEQ ID NO 13666
  misc_feature: The sequence is a functional homolog of SEQ ID NO 2 in US patent 7250555
  misc_feature: Useful for making plants with modulated salt sensitivity
  misc_feature: Functional homolog of the protein sequence given in SEQ ID NO 13664
MVDFVRRLASVLLKCCDLDIPSRPKGLEDPERLARETVFNVNEIEALYELFKKISSAVVDDGLINKEEFQLALFKTNRKDSMFADRVFDLFDTKHNGILEFEEFARALSVFHPSAPIDDKIDFAFKLYDLKQQGFIEKQEVKQMVVATLAESGMNLSDDIIEGIIDKTFEEADTKHDGKIDKEEWRSLVLRHPSLLKNMTLPYLRDITTTFPSFVFNSQVEDA

SEQ ID NO: 12785 - DNA, 396 bp, Sorghum bicolor
  misc_feature: Ceres ANNOT ID no. 6114514
  misc_feature: Encodes the peptide sequence at SEQ ID NO 12786
atgagccggggcaacggcggcagcggcgtgaggagcactcggctggagctgcagctgaacctgtccccaccggtggggatggaggtggacggcggcggcgtgcaagacgacagcgactcgtcgtcgccgagctcgtgcgtgtcgtcggacgggcggagctcgagcggcggcggcagccccgggggcaagtcgccgatggtgatcggcgcctgcacgcggtgcctcatgtactgcatggtggccaagaaggattacccgacctgcatcaactgcaagcagccgtgcctggtggacctcctccacggcgaggccggtggccgtggcggtggcggtggtgccagcgaggccgccgccggcgacaagaagcagcagcagcagcgcggcaagcgcaagtga

SEQ ID NO: 12786 - protein, 131 aa, Sorghum bicolor
  misc_feature: Ceres ANNOT ID no. 6114514
  misc_feature (1)..(114): NCBI GI: 116309338 NCBI Desc: h0622f05.5 [oryza sativa (indica cultivar-group)]
  misc_feature (2)..(98): NCBI GI: 15290114 NCBI Desc: p0423b08.15 [oryza sativa (japonica cultivar-group)]
  misc_feature (40)..(113): NCBI GI: 90399140 NCBI Desc: h0913c04.5 [oryza sativa (indica cultivar-group)]
MSRGNGGSGVRSTRLELQLNLSPPVGMEVDGGGVQDDSDSSSPSSCVSSDGRSSSGGGSPGGKSPMVIGACTRCLMYCMVAKKDYPTCINCKQPCLVDLLHGEAGGRGGGGGASEAAAGDKKQQQQRGKRK

SEQ ID NO: 12787 - DNA, 918 bp, Sorghum bicolor
  misc_feature: Ceres ANNOT ID no. 6114538
  misc_feature: Encodes the peptide sequence at SEQ ID NO 12788
atggcgatcaacaacgacgacgaccggtgctgcccagcgttcgcgggagccgacgacggcgccgagagcgcgacgtccatcgaggacctgcccacggacgtcctgtccctcgtgctccgccgcctcgacggcgcgtcgctggccgcgctcggctgcgcgtccgccgccttccgcggcctcgccgccgacccggccgcctggcgcgcgctctgcctcgcgctctggccctcgctccgcgacgtgcctccgtgctgcgaccaccgccggctcttcgccgacgcgttcccgttccccgccgtgccgctggcagcactgccgccacagccaccaacgcccggcggcggcggcggcgccggcagcagcctcccgccgctgccgtcgcgcctcgtctcggccgtcgacctccggcatggcggcgcgtgcgtcatgtcccgcgcggtggagacggacgcgtcggcggcctggttcctgggcgcgccgttccgcgtcgacgcgctcacgcgggagggcttcacgttgccccgccgccccgtgtccgtggaccggcggtggctcacgggggagaccgtggtgcggttcgcgctcgtcctcggcggcggcgtcgtgctggacgccgccgtcacgtgcgacgagcggtacggacatgtcagggaggtcagcctgtgcatggaggacgccgagggcggcggcggcgtcagcggccgggatgggctggccgtggtcgccgcggccatggcaggcgccagacggggacgtggcgctgaagaggacaccagggtgcggtaccaagagttcgtgaaggggagggcggacaggaaggagcggaaggcccgccgggagggcatcatcgacctctgctgctccggcgtcggagcggcggcgttcgtggggttcctggtcatgctcacattccggtga

SEQ ID NO: 12788 - protein, 305 aa, Sorghum bicolor
  misc_feature: Ceres ANNOT ID no. 6114538
  misc_feature (25)..(72): Pfam Id: F-box Pfam Desc: F-box domain
  misc_feature (30)..(96): NCBI GI: 92866991 NCBI Desc: cyclin-like f-box [medicago truncatula]
  misc_feature (126)..(226): NCBI GI: 115458308 NCBI Desc: os04g0414500 [oryza sativa (japonica cultivar-group)]
MAINNDDDRCCPAFAGADDGAESATSIEDLPTDVLSLVLRRLDGASLAALGCASAAFRGLAADPAAWRALCLALWPSLRDVPPCCDHRRLFADAFPFPAVPLAALPPQPPTPGGGGGAGSSLPPLPSRLVSAVDLRHGGACVMSRAVETDASAAWFLGAPFRVDALTREGFTLPRRPVSVDRRWLTGETVVRFALVLGGGVVLDAAVTCDERYGHVREVSLCMEDAEGGGGVSGRDGLAVVAAAMAGARRGRGAEEDTRVRYQEFVKGRADRKERKARREGIIDLCCSGVGAAAFVGFLVMLTFR

SEQ ID NO: 12789 - DNA, 240 bp, Sorghum bicolor
  misc_feature: Ceres ANNOT ID no. 6114672
  misc_feature: Encodes the peptide sequence at SEQ ID NO 12790
atgaggcgctgcagcagcaagatctcctcatcaccgccccttgtcgctctcgctctcctcttcctcctcgtcgtcgtctgctcctcctcctcctccttccatggcgcggcagctgctcgccccctgcagcctgctgttcctcttcctcctctgattgctcaccatgtctcatccgagaggcggctgctccacgacgcgcacctcgactacatctacacgcagcacaagggcaagccatga

SEQ ID NO: 12790 - protein, 79 aa, Sorghum bicolor
  misc_feature: Ceres ANNOT ID no. 6114672
  misc_feature (22)..(78): Pfam Id: PSK Pfam Desc: Phytosulfokine precursor protein (PSK)
  misc_feature (59)..(79): NCBI GI: 110294434 NCBI Desc: phytosulfokine-alpha 1 precursor [triticum aestivum]
  misc_feature (59)..(79): NCBI GI: 18202716 NCBI Desc: phytosulfokines 2 precursor [contains: phytosulfokine-alpha (psk-alpha) (phytosulfokine-a); phytosulfokine-beta (psk-beta) (phytosulfokine-b)]
MRRCSSKISSSPPLVALALLFLLVVVCSSSSSFHGAAAARPLQPAVPLPPLIAHHVSSERRLLHDAHLDYIYTQHKGKP

SEQ ID NO: 12791 - DNA, 918 bp, Sorghum bicolor
  misc_feature: Ceres ANNOT ID no. 6115160
  misc_feature: Encodes the peptide sequence at SEQ ID NO 12792
atgggcagcgaggacgcgctcgtcgagatccaccccggcgagctccgcttcctcgttgaggtgaagaagaagagttcatgttgtatccgtcttgttaataagtcagatcaatatgtagcattcaaggttaaaacaacttctccaaaaaaatattgtgttcgaccaaatataggcgttattcttccattggcatcacgtgattttacagttactatgcaagcgctaaagaatgctccacttgatttgcaaacaaaagacaagtttcttgtgcagaccacagttgttccgtttggtacagctgatgagggcattgttcctgcttttttctccaaagaaactggtcaatatattgaggagaagaagttgaaagttgtcactgtcagcataacagagcctcaagtacagcagctcatcaatggagttccccatgccaaggaaacagctggggttcttgtgacagagcagacactagataatgtgaatgaagcacctaatgtggcgaatgaagttcctaattctctgaaagcaagctttccctctttaaaagcaagtgtagatctgaaagaatctccaccaccagaatatactcctgctccaagtgaagttccatcgttaagtgataaagaatctaccagtgctgataatgttcatatacctcaggtaaccaaagatgttcaaaatttaccgatgaaacttaacaaccttgaagtaaaacttgaagaggctaaaactttgattgtaaaattgagggaagcaaacagagctaccatccaagagcgggataaattgcggaaagagatggtgttattgaaaagggcgggcgctgcacggagtcagtccagcaccggtttccccctgcttttcgtcatctacatggcagttgttggcatttcgctcggttaccttctgcacctatga

SEQ ID NO: 12792 - protein, 305 aa, Sorghum bicolor
  misc_feature: Ceres ANNOT ID no. 6115160
  misc_feature (7)..(114): Pfam Id: Motile_Sperm Pfam Desc: MSP (Major sperm protein) domain
  misc_feature (7)..(304): NCBI GI: 140062643 NCBI Desc: major sperm protein [medicago truncatula]
  misc_feature (7)..(194): NCBI GI: 79317397 NCBI Desc: vap27-2 (vamp/synaptobrevin-associated protein 27-2); structural molecule [arabidopsis thaliana]
  misc_feature (1)..(132): NCBI GI: 92872094 NCBI Desc: major sperm protein [medicago truncatula]
  misc_feature (1)..(132): NCBI GI: 115459632 NCBI Desc: os04g0534400 [oryza sativa (japonica cultivar-group)]
  misc_feature (1)..(132): NCBI GI: 116310461 NCBI Desc: osigba0159i10.10 [oryza sativa (indica cultivar-group)]
  misc_feature: The sequence is a functional homolog of SEQ ID NO. 356 in the 11/188,298 US application
MGSEDALVEIHPGELRFLVEVKKKSSCCIRLVNKSDQYVAFKVKTTSPKKYCVRPNIGVILPLASRDFTVTMQALKNAPLDLQTKDKFLVQTTVVPFGTADEGIVPAFFSKETGQYIEEKKLKVVTVSITEPQVQQLINGVPHAKETAGVLVTEQTLDNVNEAPNVANEVPNSLKASFPSLKASVDLKESPPPEYTPAPSEVPSLSDKESTSADNVHIPQVTKDVQNLPMKLNNLEVKLEEAKTLIVKLREANRATIQERDKLRKEMVLLKRAGAARSQSSTGFPLLFVIYMAVVGISLGYLLHL

SEQ ID NO: 12793 - DNA, 309 bp, Sorghum bicolor
  misc_feature: Ceres ANNOT ID no. 6115399
  misc_feature: Encodes the peptide sequence at SEQ ID NO 12794
atgagaatggaagggctgctgtacagcaaggtgcaggaggggaagctcttcgccttgcaccgcgtcaacaccgccctacagggccccttcttctctgtgttcgacatctcaccaggctcgccgttgacctcgaccagggagctcccggtgatgctcgaggcctcccgaagccccggtgccgccaacgctgccacatgggacttcttcgctgcgggcaagggatcccacaaggtctccctcggtggtgatttcagcatccaggttagtccaggccatccaagtccaggctttatgggggtatccatttag

SEQ ID NO: 12794 - protein, 102 aa, Sorghum bicolor
  misc_feature: Ceres ANNOT ID no. 6115399
  misc_feature (5)..(92): NCBI GI: 115441083 NCBI Desc: os01g0851400 [oryza sativa (japonica cultivar-group)]
  misc_feature (5)..(88): NCBI GI: 20805182 NCBI Desc: ataxin 3-like protein [oryza sativa (japonica cultivar-group)]
  misc_feature (5)..(88): NCBI GI: 38604054 NCBI Desc: at3g54130 [arabidopsis thaliana]
MRMEGLLYSKVQEGKLFALHRVNTALQGPFFSVFDISPGSPLTSTRELPVMLEASRSPGAANAATWDFFAAGKGSHKVSLGGDFSIQVSPGHPSPGFMGVSI

SEQ ID NO: 12795 - DNA, 1590 bp, Sorghum bicolor
  misc_feature: Ceres ANNOT ID no. 6115452
  misc_feature: Encodes the peptide sequence at SEQ ID NO 12796
atggacttctcggaacaggacgtcgacgtcttcggcgaggactacgacgtccacgacggcggcgccgaggccgaggccgacggcggcggggactcgtcgggctcctcctccccgtcctcgtcctcgtcgtcctctgccgccgcgtcctcctcatcctcaagtggcggctcaagccgtagcagcagcggcggcgctgccggtgagggcgaggatggcgccgacgagggggacggtgaggaatacgattcgtccaacctcacagccgcgaggggcgctggcgccgccggctaccgggacgatgagaagggggattatgaggacgaggaggtagaggagagagatttgttcggctcagacaacgaagagtacgtcagaaccccggcgcgcagcaactacctagtcccagtgcttcctgcgatacggaacactaataatcattcccgaggaggcttcggaggacgaggtggtagaggcccaccacttcttccaaggccaggaggccatccagggcgacataactttggttatgggagatttgggaatgggcgtcatgttgaaggtttagtttcagacatgaagcttaataagagcgaagaaacattgtctagaaaagctgttacttttcaagagccttgtgagattgcatgcttaagtcgtgttgatggtggagaggtgtattttgatgatcgcagcttgaggctcttcaaacgtgaaatctgtgattacgttggtgcagatctcaataaaggattcgagacatttatagagaagagagatttgggttctgaaggatttggcgatctactcgcatgcatacgaaattccaacatacttcttcagcatactatacattttgtgacataccgcaacaatcttaacaagatattggccactgcttacctaagagaaccatggaagatgggcgttcataaaagaaagggtgttgtataccttgatgttcataagctccctgaaagaccaaaaagtgaagtggagcgtaggagatgttattggggctattcttttgaaaatcttgccactgagaactcattcagcgacgatggaagaggtattgatgcaaatgtagagttttgttctgtaataaagacaaaattgggtgcccatcgcattgtcatgggtgctgagatggactgctgtgatgcaactgatgatggcaggcggttctatgtggagttgaaaacaagcagagagctggagtaccatacagtggaagcatatgagaaagaaaagctacttagattttggattcaatcgttccttgctggtgttccttatgttgttgtgggattcaggaatgatgctggcatacttgtacgaacggaaagactaagaaccaaagatattacacaaaaggtgaaggcaaagaactactggcagggtggcgtttgcctggcctttgccgatgaggtcttatgctggttatatgggactgtcagagagaatgaagactatgttcttcaatttgtacatccatttaaccgcctggaacttatacgagcccagtccccctgtccagaagccataacgttgcatgtgcagcagctctcagtctcaggtgcagcagactag

SEQ ID NO: 12796 - protein, 529 aa, Sorghum bicolor
  misc_feature: Ceres ANNOT ID no. 6115452
  misc_feature (383)..(447): Pfam Id: RAI1 Pfam Desc: RAI1 like
  misc_feature (1)..(438): NCBI GI: 115463697 NCBI Desc: os05g0392100 [oryza sativa (japonica cultivar-group)]
  misc_feature (9)..(522): NCBI GI: 89257693 NCBI Desc: glycine-rich protein -related [brassica oleracea]
  misc_feature (414)..(522): NCBI GI: 46487751 NCBI Desc: glycine-rich protein [haloxylon ammodendron]
  misc_feature (337)..(508): NCBI GI: 66845198 NCBI Desc: hla class iii protein dom3z [aspergillus fumigatus af293]
  misc_feature (337)..(508): NCBI GI: 74667615 NCBI Desc: protein rai1
MDFSEQDVDVFGEDYDVHDGGAEAEADGGGDSSGSSSPSSSSSSSAAASSSSSSGGSSRSSSGGAAGEGEDGADEGDGEEYDSSNLTAARGAGAAGYRDDEKGDYEDEEVEERDLFGSDNEEYVRTPARSNYLVPVLPAIRNTNNHSRGGFGGRGGRGPPLLPRPGGHPGRHNFGYGRFGNGRHVEGLVSDMKLNKSEETLSRKAVTFQEPCEIACLSRVDGGEVYFDDRSLRLFKREICDYVGADLNKGFETFIEKRDLGSEGFGDLLACIRNSNILLQHTIHFVTYRNNLNKILATAYLREPWKMGVHKRKGVVYLDVHKLPERPKSEVERRRCYWGYSFENLATENSFSDDGRGIDANVEFCSVIKTKLGAHRIVMGAEMDCCDATDDGRRFYVELKTSRELEYHTVEAYEKEKLLRFWIQSFLAGVPYVVVGFRNDAGILVRTERLRTKDITQKVKAKNYWQGGVCLAFADEVLCWLYGTVRENEDYVLQFVHPFNRLELIRAQSPCPEAITLHVQQLSVSGAAD

SEQ ID NO: 12797 - DNA, 1422 bp, Sorghum bicolor
  misc_feature: Ceres ANNOT ID no. 6115495
  misc_feature: Encodes the peptide sequence at SEQ ID NO 12798
atggcggacgcgttctccccgccttcgccgccaccggcaccggcaccatccccatcccctatcgccgcggacgacctcgcggacgcgcggctcgcgccgtggacgacgtcgttctccccgtggccggcgccgcgcggggaccatgccagcggcggcggtcgggcgaatccgctcttcaccatactgccagtctcggctctggccataggcctcgtgctgctcgtcgccgtggccgtcatcctggcggtgacacgccgggcgaggccgcgccaggcggacgccagcggcagctgcagcggcgacggcaagccgggcgcaccgccgtccagctgcggcagccataacaccaggtgcggctacgccgccgccggcacagggtgcatatacgccggccgtctcgtggggttctcggctgcgcagccgcggagccgtggcgcgcaggtgttcacgtaccgggagctggagcgcgccacggacgggttcagcgagtgcaacgtggtggggcggggcgcctccggcgcggtcttccgcggccggctcgccgacggcaccaccgccgccatcaagcggctaaggcttgaccaccggcggcagggcgagcgcgagttccgcatcgaggtggacctgctgagccggatggactcgccgtacctggtggggctgctgggctactgcgccgaccagagccaccggctgctggtgttcgagtacatgcccaacggcagcctcaagagccacctccacccgccccggccgccgccgccgccgctggactggcagacgcggctgggcatcgcgctggactgcgcgcgcgcgctcgagttcctgcacgagcacagcagccccgccgtgatccaccgcgacttcaactgcagcaacgtcctgctggaccacaactaccgcgcccgcgtctccgacttcggcatggccaaggtcggctccaacaaggccgacgggcaggtcgtcacccgcgtgctcggcaccaccggctacctcgcgccagagtacgcgtcgacggggaagctgacgaccaagtcggacgtgtacagctacggggttgtgctcctggagctgctcaccggccgcgtaccggtggacacgcagcggccgcctggagagcatgtcctggtttcctgggcacttccgcgactcacgaatcgccagaaactcgtgcagatggttgaccctgccctgaaaggccagtttgccctgaaggatctgatccaggtcgccgccatcgccgcgatgtgcatccagacgaaggcggagtaccggccgctgatgacggacgtggtgcagtcgctgatccccatcgccaagaccaccccggccatgtcctgctcctccacgccgctcagaccggccttgcagcacgtcatcttcatgggcccgcagtgcggcggcaacaagatctcctcctag

SEQ ID NO: 12798 - protein, 473 aa, Sorghum bicolor
  misc_feature: Ceres ANNOT ID no. 6115495
  misc_feature (161)..(435): Pfam Id: Pkinase_Tyr Pfam Desc: Protein tyrosine kinase
  misc_feature (161)..(435): Pfam Id: Pkinase Pfam Desc: Protein kinase domain
  misc_feature (57)..(450): NCBI GI: 140068251 NCBI Desc: protein kinase [medicago truncatula]
  misc_feature (57)..(450): NCBI GI: 140047230 NCBI Desc: protein kinase [medicago truncatula]
  misc_feature (61)..(440): NCBI GI: 42562758 NCBI Desc: protein kinase family protein [arabidopsis thaliana]
  misc_feature (145)..(450): NCBI GI: 7630064 NCBI Desc: serine/threonine-specific protein kinase-like protein [arabidopsis thaliana]
  misc_feature (145)..(450): NCBI GI: 42566031 NCBI Desc: protein kinase family protein [arabidopsis thaliana]
  misc_feature: The sequence is a functional homolog of SEQ ID NO. 312 in the 11/188,298 US application
  misc_feature: The sequence is a functional homolog of SEQ ID NO. 323 in the 11/188,298 US application
  misc_feature: The sequence is a functional homolog of SEQ ID NO. 520 in the 11/188,298 US application
  misc_feature: The sequence is a functional homolog of SEQ ID NO. 446 in the 11/188,298 US application
  misc_feature: The sequence is a functional homolog of SEQ ID NO. 495 in the 11/188,298 US application
  misc_feature: The sequence is a functional homolog of SEQ ID NO. 391 in the 11/188,298 US application
  misc_feature: The sequence is a functional homolog of SEQ ID NO. 399 in the 11/188,298 US application
  misc_feature: The sequence is a functional homolog of SEQ ID NO. 340 in the 11/188,298 US application
  misc_feature: The sequence is a functional homolog of SEQ ID NO. 464 in the 11/188,298 US application
  misc_feature: The sequence is a functional homolog of SEQ ID NO. 310 in the 11/188,298 US application
  misc_feature: The sequence is a functional homolog of SEQ ID NO. 311 in the 11/188,298 US application
  misc_feature: The sequence is a functional homolog of SEQ ID NO. 498 in the 11/188,298 US application
  misc_feature: The sequence is a functional homolog of SEQ ID NO. 358 in the 11/188,298 US application
  misc_feature: The sequence is a functional homolog of SEQ ID NO. 441 in the 11/188,298 US application
MADAFSPPSPPPAPAPSPSPIAADDLADARLAPWTTSFSPWPAPRGDHASGGGRANPLFTILPVSALAIGLVLLVAVAVILAVTRRARPRQADASGSCSGDGKPGAPPSSCGSHNTRCGYAAAGTGCIYAGRLVGFSAAQPRSRGAQVFTYRELERATDGFSECNVVGRGASGAVFRGRLADGTTAAIKRLRLDHRRQGEREFRIEVDLLSRMDSPYLVGLLGYCADQSHRLLVFEYMPNGSLKSHLHPPRPPPPPLDWQTRLGIALDCARALEFLHEHSSPAVIHRDFNCSNVLLDHNYRARVSDFGMAKVGSNKADGQVVTRVLGTTGYLAPEYASTGKLTTKSDVYSYGVVLLELLTGRVPVDTQRPPGEHVLVSWALPRLTNRQKLVQMVDPALKGQFALKDLIQVAAIAAMCIQTKAEYRPLMTDVVQSLIPIAKTTPAMSCSSTPLRPALQHVIFMGPQCGGNKISS

SEQ ID NO: 12799 - DNA, 720 bp, Sorghum bicolor
  misc_feature: Ceres ANNOT ID no. 6115497
  misc_feature: Encodes the peptide sequence at SEQ ID NO 12800
atggcgagctctcagtgctgcgataacccgccggccctgaacccggcctgcggggagggcaaggtcgtcgacagcttcggcgggctcaaggcctacgtcgccggccccgaggactccaaggccgccgtcgtcctcgtcgccgacgtcttcggattcgaagcgccgattctgaggaagatagccgacaaggttgcttcgtcagggtactttgttgtggtaccagatttctttcatggggatccttatgtacctgagaatgggaagcccatccctgagtggctaaagtcacatactccggaaaaagggtttgaagaggcaaaaccagttattgcgactctaaaggagaagggagtgtctgctgttggagctgcagggtattgctggggtgcaaaggttgttgtggagttggcaaaagctcatgagatccaagctgctgtactgttgcacccttcttttgttaccattgacgatatcaaagaggtcaaatgcccaatttctatactcggagctgagattgacaaaatgtccccaccagagttagtcaagcaattcgagcaggtcctttctgtgaactcaggggttggtcactttgtcaagatcttccctggtgtggcgcatggatggagcgtgagatacagccacgacgacgcagctgccgtgaagagtgctgaggaagcctttgcggacatgctcgactggttcaataagaacctgaaatga

SEQ ID NO: 12800 - protein, 239 aa, Sorghum bicolor
  misc_feature: Ceres ANNOT ID no. 6115497
  misc_feature (29)..(238): Pfam Id: DLH Pfam Desc: Dienelactone hydrolase family
  misc_feature (1)..(239): NCBI GI: 115463749 NCBI Desc: os05g0399100 [oryza sativa (japonica cultivar-group)]
  misc_feature (1)..(239): NCBI GI: 79313339 NCBI Desc: hydrolase [arabidopsis thaliana]
  misc_feature (5)..(239): NCBI GI: 115475453 NCBI Desc: os08g0238200 [oryza sativa (japonica cultivar-group)]
  misc_feature (4)..(239): NCBI GI: 115475465 NCBI Desc: os08g0239300 [oryza sativa (japonica cultivar-group)]
  misc_feature (2)..(188): NCBI GI: 3822036 NCBI Desc: endo-1,3-1,4-beta-d-glucanase [zea mays]
MASSQCCDNPPALNPACGEGKVVDSFGGLKAYVAGPEDSKAAVVLVADVFGFEAPILRKIADKVASSGYFVVVPDFFHGDPYVPENGKPIPEWLKSHTPEKGFEEAKPVIATLKEKGVSAVGAAGYCWGAKVVVELAKAHEIQAAVLLHPSFVTIDDIKEVKCPISILGAEIDKMSPPELVKQFEQVLSVNSGVGHFVKIFPGVAHGWSVRYSHDDAAAVKSAEEAFADMLDWFNKNLK

SEQ ID NO: 12801 - DNA, 915 bp, Sorghum bicolor
  misc_feature: Ceres ANNOT ID no. 6115509
  misc_feature: Encodes the peptide sequence at SEQ ID NO 12802
atggcgtcgaaatgggcggcgagggtaccgtctccacggtgggcggcgcggcgcggctgggtgggctcatgggtttcggtccgcccagcgaaatgcggaggacgtgccgttgtgtgcgccgccgttagcttcagaccatgcatcgacattcacaaggggaaagttaaacagattgttggctctactcttcgggattcatccaatgatggcatggaacttgtgacaaactttgaatcagacaaatctcctgcagagtttgcaaaattttataaggaagatgaacttcttggaggacatgttataatgcttggcgcagatcctgcaagccaggctgctgcactggaggcactacgtgcatatcctggtggtttgcaacttggaggtggaataaatttggagaatgcaatgtcttaccttaatgaaggggccagtcatgtgatagtgacctcttatgtgtttagtgatggcaagatgaacactgaaaggctaagaaaacttgtcaagctggttgggaaacagaagcttgtgctggaccttagctgtcgaaaaaaggatggcagatataccattgtaactgacaggtggcaaaagttcagtgatgtgtttgtggatgaaccaacattagaatatctcgctgcctttgcagatgagtttttggttcatggtgttgatgtggagggcaaaaggttaggaattgatgaggaacttgtggaactattggggcatcattcaccaatcccagtaacttatgctgggggtgtgtcaacaattgatgacctggagaggataaagaaagcaggcaaaagtcgagtagatgtaactgttgggagtgctctagatatatttgggggagatttgccttacaaagatgttgtcctttggcacaagaagcaaagtatgtttagtcaagtgtga

SEQ ID NO: 12802 - protein, 304 aa, Sorghum bicolor
  misc_feature: Ceres ANNOT ID no. 6115509
  misc_feature (46)..(287): Pfam Id: His_biosynth Pfam Desc: Histidine biosynthesis protein
  misc_feature (35)..(298): NCBI GI: 55953220 NCBI Desc: bbmii isomerase [arabidopsis thaliana]
  misc_feature (42)..(298): NCBI GI: 93452729 NCBI Desc: phosphoribosylformimino-5-aminoimidazole carboxamide ribotide isomerase, eukaryotic [delta proteobacterium mlms-1]
  misc_feature (145)..(303): NCBI GI: 115463769 NCBI Desc: os05g0400800 [oryza sativa (japonica cultivar-group)]
  misc_feature (42)..(300): NCBI GI: 51243857 NCBI Desc: probable phosphoribosylformimino-5-aminoimidazole carboxamide ribotide isomerase [desulfotalea psychrophila lsv54]
  misc_feature (42)..(297): NCBI GI: 126654195 NCBI Desc: phosphoribosylformimino-5-aminoimidazole carboxamide ribotide isomerase [bacillus sp. b14905]
  misc_feature (35)..(298): SWISSPROT Homolog: EC 5.3.1.16 1-(5-phosphoribosyl)-5-[(5-phosphoribosylamino)methylideneamino] imidazole-4-carboxamideisomerase, chloroplast precursor
MASKWAARVPSPRWAARRGWVGSWVSVRPAKCGGRAVVCAAVSFRPCIDIHKGKVKQIVGSTLRDSSNDGMELVTNFESDKSPAEFAKFYKEDELLGGHVIMLGADPASQAAALEALRAYPGGLQLGGGINLENAMSYLNEGASHVIVTSYVFSDGKMNTERLRKLVKLVGKQKLVLDLSCRKKDGRYTIVTDRWQKFSDVFVDEPTLEYLAAFADEFLVHGVDVEGKRLGIDEELVELLGHHSPIPVTYAGGVSTIDDLERIKKAGKSRVDVTVGSALDIFGGDLPYKDVVLWHKKQSMFSQV

SEQ ID NO: 12803 - DNA, 507 bp, Sorghum bicolor
  misc_feature: Ceres ANNOT ID no. 6115972
  misc_feature: Encodes the peptide sequence at SEQ ID NO 12804
atgggtagtaggggccgcagcagctactacggtaaccgtggtggcgttggattcttcggatcatcgtcgtcagagcgcctcctccacccggcggcggcccggcacgacgtctctgcctccgccgccgtggccgaccacctcgccgacctggacgaggaggacgtctggtcggctgtcaccaccaacgacaataaccagcaccaccgggacggcggcgccctggtgcatcatcgtcgcccagacccagcgtacggcctgtcgctcgcgttcgaggccgcgcccgcgcggcactcggcgccggtcagcgtccccgagtggcccgccgccactttgccggattatgacggcggcgacctcgagtgggtgcctccgcacgagtacctgcagcggcggtggtgcggagcaggaggggcgtcggtgctggagggcgccgggcggacgctcaagggccgcgacatcacacgcgtgcgcgacgccgtctggagcaagaccggattcttcggctag

SEQ ID NO: 12804 - protein, 168 aa, Sorghum bicolor
  misc_feature: Ceres ANNOT ID no. 6115972
  misc_feature (122)..(166): NCBI GI: 116310726 NCBI Desc: osigba0131l05.3 [oryza sativa (indica cultivar-group)]
  misc_feature (94)..(166): NCBI GI: 21741306 NCBI Desc: osjnbb0103i08.8 [oryza sativa (japonica cultivar-group)]
  misc_feature (92)..(166): NCBI GI: 56785008 NCBI Desc: prolyl 4-hydroxylase alpha subunit-like [oryza sativa (japonica cultivar-group)]
  misc_feature (120)..(166): NCBI GI: 15983450 NCBI Desc: at3g15040/k15m2_18 [arabidopsis thaliana]
  misc_feature (139)..(166): NCBI GI: 94982649 NCBI Desc: prolyl 4-hydroxylase alpha subunit-like [musa acuminata]
MGSRGRSSYYGNRGGVGFFGSSSSERLLHPAAARHDVSASAAVADHLADLDEEDVWSAVTTNDNNQHHRDGGALVHHRRPDPAYGLSLAFEAAPARHSAPVSVPEWPAATLPDYDGGDLEWVPPHEYLQRRWCGAGGASVLEGAGRTLKGRDITRVRDAVWSKTGFFG

SEQ ID NO: 12805 - DNA, 1497 bp, Sorghum bicolor
  misc_feature: Ceres ANNOT ID no. 6115995
  misc_feature: Encodes the peptide sequence at SEQ ID NO 12806
atggcggcggccatcctagcgcccaagccgcctccttcgctgcctacaagcgcctttccttcctccttcccctccccctcgcggctctgcctctccccgcggcatcccctgacaagattgctcctccgccccattccgtgcgcctcatcgccgtcctcctccgtcttgatgccggacccggacccggacctcgagcctgagcctgcccacgatagagatagagcccaagacgaggcgccggagtccaggccccgccgcatcgccctcttcgtcgagccttcgcccttcgcctacgtctccggctacaagaaccgcttccagaacttcatcaagtacctccgggagatgggcgacgaggtgattgtggtcaccacgcacgagggcgtgcctcaggaattccacggggccaagctaattggctcatggagcttcccttgcccctggtatcaaaaggttccgctgtcgctggccctcagtcctcgaatcatcggagaagttgctagattcaagcctgacattattcatgcctcttcccctgggataatggtatttggcgcgcttatcatagcaaagttgctctgcgtccctctggtaatgtcataccacacccacgttccaatttatatacccagatatacattcagctggcttgtcaagcccatgtggctaattataaaattcttgcaccgagctgcggacctcacgctggtaccatccgttgctatcggcagggatcttcaagctgcccatgttacagcagccaataaaatacgcctttggaacaagggtgttgactcagaaagcttccatcctcgttttcgcgatatggaaatgcgttcaagaaatggcaaaccagaaaagccacttatattttatgttgggcgcttaggagttgagaaaagcttggattttcttaagagagtcatggaccgacttccaggagcaaggatcgcatttattggagatggcccattcagggctgagcttgagcagatgttctcaggtatgccggcggtgttcacgggcacgttgcaaggggaagagctatcacaggcctatgccagcggggatgtgtttgtgatgccttccgagtcagagacgctgggttttgtggtgctggaggccatgtcatcgggaattccggtagtgggggctcgcgctggaggaattcctgatatcatacctgaggatcaggaggggaagaccagctttctgtacacaccaggggatgtggatgactgtgttggcaagatcgggcagcttctgtcaagcgaggagctgagggaggccatggggagggctgccaggaaggagatggagaagtttgactggcgagcagcaacgaggaagatccggaacgagcagtacagtgctgcgatctggttctggcgcaagaagagggcacagctgctgcgacccctccagtgggcgctgcggctgctgaggccgacaacgtctggggctgccattgccgatgccatggcgaagcaatcatag

SEQ ID NO: 12806 - protein, 498 aa, Sorghum bicolor
  misc_feature: Ceres ANNOT ID no. 6115995
  misc_feature (274)..(438): Pfam Id: Glycos_transf_1 Pfam Desc: Glycosyl transferases group 1
  misc_feature (77)..(485): NCBI GI: 76800638 NCBI Desc: sulfoquinovosyldiacylglycerol synthase type 2 [vigna unguiculata]
  misc_feature (86)..(460): NCBI GI: 119491641 NCBI Desc: glycosyl transferase, group 1 [lyngbya sp. pcc 8106]
  misc_feature (86)..(460): NCBI GI: 86605746 NCBI Desc: glycosyl transferase, group 1 [cyanobacteria bacterium yellowstone a-prime]
  misc_feature (86)..(460): NCBI GI: 86609837 NCBI Desc: glycosyl transferase, group 1 [cyanobacteria bacterium yellowstone b-prime]
  misc_feature (86)..(453): NCBI GI: 6492405 NCBI Desc: sqdx [synechococcus sp. pcc 7942]
  misc_feature: Useful for making plants with altered carbohydrate content
  misc_feature: Functional homolog of the protein sequence given in SEQ ID NO 13732
MAAAILAPKPPPSLPTSAFPSSFPSPSRLCLSPRHPLTRLLLRPIPCASSPSSSVLMPDPDPDLEPEPAHDRDRAQDEAPESRPRRIALFVEPSPFAYVSGYKNRFQNFIKYLREMGDEVIVVTTHEGVPQEFHGAKLIGSWSFPCPWYQKVPLSLALSPRIIGEVARFKPDIIHASSPGIMVFGALIIAKLLCVPLVMSYHTHVPIYIPRYTFSWLVKPMWLIIKFLHRAADLTLVPSVAIGRDLQAAHVTAANKIRLWNKGVDSESFHPRFRDMEMRSRNGKPEKPLIFYVGRLGVEKSLDFLKRVMDRLPGARIAFIGDGPFRAELEQMFSGMPAVFTGTLQGEELSQAYASGDVFVMPSESETLGFVVLEAMSSGIPVVGARAGGIPDIIPEDQEGKTSFLYTPGDVDDCVGKIGQLLSSEELREAMGRAARKEMEKFDWRAATRKIRNEQYSAAIWFWRKKRAQLLRPLQWALRLLRPTTSGAAIADAMAKQS

SEQ ID NO: 12807 - DNA, 1500 bp, Sorghum bicolor
  misc_feature: Ceres ANNOT ID no. 6116088
  misc_feature: Encodes the peptide sequence at SEQ ID NO 12808
atgagctcccaactccgcagcactttgctcctgctcccgctcttcgccgccgctgcttggggccgcggcgccgcctcgactgcgccgtcgctggagttccaccaccggttctccgcaccgctgcggcggtgggcggaggcccgagggcgcgcgctccccggcgggtggccggcccccggcagcgccgcgtacgtcgccgcccttgccgggcacgatcgccaccgcgcggtgtcggctgcaggagggggtggaagcggcacacctccactcactttcgccgagggaaatgccaccctcaaggtcagcaacctcggatttttgcactatgctcttgtgaccgttggcacaccgggccagacgttcatggtggcgctggacacaggcagcgacctcttctggctgccttgccagtgtgacggctgcacgccgccagctactgcagcttctggatcagctacattttacatccctggtatgtcatcaactagcaaagcagttccgtgcaatagcaacttttgtgatcttcaaaaagaatgctccacagcattgcaatgtccatacaagatggtgtatgtctctgcgggcacatcatcttctggatttttagttgaggatgtgctttatctctcaacagagaatgcccatcctcaaattctcaaggcacaaataatgcttggttgtggacagactcaaactgggtcatttctggatgctgctgctcctaatggtctttttggacttggaatagatgaggtttccgttcccagcattttagcacagaaaggtctgacatctaattccttctcgatgtgctttggtcgtgatggtattgggagaatcagctttggagaccaaggcagctcagaccaagaagagacacctcttaacatcaaccaacaacatcccacatatgccatcactataagtgggattactattggaaataaaccaacagatttggacttcattactattttcgacactggtacctccttcacatacttggcagacccagcgtatacttatattacccagagttttcatgcacaagttcaggcaaatcgccatgctgctgactccaggattccgttcgaatattgctacgatttgagctctagtgaagcaaggtttccaattcctgatataatcctaagaacagtttctggaagtctgtttcctgttattgatccagggcaagtaatctccattcaggagcatgagtatgtttattgcctggcaattgtcaagagcaggaagctcaacattattggacaaaatttcatgactggtcttcgtgtggtgttcgatcgagaaaggaaaattcttggatggaagaaatttaattgtttctcatcttcaacaactgagaactactctcctcaggaaacaaggaaccctggtgtttcccagttgaggcccctgaacaattcatcaccagcagcattatatgatagcttgctcatgatgcttattttggtccacttggccattacgttctga

SEQ ID NO: 12808 - protein, 499 aa, Sorghum bicolor
  misc_feature: Ceres ANNOT ID no. 6116088
  misc_feature (109)..(447): Pfam Id: Asp Pfam Desc: Eukaryotic aspartyl protease
  misc_feature (5)..(479): NCBI GI: 38346027 NCBI Desc: osjnbb0071d01.4 [oryza sativa (japonica cultivar-group)]
  misc_feature (5)..(475): NCBI GI: 116308959 NCBI Desc: h0209a05.1 [oryza sativa (indica cultivar-group)]
  misc_feature (5)..(481): NCBI GI: 32526671 NCBI Desc: chloroplast nucleoid dna-binding protein -like protein [oryza sativa (japonica cultivar-group)]
  misc_feature (6)..(455): NCBI GI: 42567433 NCBI Desc: aspartyl protease family protein [arabidopsis thaliana]
  misc_feature (34)..(460): NCBI GI: 140047292 NCBI Desc: peptidase aspartic, active site [medicago truncatula]
MSSQLRSTLLLLPLFAAAAWGRGAASTAPSLEFHHRFSAPLRRWAEARGRALPGGWPAPGSAAYVAALAGHDRHRAVSAAGGGGSGTPPLTFAEGNATLKVSNLGFLHYALVTVGTPGQTFMVALDTGSDLFWLPCQCDGCTPPATAASGSATFYIPGMSSTSKAVPCNSNFCDLQKECSTALQCPYKMVYVSAGTSSSGFLVEDVLYLSTENAHPQILKAQIMLGCGQTQTGSFLDAAAPNGLFGLGIDEVSVPSILAQKGLTSNSFSMCFGRDGIGRISFGDQGSSDQEETPLNINQQHPTYAITISGITIGNKPTDLDFITIFDTGTSFTYLADPAYTYITQSFHAQVQANRHAADSRIPFEYCYDLSSSEARFPIPDIILRTVSGSLFPVIDPGQVISIQEHEYVYCLAIVKSRKLNIIGQNFMTGLRVVFDRERKILGWKKFNCFSSSTTENYSPQETRNPGVSQLRPLNNSSPAALYDSLLMMLILVHLAITF

SEQ ID NO: 12809 - DNA, 1482 bp, Sorghum bicolor
  misc_feature: Ceres ANNOT ID no. 6117322
  misc_feature: Encodes the peptide sequence at SEQ ID NO 12810
atgatcgcacaaggcctccgcagatccagtgccgcctcctcccaggttagcaggctggtgaaatacattgctagtgctggaagttctgaaccttcacttcaggcgacagaagaaaatgggtttaaggggcatagcatgctggctccattcacagcaggatggcagagcactgatttacatccattggttatagagagatcagagggttcttacgtttatgacatcaatgggaagaagtatatagatgctcttgcaggactgtggtgtacagctttaggtggtaatgagcctcgactagtcaaagcagcaactgagcaattacacaaattaccgttctaccattccttttggaaccgtacaaccaaaccctcattggaccttgcaaatgaaattctcagcatgttcactgcaagggaaatgggaaaggtgttcttcacaaatagtggttcagaagcaaatgactcccaggttaaactagtgtggtattataacaatgcactgggaaggccagacaagaagaaatttattgctcgctcaaaatcgtatcatgggtcaaccttgattgcagctagtttatcaggtctgccagcgcttcatcagaagttcgatctaccagcaccttttgtcctgcacacagactgccctcactactggcgattctgtcttcctgatgagacagaagaagagttttcaactagacttgccaacaatttggagaatcttatcctcaaagaaggacctgaaacaattgctgctttcattgctgaacctgtgatgggtgctggtggtgttatcctccctccaaagacctattttgagaagattcaagcagttctgaagaagtatgacatcttgttaattgcggatgaggtcattactgcatttggaagactagggacaatgtttggttgcgatatgtataacattaaaccagatcttgtctccatagctaaggctctttcttctgcatatatgccaattggagcaattcttgtaagcccagaagtaacagatgtaatctattcgcagagcaataaacttggttcttttgctcatggctttacatactcgggccatccagtttcttgtgctgttgctgtggaaaccttgaagatatataaggaaaggaatattatagaacatgttaacaaaattgctccaaggttccaagagggaatcaaggccttctcaggaagcccaattgttggggagatacgtggtgtgggactgatacttggaactgagtttgttgacaacaaatctccaaatgatccattcccagctgaatggggtgttggttcgatctttggtgctgagtgtgagaagcgtgggatgctcatcagggtggctggggacagcatcatgctgtcacccccactgatcatgactcccaatgaagttgaagaaatcataagcaaattcggtgatgccctgaaggccacagaggaaaggattggagaactgaaatccaggaagaattag

SEQ ID NO: 12810 - protein, 493 aa, Sorghum bicolor
  misc_feature: Ceres ANNOT ID no. 6117322
  misc_feature (63)..(418): Pfam Id: Aminotran_3 Pfam Desc: Aminotransferase class-III
  misc_feature (28)..(493): NCBI GI: 38344251 NCBI Desc: osjnba0008m17.4 [oryza sativa (japonica cultivar-group)]
  misc_feature (28)..(493): NCBI GI: 116309877 NCBI Desc: osigba0126b18.7 [oryza sativa (indica cultivar-group)]
  misc_feature (3)..(492): NCBI GI: 29837286 NCBI Desc: gamma-aminobutyrate transaminase subunit precursor isozyme 3 [lycopersicon esculentum]
  misc_feature (25)..(492): NCBI GI: 38344250 NCBI Desc: osjnba0008m17.3 [oryza sativa (japonica cultivar-group)]
  misc_feature (25)..(492): NCBI GI: 116309876 NCBI Desc: osigba0126b18.6 [oryza sativa (indica cultivar-group)]
MIAQGLRRSSAASSQVSRLVKYIASAGSSEPSLQATEENGFKGHSMLAPFTAGWQSTDLHPLVIERSEGSYVYDINGKKYIDALAGLWCTALGGNEPRLVKAATEQLHKLPFYHSFWNRTTKPSLDLANEILSMFTAREMGKVFFTNSGSEANDSQVKLVWYYNNALGRPDKKKFIARSKSYHGSTLIAASLSGLPALHQKFDLPAPFVLHTDCPHYWRFCLPDETEEEFSTRLANNLENLILKEGPETIAAFIAEPVMGAGGVILPPKTYFEKIQAVLKKYDILLIADEVITAFGRLGTMFGCDMYNIKPDLVSIAKALSSAYMPIGAILVSPEVTDVIYSQSNKLGSFAHGFTYSGHPVSCAVAVETLKIYKERNIIEHVNKIAPRFQEGIKAFSGSPIVGEIRGVGLILGTEFVDNKSPNDPFPAEWGVGSIFGAECEKRGMLIRVAGDSIMLSPPLIMTPNEVEEIISKFGDALKATEERIGELKSRKN

SEQ ID NO: 12811 - DNA, 1917 bp, Sorghum bicolor
  misc_feature: Ceres ANNOT ID no. 6117410
  misc_feature: Encodes the peptide sequence at SEQ ID NO 12812
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
atgaggcagcacactggtaaacgtccccgccaacacagggaatatgaaagagaagaaaggaaggaccaacacaagaggccatttccccatgctcaggaaagctctaataatgatggattggttctttaccgtatactctgtccagacagtttgattggtagtgtcataggaaagaatggcaatgtgataaatgctatccggcaacagacaagtgccaaagtcaaggttgttgacccgtaccctggtgcagacaaaagggttatcttggtatattgctacgtcaagcatagagaccttgatgctgaggttgatgacaatgagcctgtttgtgcagctcaagatgcattacttagggtgcacaatgcaattgttgatacattacataggaatcgtagagactctgataagaagaatacagaggaagctaacattcttgtgccagctagtcaggcgtcaaatgttataggaaaatctggtgctgtcatcaaacatcttcggtcaacatcaagagcattcattaaagtgagcccaaaagatccaagtgacgctacacattcatgtgctatgagttttgataattttgttcaggtaaattctctagcatctcattatttgataactggtggtgctgaagctgttaaaaaagcactatttggagtatcaaccatcatctacaagcacccatcaaaagagaacattcctcttgaaacttccattcctgagcctactccaagcattataatcccttctgaacttcctgtctatccagctagtaacttttactcggccccagatgctgctataccttctgtacatccaagcctgtctatcttagggtcaacacatcatgttcctgaacttgctctacctgccgatgatcatggtcgactgcctatttatccatctattcttccagttattcctacttatagtgccccaaaatgttcaggagaacttgaatttcgtgttttatgccctagtggcaaaattggcttggttattggtagaggtggggctaccataaagaatataaggcaagaaagtggtgcaaggatagatgttgatgatgcaaagaatgacagggaggaaagtatcattaccattacatccactgaggccatcgatgatgttaaatctgccgctgtggaagctgttttgctgcttcaagccaagatcaatgattatgaggatgatagaatgaatcttcgccttcttgtcccaaataaggttataggctgtcttattggcaggggtggttcaatagtcaatgacatgaggaagaagactaaggcaaacatcctcatttcgaagggcgataagccccggagagcatcttccagtgacgaacttgttgaggtatctggagaagcagacaagctgcgtgatgctcttgttcagataattttgagacttagggaagatgttctgaaagagagtgttgaaagccaaaattctgacagggatggcaagctaactgttgccacctctgattccttatatggaagcagtctttctttgcctgcattattacctcacaacccacaaattgcccccttgagctatgatagaagaggtgaatctgagagagctctggaagtattccctcgtaccagttcatatgggtatagctccatgcaggtcactgatgatggctacggtggacttccatcatatacatcaaaggcatatgaagaacatctaccacgtgacgaaatgactatccctgctagtggtctgtcaaaagtaatgggaaaacgtggcacaaatttggacaacattagaaagatttctggagctcacattgaaattattgaatcaaaatcctctcgtcatgaccatattgcttacatatctggaacctctgaacagaggcagtcagctgagaatttgatcaaagctttcataatgtctacctag

SEQ ID NO: 12812 - protein, 638 aa, Sorghum bicolor
  misc_feature: Ceres ANNOT ID no. 6117410
  misc_feature (42)..(94): Pfam Id: KH_1 Pfam Desc: KH domain
  misc_feature (141)..(220): Pfam Id: KH_1 Pfam Desc: KH domain
  misc_feature (320)..(381): Pfam Id: KH_1 Pfam Desc: KH domain
  misc_feature (401)..(467): Pfam Id: KH_1 Pfam Desc: KH domain
  misc_feature (569)..(631): Pfam Id: KH_1 Pfam Desc: KH domain
  misc_feature (6)..(614): NCBI GI: 13605589 NCBI Desc: at5g46190/mcl19_25 [arabidopsis thaliana]
  misc_feature (266)..(475): NCBI GI: 140064615 NCBI Desc: kh, type 1 [medicago truncatula]
  misc_feature (266)..(557): NCBI GI: 92871531 NCBI Desc: kh, type 1 [medicago truncatula]
  misc_feature (297)..(484): NCBI GI: 92896300 NCBI Desc: kh, type 1 [medicago truncatula]
  misc_feature (320)..(472): NCBI GI: 79317957 NCBI Desc: nucleic acid binding [arabidopsis thaliana]
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
MRQHTGKRPRQHREYEREERKDQHKRPFPHAQESSNNDGLVLYRILCPDSLIGSVIGKNGNVINAIRQQTSAKVKVVDPYPGADKRVILVYCYVKHRDLDAEVDDNEPVCAAQDALLRVHNAIVDTLHRNRRDSDKKNTEEANILVPASQASNVIGKSGAVIKHLRSTSRAFIKVSPKDPSDATHSCAMSFDNFVQVNSLASHYLITGGAEAVKKALFGVSTIIYKHPSKENIPLETSIPEPTPSIIIPSELPVYPASNFYSAPDAAIPSVHPSLSILGSTHHVPELALPADDHGRLPIYPSILPVIPTYSAPKCSGELEFRVLCPSGKIGLVIGRGGATIKNIRQESGARIDVDDAKNDREESIITITSTEAIDDVKSAAVEAVLLLQAKINDYEDDRMNLRLLVPNKVIGCLIGRGGSIVNDMRKKTKANILISKGDKPRRASSSDELVEVSGEADKLRDALVQIILRLREDVLKESVESQNSDRDGKLTVATSDSLYGSSLSLPALLPHNPQIAPLSYDRRGESERALEVFPRTSSYGYSSMQVTDDGYGGLPSYTSKAYEEHLPRDEMTIPASGLSKVMGKRGTNLDNIRKISGAHIEIIESKSSRHDHIAYISGTSEQRQSAENLIKAFIMST

SEQ ID NO: 12813 - DNA, 1035 bp, Sorghum bicolor
  misc_feature: Ceres ANNOT ID no. 6117426
  misc_feature: Encodes the peptide sequence at SEQ ID NO 12814
atgccctcgtcctctcgccgccgtcacgggcgcgggcgcggccggggccgtaggagcggcagcaagaagaggaactgggctgacctgccgctggacgcgatctcggccgtgctccgcaagctcgaccacgtcgagatcctgatgggcgccggccaggcgtgccgctcctggcgccgcgccgcgcgggacgacccctcgctgtggcgccgcatcgacatgtgcggccacgccgacctcttcaaccaggtcgatctccatgggatggcgcaggccgccgtgcgccgcgccaagggccagtgcgaggccttttggggcgagtacgccggagacgacgccttcctcctcttccttggggagcaggcaccatcactgaagagtcttcgcctgatctcttgctatgatgtctcgaatgaagggtttgcagaggcaataaagaagctccctttgcttgaagagcttgagctttcactttcaaaaaatgtatttgggcaggaagtgttcgagactgttggcaagtcttgtccacacctcaaacgcttcaggctcagcgaacacaggttctacagttttgaagatgttgactacaacaagaatggcgaagccctgggcatagcaacaatgactgagctacgttccctgcagatctttggcaataacctcaccaatgaagggcttacagccatcctggacaactgctgtcatctggagtccctggacattcgccattgcttcaacgtcgaaatggacaacactctccgagcaaagtgtgctggtatcaagacactaaggcttcccaatgactcaactgatgactatgaattcatagtttcgaatcctgcttgggccaatgactcccagacccagagtgaggatgacttcgatggtgacatggggtatgatgattactacgacctggacactgagctcggttctgatgatgatatctatgatccttccaactacattgatggtatagatgaagatgatgaagaagctaggatgatcctcaagggtttgtgggcgctgatgaaatga

SEQ ID NO: 12814 - protein, 344 aa, Sorghum bicolor
  misc_feature: Ceres ANNOT ID no. 6117426
  misc_feature (24)..(72): Pfam Id: F-box Pfam Desc: F-box domain
  misc_feature (99)..(344): NCBI GI: 40253669 NCBI Desc: f-box protein-like [oryza sativa (japonica cultivar-group)]
  misc_feature (1)..(329): NCBI GI: 38637427 NCBI Desc: f-box protein family-like [oryza sativa (japonica cultivar-group)]
  misc_feature (24)..(192): NCBI GI: 40253668 NCBI Desc: glutamic acid-rich protein precursor-like protein [oryza sativa (japonica cultivar-group)]
  misc_feature (25)..(321): NCBI GI: 27765050 NCBI Desc: at4g05460 [arabidopsis thaliana]
  misc_feature (25)..(321): NCBI GI: 21593361 NCBI Desc: f-box protein family, atfbl20 [arabidopsis thaliana]
MPSSSRRRHGRGRGRGRRSGSKKRNWADLPLDAISAVLRKLDHVEILMGAGQACRSWRRAARDDPSLWRRIDMCGHADLFNQVDLHGMAQAAVRRAKGQCEAFWGEYAGDDAFLLFLGEQAPSLKSLRLISCYDVSNEGFAEAIKKLPLLEELELSLSKNVFGQEVFETVGKSCPHLKRFRLSEHRFYSFEDVDYNKNGEALGIATMTELRSLQIFGNNLTNEGLTAILDNCCHLESLDIRHCFNVEMDNTLRAKCAGIKTLRLPNDSTDDYEFIVSNPAWANDSQTQSEDDFDGDMGYDDYYDLDTELGSDDDIYDPSNYIDGIDEDDEEARMILKGLWALMK

SEQ ID NO: 12815 - DNA, 1980 bp, Sorghum bicolor
  misc_feature: Ceres ANNOT ID no. 6117467
  misc_feature: Encodes the peptide sequence at SEQ ID NO 12816
atggcgacgcccagcgccgccgcctccagcagcttcctcgtcccggcgaccaccgctgtcgcctcgacaccctctgcatgcccatccacgctccccaagaagaatgccgctggcgctgggcgccggcggcaccgcacaatgcagtgcagggccagcagcggcggaggccgccgtggcgacggcgacgacgtcgacagccgcctcctttggctgccccgtcgtcaagtgctcaccggcctgagcggcgtcgccgccggcttcgtcgggtaccctgacgaccttgcgtccatcgccctcgccctggaggcgaaccccgtggagagctgccgccgcggggagaaggtgacggacaagatcgtggagtgctcggacccgaaccgcggcttcccgtgcccgccggcgacgcggatccccgtcgtcgacttcacgccggagcccaaggtgacgcgcatccggcagccggcgcacctcctggacgccgagtaccaggccaagtacaaggaggccgtccggaagatgcgggcgctggacaagtccaacccgctgagcttcgcggcgcaggcggccgtccacgagtcctactgcgacggccactaccggctggacccgtcggagaagaaccgccccttcgacgtccacttctcctggatcttcgcgccgtggcaccgcatgtacatctacttctacgagcgcgccctcggcgacctcatcggcgacgacaccttcgcgctgccgtactggggctgggacacccccgccggcatggggatccccgccgtcttcaagggggacgacgacaacccgctgttcgacccctaccggaacatggacaacaacgacgccctcatcgacctcgactacctgaaaactccccgacggccgaccgtcccgttcacgccgccgccggtgtccgacgccgccgcgcgccaggcctacgacgacgccgttcggaccaaccttgccaccgtatacattcagcaaatccgtgacggcaaggggcctcgtgcgttcctcggcgagaagctctgcagcgaggcgagctcccgggtgaaggaggtgaacgagcgttccaagaggcggcagggcgccggcgcgccgaaggtgaaggcgagcaacgcgcagggcacgctggaacggatggcgcacacgacggtgcacgtgtgggccggcaggtcgagccccaaggctccggcgacctgcacggtggacggcggcggggtggtggcgcacgacggcaagccgcactgcaacaacgacatggggttcctgggcacggcggggagggacccgctcttctactcgcaccacgccaatgtcgaccggatgtggcacctctggtccaccaagctcggcggcaagggcttcgacgacgcggagtggctcgacaccagcttcgtcttctacgacgacgtcaagagcccgcggctggtgcggatgaagttccgcgacgtgctcgacgtcaccaacctcggctacacctacgacaaggagtcggaggcggcgctgccgtggctcaagagcaagcccacccggttctcgtccggcaagacgccgtcgtcgtcggtgccggcggcggagcccaaggtggcgtcggagttcccgctgacgctgacgaaggaggcggtggacgtgccgtcggtggcgatcccggcgaagcagccagggaaggacctggtgctgctcatcgagggcatcgagtacgacccgcagatcaacaacaagttcgacgtgatcatcaacgtgcccaaggaggacgccggcaaggtggggcccaaggactgcgagtacgccggcagcttcaccgccgtgccgagctccaacgccgccggcgggacgctcgtggggaaggtcacgctcttcatcgacggggtgctggccgacctcgggctcaccaacgagagcgccgtcgacatcgtgctggttcctcacaccgacgaggagatcaagatctacctgccgccgaccatcgagaacgcatga

SEQ ID NO: 12816 - protein, 659 aa, Sorghum bicolor
  misc_feature: Ceres ANNOT ID no. 6117467
  misc_feature (122)..(499): Pfam Id: Tyrosinase Pfam Desc: Common central domain of tyrosinase
  misc_feature (5)..(344): NCBI GI: 2737882 NCBI Desc: polyphenol oxidase
  misc_feature (25)..(344): NCBI GI: 46946546 NCBI Desc: polyphenol oxidase [triticum aestivum]
  misc_feature (71)..(339): NCBI GI: 37359228 NCBI Desc: polyphenol oxidase [ananas comosus]
  misc_feature (15)..(339): NCBI GI: 51872305 NCBI Desc: polyphenol oxidase [populus balsamifera subsp. trichocarpa x populus deltoides]
  misc_feature (73)..(340): NCBI GI: 51872303 NCBI Desc: polyphenol oxidase [populus balsamifera subsp. trichocarpa x populus deltoides]
MATPSAAASSSFLVPATTAVASTPSACPSTLPKKNAAGAGRRRHRTMQCRASSGGGRRGDGDDVDSRLLWLPRRQVLTGLSGVAAGFVGYPDDLASIALALEANPVESCRRGEKVTDKIVECSDPNRGFPCPPATRIPVVDFTPEPKVTRIRQPAHLLDAEYQAKYKEAVRKMRALDKSNPLSFAAQAAVHESYCDGHYRLDPSEKNRPFDVHFSWIFAPWHRMYIYFYERALGDLIGDDTFALPYWGWDTPAGMGIPAVFKGDDDNPLFDPYRNMDNNDALIDLDYLKTPRRPTVPFTPPPVSDAAARQAYDDAVRTNLATVYIQQIRDGKGPRAFLGEKLCSEASSRVKEVNERSKRRQGAGAPKVKASNAQGTLERMAHTTVHVWAGRSSPKAPATCTVDGGGVVAHDGKPHCNNDMGFLGTAGRDPLFYSHHANVDRMWHLWSTKLGGKGFDDAEWLDTSFVFYDDVKSPRLVRMKFRDVLDVTNLGYTYDKESEAALPWLKSKPTRFSSGKTPSSSVPAAEPKVASEFPLTLTKEAVDVPSVAIPAKQPGKDLVLLIEGIEYDPQINNKFDVIINVPKEDAGKVGPKDCEYAGSFTAVPSSNAAGGTLVGKVTLFIDGVLADLGLTNESAVDIVLVPHTDEEIKIYLPPTIENA

SEQ ID NO: 12817 - DNA, 342 bp, Sorghum bicolor
  misc_feature: Ceres ANNOT ID no. 6117626
  misc_feature: Encodes the peptide sequence at SEQ ID NO 12818
atggaacggaaaggactcgcgcaacaggatgtggtttttgcttcacttaagaaccgagagagtgcgggtccttttataggcaagcggaaggaggaaggccaggcgcggaacagaaagatcgcgactctttgcggtggaggagacagaaacagacagcggccctctgtttacgttgatggcttcagggaaactgccaatgcagagaaggtcaaagaagcacacaagagggtgatggtggccaatcatccagatgcgggtggaagtcattaccttgcttcaaagattaacgaggcgaaggatatattgacagggaaaacaaaaggaggtggatcggccttttga

SEQ ID NO: 12818 - protein, 113 aa, Sorghum bicolor
  misc_feature: Ceres ANNOT ID no. 6117626
  misc_feature (52)..(113): NCBI GI: 115471001 NCBI Desc: os07g0192300 [oryza sativa (japonica cultivar-group)]
  misc_feature (52)..(113): NCBI GI: 21554024 NCBI Desc: dnaj protein-like [arabidopsis thaliana]
  misc_feature (45)..(107): NCBI GI: 62858503 NCBI Desc: loc549696 [xenopus tropicalis]
  misc_feature (45)..(107): NCBI GI: 21687102 NCBI Desc: homolog of yeast tim14 isoform a [homo sapiens]
  misc_feature (45)..(107): NCBI GI: 119598764 NCBI Desc: dnaj (hsp40) homolog, subfamily c, member 19, isoform cra_a [homo sapiens]
MERKGLAQQDVVFASLKNRESAGPFIGKRKEEGQARNRKIATLCGGGDRNRQRPSVYVDGFRETANAEKVKEAHKRVMVANHPDAGGSHYLASKINEAKDILTGKTKGGGSAF

SEQ ID NO: 12819 - DNA, 816 bp, Sorghum bicolor
  misc_feature: Ceres ANNOT ID no. 6117637
  misc_feature: Encodes the peptide sequence at SEQ ID NO 12820
atggaggctgctctagttagtgtctccacaggggtgatgaagcccctcctgtccaagctcaccaagctgctggaagaagagtgcttcaagctcaaaggtgtgcgcaagcagatcaagtttttgagagacgagctgagcgccatgagtcccgcgcttgagatgctcgcggatgcagaggagctcgaccctcaaatggcggcgtggagggacaagctaagggagctggcctatgacttggaagactgcgttgatgccttcatggctcgtgttgaccacgagcctgatggacattcaggcttcatcaagagcttcttccgcaagctgaagaaactgaaaccacgccatgagatcgccaatcagatcgaagaactcaaggcatctgttatagaggcaagcgagaggcacaagaggtatgatttggcccaactgaaaaacaaatctagcagttcttctgttgatcccaggctgcaggcgctctatgaggatattgataatcttgtgggcatcgatgcccccaagaagcatatcattgagttgttaaacatggagatgaatgggtcatccactaaacttaaagtggtctcaatttctggttgtggaggtcttggtaagactactcttgcaaagcaagtctatgaaggcattaaaaaccagttcgaatgtgcagcatttgtgtcggtttctcgaactccggatgtcaggaagattctaatacacattgctaatggagtcaagtgcactggtattaaaacacaagatgatgatttgcagcagctcattgataaactcagggaacaccttcacgataaaaggtaa

SEQ ID NO: 12820 - protein, 271 aa, Sorghum bicolor
  misc_feature: Ceres ANNOT ID no. 6117637
  misc_feature (4)..(271): NCBI GI: 115488596 NCBI Desc: os12g0485900 [oryza sativa (japonica cultivar-group)]
  misc_feature (1)..(270): NCBI GI: 115475043 NCBI Desc: os08g0176500 [oryza sativa (japonica cultivar-group)]
  misc_feature (1)..(271): NCBI GI: 115445499 NCBI Desc: os02g0272900 [oryza sativa (japonica cultivar-group)]
  misc_feature (1)..(270): NCBI GI: 4680207 NCBI Desc: disease resistance protein rpm1 homolog [sorghum bicolor]
  misc_feature (4)..(271): NCBI GI: 28555901 NCBI Desc: nbs-lrr disease resistance protein homologue [hordeum vulgare]
MEAALVSVSTGVMKPLLSKLTKLLEEECFKLKGVRKQIKFLRDELSAMSPALEMLADAEELDPQMAAWRDKLRELAYDLEDCVDAFMARVDHEPDGHSGFIKSFFRKLKKLKPRHEIANQIEELKASVIEASERHKRYDLAQLKNKSSSSSVDPRLQALYEDIDNLVGIDAPKKHIIELLNMEMNGSSTKLKVVSISGCGGLGKTTLAKQVYEGIKNQFECAAFVSVSRTPDVRKILIHIANGVKCTGIKTQDDDLQQLIDKLREHLHDKR

SEQ ID NO: 12821 - DNA, 1074 bp, Sorghum bicolor
  misc_feature: Ceres ANNOT ID no. 6117643
  misc_feature: Encodes the peptide sequence at SEQ ID NO 12822
atggcggtggatccaagcgccgccgcgcaggcggaggccgcggcgcgccggatcgaggaggcggaggccttcttccgcgccgcgccgccgctccgcgaccgcgaccgcctcgccgccagcctcgccgacttcgtcgcccgccacgccgccgggagcggcggagtggtgtgcatcacctccggcggcactacggtgcccctggagcagcgttgcgtgcgcttcatcgacaattttagctccggccagcgcggtgccgcatccaccgagtacgcagacaaatcgcacactcttctgcttttttactgctctgcttgctcatgctgttatggttggtccgttcaatttttggttaaatggggatcggttcaatgcaggtattttctcaaggccggctaccctgtcatcttcatccatcgccgtgggagcaagcaaccttactgtaggtttcttccagaggattcctttctcgatctttttgagctcggtgaagactcggagatccaagttccacagtcgcattcctcggtggtaaaggcagcaattagcaattaccggaaggcaattgatgaaggccttcttctcaaactccctttcacaacaatttttgagtaccttcagttactacaaatggtagctatttctatgaattgcttggggcaccgtggaatgttttatcttgctgctgcagtttccgacttctatgttccatgggaaactatggctaaacataaaattcagtcagcaagtggccctttgaacatgcaactcaaccaagcccctaagatgcttttcatcctccggaaaaaatgggctcctgctgcattttgtgtatccttcaagctcgaaacagatcctaatattctcctacagaaggcagaaatggctttggaaaagtatggtatgaacgttgtggtggcaaatgaacttgcaaactacaaagatgtagtagtgatggtcacaagcagcaggaggacgaccgtgagcaggagcagcaaggaggaagacctggaactgcagctaactgatctcctggtgaagatgcactccgagcacattgcacagcccaatttgtag

SEQ ID NO: 12822 - protein, 357 aa, Sorghum bicolor
  misc_feature: Ceres ANNOT ID no. 6117643
  misc_feature (52)..(332): Pfam Id: DFP Pfam Desc: DNA / pantothenate metabolism flavoprotein
  misc_feature (120)..(356): NCBI GI: 115475039 NCBI Desc: os08g0176100 [oryza sativa (japonica cultivar-group)]
  misc_feature (172)..(354): NCBI GI: 8778623 NCBI Desc: f5o11.7 [arabidopsis thaliana]
  misc_feature (120)..(346): NCBI GI: 49119251 NCBI Desc: mgc80633 protein [xenopus laevis]
  misc_feature (120)..(348): NCBI GI: 48101027 NCBI Desc: similar to ensangp00000013327 [apis mellifera]
  misc_feature (120)..(353): NCBI GI: 34810082 NCBI Desc: chain b, crystal structure of phosphopantothenoylcysteine synthetase
MAVDPSAAAQAEAAARRIEEAEAFFRAAPPLRDRDRLAASLADFVARHAAGSGGVVCITSGGTTVPLEQRCVRFIDNFSSGQRGAASTEYADKSHTLLLFYCSACSCCYGWSVQFLVKWGSVQCRYFLKAGYPVIFIHRRGSKQPYCRFLPEDSFLDLFELGEDSEIQVPQSHSSVVKAAISNYRKAIDEGLLLKLPFTTIFEYLQLLQMVAISMNCLGHRGMFYLAAAVSDFYVPWETMAKHKIQSASGPLNMQLNQAPKMLFILRKKWAPAAFCVSFKLETDPNILLQKAEMALEKYGMNVVVANELANYKDVVVMVTSSRRTTVSRSSKEEDLELQLTDLLVKMHSEHIAQPNL

SEQ ID NO: 12823 - DNA, 660 bp, Sorghum bicolor
  misc_feature: Ceres ANNOT ID no. 6117795
  misc_feature: Encodes the peptide sequence at SEQ ID NO 12824
atggcatgcatgggaggcctggtctgcattcccctgaaccagaagacattccgtcccaagaagagtgctccgtcaggcagcaagggagcgcagctccggaagcacatagatgccactctcggcagtggaaaccttagggaagctgtgaggttgccccctggagaggatatcaatgaatggcttgctgtgaatactgtggatttctttaaccaagttaatctgctgtatggcacactcacagaattctgcacacctgagagctgcccgacaatgacagctggcccaaagtacgagtacagatgggctgatggtgtgcagataaagaaacccatagaggtatcagcaccaaaatatgtggagtatctgatggattggattgaaggccagcttgacgatgaatccatatttcctcaaaaacttggcacgccatttccacaaaacttcaaggaagtagtgaagacaatattcaagcgcttgtttcgtgtctatgcccacatctaccactctcatttccagaagattgttagccttaaagaggaggcccatctcaatacctgtttcaagcacttcattctgtttacaaatgagtttggcctgattgacaagaaggagctggctccactccaggagctcatcgaatccatcatcgttccttactga

SEQ ID NO: 12824 - protein, 219 aa, Sorghum bicolor
  misc_feature: Ceres ANNOT ID no. 6117795
  misc_feature (33)..(209): Pfam Id: Mob1_phocein Pfam Desc: Mob1/phocein family
  misc_feature (13)..(216): NCBI GI: 115481876 NCBI Desc: os10g0396300 [oryza sativa (japonica cultivar-group)]
  misc_feature (13)..(216): NCBI GI: 19309913 NCBI Desc: mob1-like protein [medicago sativa subsp. falcata]
  misc_feature (13)..(216): NCBI GI: 82734181 NCBI Desc: mob1-like protein [medicago sativa subsp. falcata]
  misc_feature (13)..(215): NCBI GI: 62147661 NCBI Desc: mob1-like protein [poa pratensis]
  misc_feature (13)..(194): NCBI GI: 115453479 NCBI Desc: os03g0409400 [oryza sativa (japonica cultivar-group)]
MACMGGLVCIPLNQKTFRPKKSAPSGSKGAQLRKHIDATLGSGNLREAVRLPPGEDINEWLAVNTVDFFNQVNLLYGTLTEFCTPESCPTMTAGPKYEYRWADGVQIKKPIEVSAPKYVEYLMDWIEGQLDDESIFPQKLGTPFPQNFKEVVKTIFKRLFRVYAHIYHSHFQKIVSLKEEAHLNTCFKHFILFTNEFGLIDKKELAPLQELIESIIVPY

SEQ ID NO: 12825 - DNA, 846 bp, Sorghum bicolor
  misc_feature: Ceres ANNOT ID no. 6117804
  misc_feature: Encodes the peptide sequence at SEQ ID NO 12826
atgcgaggatcctgccccggcggaggcgcctcggcgtccttggccccaagcttcaacggcttccgagccatgatctggccggcaacagtaaattgtacgagccggatcggcatttccttcatccaaacagccaaaacggggccgttccgcgcaggcgacagggctacgggaggaatttgctatgctagccaggcggttgaattgctgcccactttgtgccctgaaatcgtggtccgagacgcacggctcgaggactgctgggaagtggctgacactcactgcagctcgttctttcctggttacaagttcccgttggaccttgttctccggattgatcgttacattgctctcctgtctggattttcagttccgcccgggtgcatgaagacttgccttgtggccgtcaattctaattctgtaaataatagtttcaccatcgagtgtggagatgttacagatgccagctttcaagaatacagtctcagtagaggttccatagctggcattcttactcttgatacagtggcagactatcttccgagaaggggacccctgaagcagagaaggacaggtattgcatatatagcaaatgtggcagtgcgaaaggaggagcgtcggaaaggaattgctaaaatgttagtccaagaagcagaggcacgggcaaggagttggggatgccggtcaatggcattgcattgtgatgtaaacaacatagctgccctacgtctgtacaaaaatcaaggtttcaaatgcatccgtgtaccagaaggagctaaatggcctgaacccaagatagctaaaggagtgcaatacaacttcatgatgaagctagtgcccaaggcttga

SEQ ID NO: 12826 - protein, 281 aa, Sorghum bicolor
  misc_feature: Ceres ANNOT ID no. 6117804
  misc_feature (158)..(250): Pfam Id: Acetyltransf_1 Pfam Desc: Acetyltransferase (GNAT) family
  misc_feature (54)..(280): NCBI GI: 47497393 NCBI Desc: gcn5-related n-acetyltransferase (gnat) family protein-like [oryza sativa (japonica cultivar-group)]
  misc_feature (58)..(278): NCBI GI: 42571129 NCBI Desc: gcn5-related n-acetyltransferase (gnat) family protein [arabidopsis thaliana]
  misc_feature (194)..(250): NCBI GI: 67921955 NCBI Desc: gcn5-related n-acetyltransferase [crocosphaera watsonii wh 8501]
  misc_feature (194)..(261): NCBI GI: 126657269 NCBI Desc: gcn5-related n-acetyltransferase [cyanothece sp. ccy0110]
  misc_feature (194)..(253): NCBI GI: 146304902 NCBI Desc: gcn5-related n-acetyltransferase [metallosphaera sedula dsm 5348]
MRGSCPGGGASASLAPSFNGFRAMIWPATVNCTSRIGISFIQTAKTGPFRAGDRATGGICYASQAVELLPTLCPEIVVRDARLEDCWEVADTHCSSFFPGYKFPLDLVLRIDRYIALLSGFSVPPGCMKTCLVAVNSNSVNNSFTIECGDVTDASFQEYSLSRGSIAGILTLDTVADYLPRRGPLKQRRTGIAYIANVAVRKEERRKGIAKMLVQEAEARARSWGCRSMALHCDVNNIAALRLYKNQGFKCIRVPEGAKWPEPKIAKGVQYNFMMKLVPKA

SEQ ID NO: 12827 - DNA, 1101 bp, Sorghum bicolor
  misc_feature: Ceres ANNOT ID no. 6117833
  misc_feature: Encodes the peptide sequence at SEQ ID NO 12828
atgctgtcggggtgctcggtgtccagtctcgcggcgcggttcgccttcttcccgccggagccggcgacgtacgccgtccggaaggacgaggccacgggccgcctcgtcgcctcgggggtgccgcgggacaacgccttggacgtcctgctcgtcgacaccgccagggggaacaaggtcgtcgccttctacttccggaacccctgcgcccggctcaccctgctctactcgcacggcaacgccgccgaccttggccagctgtacgacctctttgtgcagctcaaggtcaatctcaagatcaatctgatgggatacgactattctggctatggtgcatctactggcaagccaagtgaagagaatacatatgcagacattgaagcagtttaccaatgcttagaaactgagtatgggatcagccaggaagacattatcctgtatggacaatctgtgggcagtggaccaacattacatttagcctctcgtttgcctagattgcgtggggtggttctccacagcgctatactgtcaggcctccgtgttgtttgccatgtgaactttactttctgctttgacatttacaaaaatgtgaagaaaataaaaaaggtcaaatgcccagtgctcgttattcatgggacggatgatgatgttgtgaactggtcacatggaaaggagctgtggaagctagcaagggatccttacgacccactgtggatcaaagggggcggtcactgcaacctggagctgtacccggacttcatccgccacctatccaggttcatccgcgagatggagaacatcacaacgaagatccggctcaagaagatcaggccgtccctccagctgcccagaaagaaggcccaccaccgggcgaacaccgcgacgacaaccaccttcaccgctaactgctgctgccgcatccgtgtccgcaagccgacctgccccagctgcaacttcagctgcggtggctgctgtgggctgaggaactgcttcacattccgtttttccaggtgctgccgccctcctacctgcttcaccggcggtggcggctgttgctcgtgcaggagctgcttcaagtgctgctgctgtggagatgggcgttaa

SEQ ID NO: 12828 - protein, 366 aa, Sorghum bicolor
  misc_feature: Ceres ANNOT ID no. 6117833
  misc_feature (4)..(274): NCBI GI: 140067578 NCBI Desc: c2; esterase/lipase/thioesterase [medicago truncatula]
  misc_feature (4)..(284): NCBI GI: 124359459 NCBI Desc: esterase/lipase/thioesterase [medicago truncatula]
  misc_feature (27)..(275): NCBI GI: 56784467 NCBI Desc: cgi67 serine protease-like [oryza sativa (japonica cultivar-group)]
  misc_feature (27)..(275): NCBI GI: 115439289 NCBI Desc: os01g0689800 [oryza sativa (japonica cultivar-group)]
  misc_feature (4)..(266): NCBI GI: 51535771 NCBI Desc: cgi67 serine protease-like [oryza sativa (japonica cultivar-group)]
MLSGCSVSSLAARFAFFPPEPATYAVRKDEATGRLVASGVPRDNALDVLLVDTARGNKVVAFYFRNPCARLTLLYSHGNAADLGQLYDLFVQLKVNLKINLMGYDYSGYGASTGKPSEENTYADIEAVYQCLETEYGISQEDIILYGQSVGSGPTLHLASRLPRLRGVVLHSAILSGLRVVCHVNFTFCFDIYKNVKKIKKVKCPVLVIHGTDDDVVNWSHGKELWKLARDPYDPLWIKGGGHCNLELYPDFIRHLSRFIREMENITTKIRLKKIRPSLQLPRKKAHHRANTATTTTFTANCCCRIRVRKPTCPSCNFSCGGCCGLRNCFTFRFSRCCRPPTCFTGGGGCCSCRSCFKCCCCGDGR

SEQ ID NO: 12829 - DNA, 942 bp, Sorghum bicolor
  misc_feature: Ceres ANNOT ID no. 6117901
  misc_feature: Encodes the peptide sequence at SEQ ID NO 12830
atggcgaacgagcagagcgggagcctcctgcggaggtggaggccattctacggcgcgttcggcgccatcgacgacgcgatcgaggaagcaggcgggcacccgcgcgccgcgttccgggacgtgagggtccagatcctccagctgctccgcggcgccaccgacgacggcgtggccgagcagctctgcggcgcgctggacgaggccatggcggaagcgctcgagaccctgcgggtggcgcccgtcccgcaccgcgcgctggcgtccaccgacctcgcaaggaccgtcggcgccctcctcgacaagcacggctcggcccggatccgccggctcgccggcgacgtcgtgcgcgggtggaaggcggccaacgtcaccgcaactacagcagtcaaggaagagctcgacaagctctctgctgatgatcaaatcccaggacagagcatctctgcagtgatagctgatggtaatgcgcgtttccgtgggcgcaaggagaagctacagataccgccggcgaagacgatgcttcccgccggcgatgtacacaagaagaagctacagataccgccggcgaagatgcttcctatcgtccccgtcgccgaggcacacaagaagatggtgtatgttccaccagcgaagaagacgatgctgccgatcgcagctactgtctcgacaccgaacacgagcgagaccaagaaggcagccgtcgacgagagcaagaagatggaggctacgaaacgcaagctgcgtgagggttaccaagaggccgagaagatcaagcgtcaacacaccattcagaagatcgacgacaaggatgcagcaaagatgtttgagcagaagcaacggaagatgcatcccgtcgtgcgagagagaggaggccgagcatcatgtaggacatcctcaggcggcgtcaggcgttcgttgcttccctctcttcagatgatttag

SEQ ID NO: 12830 - protein, 313 aa, Sorghum bicolor
  misc_feature: Ceres ANNOT ID no. 6117901
  misc_feature (66)..(273): NCBI GI: 115484349 NCBI Desc: os11g0166800 [oryza sativa (japonica cultivar-group)]
  misc_feature (66)..(294): NCBI GI: 92873111 NCBI Desc: transcription factors tfiis, elongin a, crsp70, conserved [medicago truncatula]
  misc_feature (227)..(289): NCBI GI: 115473677 NCBI Desc: os07g0642600 [oryza sativa (japonica cultivar-group)]
  misc_feature (66)..(273): NCBI GI: 20147241 NCBI Desc: at5g09850/myh9_6 [arabidopsis thaliana]
  misc_feature (66)..(273): NCBI GI: 18416107 NCBI Desc: transcription elongation factor-related [arabidopsis thaliana]
MANEQSGSLLRRWRPFYGAFGAIDDAIEEAGGHPRAAFRDVRVQILQLLRGATDDGVAEQLCGALDEAMAEALETLRVAPVPHRALASTDLARTVGALLDKHGSARIRRLAGDVVRGWKAANVTATTAVKEELDKLSADDQIPGQSISAVIADGNARFRGRKEKLQIPPAKTMLPAGDVHKKKLQIPPAKMLPIVPVAEAHKKMVYVPPAKKTMLPIAATVSTPNTSETKKAAVDESKKMEATKRKLREGYQEAEKIKRQHTIQKIDDKDAAKMFEQKQRKMHPVVRERGGRASCRTSSGGVRRSLLPSLQMI

SEQ ID NO: 12831 - DNA, 1092 bp, Sorghum bicolor
  misc_feature: Ceres ANNOT ID no. 6118050
  misc_feature: Encodes the peptide sequence at SEQ ID NO 12832
atgggtgcgcttccgcaaccagaccccaagaacacttcgtcctgcgacgatggccaaggcccagatccctcgtgcccgcctgatgacgttccagcttcaccgctgccttaccctcttcctcctcctcctcctcctccttcccccgcctcccacggccggagcaccttcgtcaccgccctcatcatcgccgtcccggtgctcgccttcctcgcgctctgcctctccatactcatcttcgtccggcgcaggcggctgcggcgagaggcgctcctcgaagccgccgcgctggccccggcggcgcccggcaccttccccgacgacggcgacgggggagaaggagaagtcgtgcaccacgcgtggcacatccggaccgtcgggctcgacgacgcggcgatcgagtccatcgcgctcacgcggtaccgcgacggcgtgctcggcgccgccgcctccgactgcaccgtctgcctcggcgagttccaggacggcgagctcctccggctgctccccaagtgcgcccacgcgttccacgtgcagtgcatcgacacctggctccgcgcccacgtcagctgcccgctctgccgcgccgacgtgatggtggaccatgccgccgccgccgccgccgccgcgggcgccgacgccgagcatcccccggggggcgatgctgccgacgccgcctcggccgaacagtccgcgagcaatacccagaccatggaactggagcggcccggccagcaggccaacgagcagcaagagctgcgtgtccaaatcgatcagccccaccactccagctcgctgtcgctggaactggaccgacgaccacgtcggcagattccgcgccccggagcacgggcacggaactttcggcgggtggcatccatggactcgccggcgccgccgacgcctgaagacgagcaggccggtggcgagaagcagcaggggacaggcggtgctgtttgtgtttgctgcgaggtgtcaccaggacctggccgccagctgaatcgccccgccatgaagaggtcattgtccgccagcagccggtggacgctcctctcgcggcattgccgcacgcgcagctcgcttctgccgctctga

SEQ ID NO: 12832 - protein, 363 aa, Sorghum bicolor
  misc_feature: Ceres ANNOT ID no. 6118050
  misc_feature (152)..(193): Pfam Id: zf-C3HC4 Pfam Desc: Zinc finger, C3HC4 type (RING finger)
  misc_feature (64)..(363): NCBI GI: 46806010 NCBI Desc: zinc finger (c3hc4-type ring finger)-like protein [oryza sativa (japonica cultivar-group)]
  misc_feature (42)..(363): NCBI GI: 116310081 NCBI Desc: h0818e04.19 [oryza sativa (indica cultivar-group)]
  misc_feature (40)..(363): NCBI GI: 47848401 NCBI Desc: zinc finger (c3hc4-type ring finger) family protein-like [oryza sativa (japonica cultivar-group)]
  misc_feature (40)..(363): NCBI GI: 115479671 NCBI Desc: os09g0468800 [oryza sativa (japonica cultivar-group)]
  misc_feature (37)..(256): NCBI GI: 92878610 NCBI Desc: zinc finger, ring-type; ringv [medicago truncatula]
  misc_feature: The sequence is a functional homolog of SEQ ID NO 1131 in the 10/666,642US patent application
  misc_feature: The sequence is a functional homolog of SEQ ID NO 1134 in the 10/666,642US patent application
  misc_feature: The sequence is a functional homolog of SEQ ID NO 954 in the 10/412,699US patent application
  misc_feature: Useful for making plants with modulated growth and phenotype characteristics
  misc_feature: The sequence is a functional homolog of SEQ ID NO 954 in the 20040045049 US patent application
  misc_feature: The sequence is a functional homolog of SEQ ID NO 1131 in the 20070033671 US patent application
  misc_feature: The sequence is a functional homolog of SEQ ID NO 1134 in the 20070033671 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 350 in the 11/188,298 US application
MGALPQPDPKNTSSCDDGQGPDPSCPPDDVPASPLPYPLPPPPPPPSPASHGRSTFVTALIIAVPVLAFLALCLSILIFVRRRRLRREALLEAAALAPAAPGTFPDDGDGGEGEVVHHAWHIRTVGLDDAAIESIALTRYRDGVLGAAASDCTVCLGEFQDGELLRLLPKCAHAFHVQCIDTWLRAHVSCPLCRADVMVDHAAAAAAAAGADAEHPPGGDAADAASAEQSASNTQTMELERPGQQANEQQELRVQIDQPHHSSSLSLELDRRPRRQIPRPGARARNFRRVASMDSPAPPTPEDEQAGGEKQQGTGGAVCVCCEVSPGPGRQLNRPAMKRSLSASSRWTLLSRHCRTRSSLLPL

SEQ ID NO: 12833 - DNA, 957 bp, Sorghum bicolor
  misc_feature: Ceres ANNOT ID no. 6118110
  misc_feature: Encodes the peptide sequence at SEQ ID NO 12834
atgtctgcccagtgcaagctggttgcgcttggtgcactgatcttcttccttcttgtctcgtatggctcatgcactaggatcgtcaactttaatgcctcccacatcacggcggatccctactgggtggctgccagggccacttggtatggtgcgccaaccggcgctggcccctacgacaacggtggcgcttgtgggttcaagaatgtgaacctgcctcctttctcggccatgacatcgtgcggcaaccagcccctgttcaaggatggcaagggctgtggctcgtgctaccagatacgatgcgtcaaccaccccgcgtgctctggcaacccggagacggtgatgatcaccgacatgaactactacccagtcgctaagtaccactttgacctcagcggcacggcgtttggtgccatggcacagcccggccgcaacaacgagctccgccacgccggcatcatcgacatccagttcaggagggtgccctgcatctaccccgggcagacggtgaccttccacatcgagcacggctcaaaccccaactacttagcagtgcttgtcgagttcgaagacggcgatggcgatgtggtccaggtggacatcatggaggccaactccgggtggtggacgccgatgcgggagtcgtggggatccatctggaggatggactccaagcgccggctgcaggggcccttctcgctgcgcatcaccaacgagtccggcgagaggctggtggcttaccaggtcatcccggcgaactgggcgcccaacacctactaccgctccaacatccagtatgaggcttttggctctgctgctggacaggctattggctttggctctgctgttggactggtcattagctctgctgctggactgcacacggtaattaccggcatcattggcttgatctgtttggtattgtatcatttgcatgggattgaggtgcctcagttttaa

SEQ ID NO: 12834 - protein, 318 aa, Sorghum bicolor
  misc_feature: Ceres ANNOT ID no. 6118110
  misc_feature (169)..(250): Pfam Id: Pollen_allerg_1 Pfam Desc: Pollen allergen
  misc_feature (78)..(157): Pfam Id: DPBB_1 Pfam Desc: Rare lipoprotein A (RlpA)-like double-psi beta-barrel
  misc_feature (7)..(265): NCBI GI: 14193773 NCBI Desc: beta-expansin 7 [zea mays]
  misc_feature (6)..(267): NCBI GI: 8118423 NCBI Desc: beta-expansin [oryza sativa]
  misc_feature (6)..(267): NCBI GI: 115502197 NCBI Desc: expansin-b3 precursor (osexpb3) (beta-expansin-3) (osaexpb1.10)
  misc_feature (6)..(265): NCBI GI: 14330330 NCBI Desc: beta expansin b3 [schedonorus pratensis]
  misc_feature (6)..(265): NCBI GI: 44894800 NCBI Desc: expansin expb3 [triticum aestivum]
  misc_feature: Useful for making plants with altered cell wall content and/or composition
  misc_feature: Functional homolog of the protein sequence encoded by LOCUS at1g65680
  misc_feature: Useful for making plants with altered carbohydrate content
  misc_feature: Functional homolog of the protein sequence given in SEQ ID NO 13733
MSAQCKLVALGALIFFLLVSYGSCTRIVNFNASHITADPYWVAARATWYGAPTGAGPYDNGGACGFKNVNLPPFSAMTSCGNQPLFKDGKGCGSCYQIRCVNHPACSGNPETVMITDMNYYPVAKYHFDLSGTAFGAMAQPGRNNELRHAGIIDIQFRRVPCIYPGQTVTFHIEHGSNPNYLAVLVEFEDGDGDVVQVDIMEANSGWWTPMRESWGSIWRMDSKRRLQGPFSLRITNESGERLVAYQVIPANWAPNTYYRSNIQYEAFGSAAGQAIGFGSAVGLVISSAAGLHTVITGIIGLICLVLYHLHGIEVPQF

SEQ ID NO: 12835 - DNA, 1584 bp, Sorghum bicolor
  misc_feature: Ceres ANNOT ID no. 6119156
  misc_feature: Encodes the peptide sequence at SEQ ID NO 12836
atggcggatccgccgtctgtgctcacgctcctagtgaagaagggcccttgcgaagggagggccctgcagcgccgcgccggcgccgcggcgctccgtgtcggccgcgttgccaagggcaacgacctctccgtgcgcgacgcgggcgcgtcgcagaggcatctctccgtcgagttcctcccgccgcccgcggcacggtgggccgccaccgacctaggctcctccaacggcaccctcctcaacggtacgcctctcgtgcccaccgtcccggcgccgctctccgatggggacctcatcaagatcggggagagcaccgtgatcgccgtctccatatcgatcgatgcgggcccgggaccgggccccgccgccactaggcgttccgcgcgcaacgcagctgccgtggcggcggcgccggaggaggaggatcagggccccgcggtttcgcgcagggccggacggaggaaggccggtgcggcggaagcccccgaaggtgggaatgaagtggaggaagctgcactcccgactcgccgaggcgggcggaagaaggccgttgagcccgctggggtggagatgggagcggaaaaggaggaggaggaggaggcggcaataccgcgccggggcaggtcgaggaaggctgcagcgacggttgtccttccgccacagccgcaaaatacgaggtcagcgagagctactgcaaggagaggtgaggcggtggggtgccaaaacgatgagggaaaagtggtggggactggaagggggagaggacgggttacaagggcaagtgcaaggaatggcacgagtggtactcccgaggatgaggaggaagaggagggtgaagatgctgtggccagagatcggggagggacagttgttgagggcaaagaggtggtgccggcggctgggagaggacgagcaaagaggagcagaagaggaagaggccgaggaagggccacaagggcaaggaaagctgaggatgcaattgttgagaacgatgaaaatgagcaagaggaaagggatatggctcatgccagagatcgagaggggagcccattgagggttttggccgtgagtgatggttctgaacaggataaggtgacaattgaggacggcaagttggatggaacctcaaaggtatccatggaggatgagaagatggtggatgtggaggaagatgcgacattgacagagagggaaattgaggggagggacaatgctcagcatgctcctgctgacaatggtggtgtggaagaagaggaggtgaaaaatttgagcaaggaaggggaaactgaagttgaccaggaattgagagaaaaagtgtcaccagagtcaaagctggatggtgttgaagtggaagagaatgatacaagggaaactattgctgccagtggagagaaaggccatgtgggggagcacacaggaagacgccgcttggaggatatgacattgggggagtggtttgttcagatcgagaaattccttctagcaaagaatgcagaggctgctgaaaaggcgatagctgaagtgcaagagaaacatcggcggttttgtgagcatgttaaaatgctcaaaaagagttctgctccttga

SEQ ID NO: 12836 - protein, 527 aa, Sorghum bicolor
  misc_feature: Ceres ANNOT ID no. 6119156
  misc_feature (31)..(101): Pfam Id: FHA Pfam Desc: FHA domain
  misc_feature (139)..(425): NCBI GI: 28573493 NCBI Desc: cg5935-pa, isoform a [drosophila melanogaster]
  misc_feature (139)..(425): NCBI GI: 24654265 NCBI Desc: cg5935-pc, isoform c [drosophila melanogaster]
  misc_feature (139)..(425): NCBI GI: 21356855 NCBI Desc: cg5935-pb, isoform b [drosophila melanogaster]
  misc_feature (139)..(402): NCBI GI: 61678363 NCBI Desc: cg5935-pd, isoform d [drosophila melanogaster]
  misc_feature (139)..(478): NCBI GI: 61658793 NCBI Desc: rpgr [macaca mulatta]
MADPPSVLTLLVKKGPCEGRALQRRAGAAALRVGRVAKGNDLSVRDAGASQRHLSVEFLPPPAARWAATDLGSSNGTLLNGTPLVPTVPAPLSDGDLIKIGESTVIAVSISIDAGPGPGPAATRRSARNAAAVAAAPEEEDQGPAVSRRAGRRKAGAAEAPEGGNEVEEAALPTRRGGRKKAVEPAGVEMGAEKEEEEEAAIPRRGRSRKAAATVVLPPQPQNTRSARATARRGEAVGCQNDEGKVVGTGRGRGRVTRASARNGTSGTPEDEEEEEGEDAVARDRGGTVVEGKEVVPAAGRGRAKRSRRGRGRGRATRARKAEDAIVENDENEQEERDMAHARDREGSPLRVLAVSDGSEQDKVTIEDGKLDGTSKVSMEDEKMVDVEEDATLTEREIEGRDNAQHAPADNGGVEEEEVKNLSKEGETEVDQELREKVSPESKLDGVEVEENDTRETIAASGEKGHVGEHTGRRRLEDMTLGEWFVQIEKFLLAKNAEAAEKAIAEVQEKHRRFCEHVKMLKKSSAP

SEQ ID NO: 12837 - DNA, 1371 bp, Sorghum bicolor
  misc_feature: Ceres ANNOT ID no. 6119216
  misc_feature: Encodes the peptide sequence at SEQ ID NO 12838
  misc_feature: Up-regulated in root tissues in response to methyl jasmonate treatment
atggccggaagcggatcgggggcgggggcgggggcgggggcgggggcgctggccgggctcgcagcgtgcgcgacgctggcgtgcaacgtcgcctgcgtcgtgttcttcctccgcggcggccgcgtcgacgggcggcggccgcgccggtttgcggcgaggttgggcgcgggcggcgtcgcggcgcagtgggtggaggagggcgaggaggatggggaggcgctggaccgcgacgtcgcgctcgcgccggacgccgtcctcaacctcgagctcggcgatccgacgatgtacgaggcgttctggcgagaggtcggggaccgcggcgccaccgtgatccgcgggtggcaggtgatgagctacttctccgacgccgccgcgctctgctggttcctcgagccagagctggagcgcgaggtgcgacgactccaccgcgtcgtcggaaacgccgtggacgacggctaccacctcgtggtcggcaccggcgccacccagctctaccaggccgccatgtacgcgctcagctcgtcggcgcgcggggaccagcgccagcccgtccccgtcgtctcgccggcgccgtactactcctcgtatccgccccagacggacctcctgctctcggacttgtaccgctgggccggcgatgccaacaagttcaccggcgatgaatgcatcgagctggtctgctcgccgaacaaccccgacggcgccatccgcgaggccgtcgtgcgctccgccggcgccaaggcgatccatgacctggtgtactactggccgcagcacacgcccatcaccggccgcgccgcccacgacatcatgctcttcacattgtccaagatcaccggccacgccggcacgaggctcgggtgggcactggtgaaggaccgcgaagtggccaggaagatggtctacttcgtcgaccgcagcaccatcggcgtgtccaaagagtcgcagctgcgcgccaccaagatcctcggggtcgtctccgacgcctacgaggtcgtcccgccgccgccggccggcgacggcagcgccgtcgccgtgccccgcctctttgacttcgcgcggcggcgcatggaggagcgctggcgcatcctgcgcgccaccgttgcggcctccggcaccttcagcctaccggaggagacctccggctactgcaacttcgccaagcaaaacctgacagcttgtcctgcgttcgcgtggctgcgatgtgagaaggaaggcgtggaggactgcgccaagctgctcgccggccacaagatcgtggctcgcggcggggagcagttcggaggagacgcgcggtgcgtcaggatcaacatgctggacagggacaatgtgttcaacctgcttgttcagcgcctgtccgctataaactga

SEQ ID NO: 12838 - protein, 456 aa, Sorghum bicolor
  misc_feature: Ceres ANNOT ID no. 6119216
  misc_feature (86)..(456): Pfam Id: Alliinase_C Pfam Desc: Allinase
  misc_feature (3)..(456): NCBI GI: 115462323 NCBI Desc: os05g0169300 [oryza sativa (japonica cultivar-group)]
  misc_feature (76)..(455): NCBI GI: 92874174 NCBI Desc: alliinase egf-like; allinase, c-terminal [medicago truncatula]
  misc_feature (65)..(455): NCBI GI: 9295708 NCBI Desc: f26f24.17 [arabidopsis thaliana]
  misc_feature (65)..(455): NCBI GI: 15220705 NCBI Desc: alliinase family protein [arabidopsis thaliana]
  misc_feature (242)..(455): NCBI GI: 115434754 NCBI Desc: os01g0169800 [oryza sativa (japonica cultivar-group)]
  misc_feature: Up-regulated in root tissues in response to methyl jasmonate treatment
MAGSGSGAGAGAGAGALAGLAACATLACNVACVVFFLRGGRVDGRRPRRFAARLGAGGVAAQWVEEGEEDGEALDRDVALAPDAVLNLELGDPTMYEAFWREVGDRGATVIRGWQVMSYFSDAAALCWFLEPELEREVRRLHRVVGNAVDDGYHLVVGTGATQLYQAAMYALSSSARGDQRQPVPVVSPAPYYSSYPPQTDLLLSDLYRWAGDANKFTGDECIELVCSPNNPDGAIREAVVRSAGAKAIHDLVYYWPQHTPITGRAAHDIMLFTLSKITGHAGTRLGWALVKDREVARKMVYFVDRSTIGVSKESQLRATKILGVVSDAYEVVPPPPAGDGSAVAVPRLFDFARRRMEERWRILRATVAASGTFSLPEETSGYCNFAKQNLTACPAFAWLRCEKEGVEDCAKLLAGHKIVARGGEQFGGDARCVRINMLDRDNVFNLLVQRLSAIN

SEQ ID NO: 12839 - DNA, 549 bp, Sorghum bicolor
  misc_feature: Ceres ANNOT ID no. 6119458
  misc_feature: Encodes the peptide sequence at SEQ ID NO 12840
atggcgccgcccaccaacgactcggaggcgccatgcacgcagcggctgcccgcggaggacgagctgctgctgcagcagacgccggctgccagctgcggcggcgatcgggcgccggcggcagggacgtcgtggaccgagcccgaccaccaacaggccgaggcgccagcggtggttcccgccgaggcggagggcgcggagaagaagagcagcagcgcgtcggcagaagctgcagcgttggcggcgggaagcggcggcggggagccgatggcggcgcggcggacggaggagatcagcgcgcgggagcggctgaagcggcaccgcaccgaaatggcggggcgggtgcggatcccggacatgtggggccaggagcggctgctcaaggactgggtcgactgcgccgtcttcgaccgcccgctcgccgccaccacggggctgctcaacgcccgcgacgcgctcgtcgccgagtgcgccaccgcgcgccgcccgggccccgcggtctcgcacgcctccacgggccgcccgctccgggtgcacaacggctgctcctga

SEQ ID NO: 12840 - protein, 182 aa, Sorghum bicolor
  misc_feature: Ceres ANNOT ID no. 6119458
  misc_feature (1)..(182): NCBI GI: 116310146 NCBI Desc: h0717b12.8 [oryza sativa (indica cultivar-group)]
  misc_feature (1)..(162): NCBI GI: 38346335 NCBI Desc: osjnba0073l04.6 [oryza sativa (japonica cultivar-group)]
  misc_feature (33)..(113): NCBI GI: 115469048 NCBI Desc: os06g0630900 [oryza sativa (japonica cultivar-group)]
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
  misc_feature: Functional homolog of the protein sequence given in SEQ ID NO 13053
MAPPTNDSEAPCTQRLPAEDELLLQQTPAASCGGDRAPAAGTSWTEPDHQQAEAPAVVPAEAEGAEKKSSSASAEAAALAAGSGGGEPMAARRTEEISARERLKRHRTEMAGRVRIPDMWGQERLLKDWVDCAVFDRPLAATTGLLNARDALVAECATARRPGPAVSHASTGRPLRVHNGCS

SEQ ID NO: 12841 - DNA, 243 bp, Sorghum bicolor
  misc_feature: Ceres ANNOT ID no. 6119582
  misc_feature: Encodes the peptide sequence at SEQ ID NO 12842
atggaacaagtgtataatagatttggtttccattgggcggatgaggaggtaactgatccaaaggcgctcctagaggaacgctcaaaggctaagtgtgtgtcgcagtggtatgaatatcagaaatgtgttaagaggattgagaatgacgagactgggcacaagcactgtaccggccagtactttgattactggaaatgtgttgacaagaatgttgcagagaaactctttgagatgttaaaatga

SEQ ID NO: 12842 - protein, 80 aa, Sorghum bicolor
  misc_feature: Ceres ANNOT ID no. 6119582
  misc_feature (18)..(80): Pfam Id: UCR_hinge Pfam Desc: Ubiquinol-cytochrome C reductase hinge protein
  misc_feature (13)..(80): NCBI GI: 115484331 NCBI Desc: os11g0162200 [oryza sativa (japonica cultivar-group)]
  misc_feature (13)..(80): NCBI GI: 488712 NCBI Desc: ubiquinol--cytochrome c reductase [solanum tuberosum]
  misc_feature (13)..(72): NCBI GI: 5103810 NCBI Desc: similar to gbx79273 cytochrome c reductase hinge protein subunit from solanum tuberosum. ests gbt45282 and gbt21596 come from this gene. [arabidopsis thaliana]
  misc_feature (5)..(79): NCBI GI: 82794475 NCBI Desc: ubiquinol-cytochrome c reductase complex 7.8 kda protein [plasmodium yoelii yoelii str. 17xnl]
  misc_feature (5)..(79): NCBI GI: 23484814 NCBI Desc: ubiquinol-cytochrome c reductase complex 7.8 kda protein [plasmodium yoelii yoelii]
  misc_feature (13)..(80): SWISSPROT Homolog: EC 1.10.2.2 Ubiquinol-cytochrome c reductase complex 7.8 kDa protein
MEQVYNRFGFHWADEEVTDPKALLEERSKAKCVSQWYEYQKCVKRIENDETGHKHCTGQYFDYWKCVDKNVAEKLFEMLK

SEQ ID NO: 12843 - DNA, 1191 bp, Sorghum bicolor
  misc_feature: Ceres ANNOT ID no. 6119696
  misc_feature: Encodes the peptide sequence at SEQ ID NO 12844
atggcgaaggagacggagtactacgacgtgctcggcgtctgccccgccgcatccgacgacgagatccgcaaggcctactacatcaaggcgagacaggtgcatcctgacaagaatcccaacgacccacacgcggccgagaagttccaggctcttggagaggcttaccaggtgctgagtgaccctctgcagaggaaggcctacgacggctacggcaagaacagcatatccagggagaacatactggatggtactgtggtgtttacccttcttttcgggagcgagctgttcgaggactacattggtcatcttgctatggcaacaatggcttcctcggagttgacaaacgataatgacagccctgaaaagcttcaggataggctcaagaatgtacaaagggaaagagaggaaaagctagctagattcctcaaggaattcctctctcagtatgttcgtggagacaaagaaggatttgctaaccgtgctgaagctgaggcaaagaggctctcaagcactagtcagtcttctgatcctacatctgggttggatattcttcgcaccattggatacatctattctcgacaagcagcaaaggagcttggcaagaaggccgtgtacctaggagtgccatttgtggccgagtgggtgaggaacaagggccatctgtggaagtcgcagatcacagcagcgaaaggggccctgcagctgttgcagttgcaagaggaggcctgccggcagagtaacaaggatagcaatgccacagagcaggatgtcgacttgcagatgaggatgaacaaggacctgatgatgagctcactgtggaagctgaatgttgtggatattgaaatgactctattgcatgtttgtgaaatggtgctatacgaaaacaatgtcaagaaagaggatctgaaggcccgagcaacggccttgagaattctggggaaaatatttcagagggaaaaggaggcactgccagcgccagcaccagcaccagcaccagcaccaggtccatcaggaccatcaaaacgaacagttcttgacgatgacagcagctcagatgaaagttcagacgatgacctggctcggacagtgccataccggactcctgcatttactcagggaatcggcaggctgttccgatgcttatgcaacccagcttatgatgttgacgatgatttcgagccccgcaaatga

SEQ ID NO: 12844 - protein, 396 aa, Sorghum bicolor
  misc_feature: Ceres ANNOT ID no. 6119696
  misc_feature (6)..(68): Pfam Id: DnaJ Pfam Desc: DnaJ domain
  misc_feature (1)..(290): NCBI GI: 2829925 NCBI Desc: similar to dnaj-like protein, gpy119692230757 [arabidopsis thaliana]
  misc_feature (1)..(367): NCBI GI: 30699227 NCBI Desc: dnaj heat shock n-terminal domain-containing protein [arabidopsis thaliana]
  misc_feature (1)..(320): NCBI GI: 115479909 NCBI Desc: os09g0493800 [oryza sativa (japonica cultivar-group)]
  misc_feature (1)..(320): NCBI GI: 42407725 NCBI Desc: dnaj protein family-like [oryza sativa (japonica cultivar-group)]
  misc_feature (1)..(357): NCBI GI: 57340266 NCBI Desc: dnaj-like protein [brassica juncea]
MAKETEYYDVLGVCPAASDDEIRKAYYIKARQVHPDKNPNDPHAAEKFQALGEAYQVLSDPLQRKAYDGYGKNSISRENILDGTVVFTLLFGSELFEDYIGHLAMATMASSELTNDNDSPEKLQDRLKNVQREREEKLARFLKEFLSQYVRGDKEGFANRAEAEAKRLSSTSQSSDPTSGLDILRTIGYIYSRQAAKELGKKAVYLGVPFVAEWVRNKGHLWKSQITAAKGALQLLQLQEEACRQSNKDSNATEQDVDLQMRMNKDLMMSSLWKLNVVDIEMTLLHVCEMVLYENNVKKEDLKARATALRILGKIFQREKEALPAPAPAPAPAPGPSGPSKRTVLDDDSSSDESSDDDLARTVPYRTPAFTQGIGRLFRCLCNPAYDVDDDFEPRK

SEQ ID NO: 12845 - DNA, 741 bp, Sorghum bicolor
  misc_feature: Ceres ANNOT ID no. 6119719
  misc_feature: Encodes the peptide sequence at SEQ ID NO 12846
atgacggcgcccaagcctggcgggggagcggcggccgcggcgcgggcggccgcggcggggcccaggacggtgctcatcacgggggtcagcagggggcttggccgggccctggcgctcgagctcgcgcgtcgcgggcacgcggtggtcggctgcggccgctccgccgagcacctccgctccctcgaggcagagatcacgtcgccgtcgcgccacttcctcaccgtcgccgatgtcaggtctgacagcagtgtggccgagctggcaaaggctgttgtggaaaggaagcaagttccagatattatagtaaacaatgctggtacaataaacaagaataacaagacatggaatgtaccagcggaagattttgatatggtggtcgatacaaatatcaaaggaacagcaaatgtgcttcgccatttcgtaccacttatgatagagaagagacatgggattataattaatctatcctctggttggggaagatctgctgctgcagaggttgctccatattgtgcttcgaagtgggcgattgagggcttgacacgctcgttggctaaagagctgcctcctggattggcagccattgctcttagccctggtgtcgtgaatactgacatgcttacttcatgctttggaagctcagccgcattgtatcaaacaactgaaacatgggcacccaaggcagctacaatgatactaagcctttcactcgatgataacggtgcctccttgactgtatga

SEQ ID NO: 12846 - protein, 246 aa, Sorghum bicolor
  misc_feature: Ceres ANNOT ID no. 6119719
  misc_feature (22)..(189): Pfam Id: adh_short Pfam Desc: short chain dehydrogenase
  misc_feature (26)..(231): Pfam Id: NAD_binding_4 Pfam Desc: Male sterility protein
  misc_feature (1)..(224): NCBI GI: 115446723 NCBI Desc: os02g0557700 [oryza sativa (japonica cultivar-group)]
  misc_feature (20)..(246): NCBI GI: 92880932 NCBI Desc: short-chain dehydrogenase/reductase sdr [medicago truncatula]
  misc_feature (22)..(246): NCBI GI: 75910976 NCBI Desc: short-chain dehydrogenase/reductase sdr [anabaena variabilis atcc 29413]
  misc_feature (22)..(246): NCBI GI: 113477427 NCBI Desc: short-chain dehydrogenase/reductase sdr [trichodesmium erythraeum ims101]
  misc_feature (22)..(246): NCBI GI: 119485616 NCBI Desc: short-chain dehydrogenase/reductase sdr [lyngbya sp. pcc 8106]
  misc_feature: The sequence is a functional homolog of SEQ ID NO. 389 in the 11/188,298 US application
MTAPKPGGGAAAAARAAAAGPRTVLITGVSRGLGRALALELARRGHAVVGCGRSAEHLRSLEAEITSPSRHFLTVADVRSDSSVAELAKAVVERKQVPDIIVNNAGTINKNNKTWNVPAEDFDMVVDTNIKGTANVLRHFVPLMIEKRHGIIINLSSGWGRSAAAEVAPYCASKWAIEGLTRSLAKELPPGLAAIALSPGVVNTDMLTSCFGSSAALYQTTETWAPKAATMILSLSLDDNGASLTV

SEQ ID NO: 12847 - DNA, 1563 bp, Sorghum bicolor
  misc_feature: Ceres ANNOT ID no. 6119771
  misc_feature: Encodes the peptide sequence at SEQ ID NO 12848
atggcatcagacgagttcatcagccttgagtcaccttgcgaggctgatgcgcaagatgaagggggagacgttcaggtagctcctgatgtgaatggggcggagcctctcgcatctgaactccaaccagaaggggaatctggtgttctgggcagtaatccgaagccatcagctgggaacctggatcttgaagaggggcaaatggaagatatggacatcacggatgatgacatagtggttggaaaggatcagcacgtgaccagcgttgcagctgtgcagacggtgatcggttttgaggtgaagctggacaagggtgatgtgactgaaaatgcaccaatttacgagtcaaacagcatccccgttgaagaaagttcctcaagaggagttaaaagagcccgtgtggaatcaaaggagccttctattcgtgtcatctacagtgacttgacaagggaaagcaaaagaaagcttatgcaactgatgcaacaatggtctgagtggcaggccagaaggcagcaccatttgaaggaagctgtggaagggaccttagaaagtggtgaagagacttattatccagcattacatgttggttcagagaaatcttgtgctgtgtcattttgggtggataaccaagcaagggaaagtgacatcgtagatgatgattctgttccactgtacgatcgggagtttaccttgggctcgactcctctgggtgattcatcaaacactgaaagcagggcagataaggacgattcacgctgtttcaattgtggttcttatagccatgctctgaaggattgcccaaagcctcgggacaacttcgcaattagcaatgcccggaagcagcacaatttgaaaagaaaccaatctaatgtgaaccgtgtacaaaatcgatactaccagaaaactcctggcaaatttgatgatctgaaagctggagtactgggacctgaaactagacagtgcttggggatcggggaaaatgatccccctccttggctgcatagaatgcgtgagttagggtatcctccgggctacctagatgtggttgacgatgaagataaaccttctggtatcaccatatttggagatggtgagatgaaactagagtatgaggagggagagctttcagagcaagccgaggcatccccacctaagaaaaggatgacagtggaattccctggaataaatgcccccgtcccagagaatggtgaccagtggctgtggggtagtgccccaccccagtcctcaagccgccaccactcattggattcgagggattaccgtgatagaggacctcctggtgctgatcattattcatcgagataccattcccacgattatgggcctttgagcccaagcttagggaggtcacactcagacagggggtggagaagtccgcctcgttatgataatccaccagcagacgatggtgcctggacgccgcattcataccccagcaggcagtactcgggccactacagctcgagctctgatatgtcgtcacgccattccagggatagagacagagacaggcatgacagcaggcactaccaccaccgcagatga

SEQ ID NO: 12848 - protein, 520 aa, Sorghum bicolor
  misc_feature: Ceres ANNOT ID no. 6119771
  misc_feature (309)..(359): Pfam Id: PSP Pfam Desc: PSP
  misc_feature (56)..(439): NCBI GI: 42572017 NCBI Desc: proline-rich spliceosome-associated (psp) family protein / zinc knuckle (cchc-type) family protein [arabidopsis thaliana]
  misc_feature (248)..(439): NCBI GI: 9828614 NCBI Desc: f1n21.3 [arabidopsis thaliana]
  misc_feature (221)..(443): NCBI GI: 85681282 NCBI Desc: zinc finger cchc domain-containing protein 8
  misc_feature (244)..(487): NCBI GI: 34190917 NCBI Desc: zcchc8 protein [homo sapiens]
  misc_feature (221)..(487): NCBI GI: 41946896 NCBI Desc: zinc finger, cchc domain containing 8 [homo sapiens]
MASDEFISLESPCEADAQDEGGDVQVAPDVNGAEPLASELQPEGESGVLGSNPKPSAGNLDLEEGQMEDMDITDDDIVVGKDQHVTSVAAVQTVIGFEVKLDKGDVTENAPIYESNSIPVEESSSRGVKRARVESKEPSIRVIYSDLTRESKRKLMQLMQQWSEWQARRQHHLKEAVEGTLESGEETYYPALHVGSEKSCAVSFWVDNQARESDIVDDDSVPLYDREFTLGSTPLGDSSNTESRADKDDSRCFNCGSYSHALKDCPKPRDNFAISNARKQHNLKRNQSNVNRVQNRYYQKTPGKFDDLKAGVLGPETRQCLGIGENDPPPWLHRMRELGYPPGYLDVVDDEDKPSGITIFGDGEMKLEYEEGELSEQAEASPPKKRMTVEFPGINAPVPENGDQWLWGSAPPQSSSRHHSLDSRDYRDRGPPGADHYSSRYHSHDYGPLSPSLGRSHSDRGWRSPPRYDNPPADDGAWTPHSYPSRQYSGHYSSSSDMSSRHSRDRDRDRHDSRHYHHRR

SEQ ID NO: 12849 - DNA, 879 bp, Sorghum bicolor
  misc_feature: Ceres ANNOT ID no. 6120387
  misc_feature: Encodes the peptide sequence at SEQ ID NO 12850
atgcaggtgcgctgcgacttctgcggcgccgcgccggccgccgtgctctgctgggccgacgaggccgcgctctgctccgcctgcgaccgccgcgtccaccgcgccaacaagctcgtccacaagcaccgccgcatcccgctcgtccagcccgcctccggcaacgtctccgacgccgacgccgatgccgccgcgccgctctgcgacgtctgcaaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgagctcgtcgaccaggcgcccgcctcccctgacgacgacgacgacgacgacgacgcctgcggccgcgacaccagagccgccgccgagcccgacgctgtgcccgccctcggcgcgcagggctcctgcgcggccaaggcctcggctcttgagtccggcagcgtaggcggcggcagcagcatctccgactacctcaccaacatctgccccggctggcgcgtcgacgacctcctcttcgacgaccccgcgttctcagcggcatcggtgccgtccctggacgccgatctgttcgacgtggtggccggcggccggccggggaagcgcggcggcgtgtggtcgaccggcgccggagcgctgggcttcgacaaggcgacgccggcgtccgtcgtggccgtcccgacgcaagggttcgtgagggagatgagctggaactccgacagcgacagcgacgtgttcgcggtgccggagttcccgcacccgccgccggccaagaaggcgcggccggcgccggcgtcgactttctggtgcttctga

SEQ ID NO: 12850 - protein, 292 aa, Sorghum bicolor
  misc_feature: Ceres ANNOT ID no. 6120387
  misc_feature (1)..(47): Pfam Id: zf-B_box Pfam Desc: B-box zinc finger
  misc_feature (62)..(109): Pfam Id: zf-B_box Pfam Desc: B-box zinc finger
  misc_feature (1)..(228): NCBI GI: 115469928 NCBI Desc: os06g0713000 [oryza sativa (japonica cultivar-group)]
  misc_feature (1)..(194): NCBI GI: 116310380 NCBI Desc: h0115b09.3 [oryza sativa (indica cultivar-group)]
  misc_feature (1)..(193): NCBI GI: 22329252 NCBI Desc: zinc finger (b-box type) family protein [arabidopsis thaliana]
  misc_feature (1)..(217): NCBI GI: 115435138 NCBI Desc: os01g0202500 [oryza sativa (japonica cultivar-group)]
  misc_feature (1)..(204): NCBI GI: 92888719 NCBI Desc: zinc finger, b-box [medicago truncatula]
  misc_feature: The sequence is a functional homolog of SEQ ID NO 1023 in the 10/666,642US patent application
  misc_feature: The sequence is a functional homolog of SEQ ID NO 1024 in the 10/666,642US patent application
  misc_feature: The sequence is a functional homolog of SEQ ID NO 1370 in the 10/666,642US patent application
  misc_feature: The sequence is a functional homolog of SEQ ID NO 1522 in the 10/374,780US patent application
  misc_feature: The sequence is a functional homolog of SEQ ID NO 1593 in the 10/412,699US patent application
  misc_feature: The sequence is a functional homolog of SEQ ID NO 16 in the 10/412,699US patent application
  misc_feature: The sequence is a functional homolog of SEQ ID NO 1645 in the 10/374,780US patent application
  misc_feature: The sequence is a functional homolog of SEQ ID NO 1646 in the 10/374,780US patent application
  misc_feature: The sequence is a functional homolog of SEQ ID NO 1671 in the 10/412,699US patent application
  misc_feature: The sequence is a functional homolog of SEQ ID NO 1672 in the 10/412,699US patent application
  misc_feature: The sequence is a functional homolog of SEQ ID NO 2246 in the 10/374,780US patent application
  misc_feature: The sequence is a functional homolog of SEQ ID NO 234 in the 10/666,642US patent application
  misc_feature: The sequence is a functional homolog of SEQ ID NO 256 in the 10/714,887US patent application
  misc_feature: The sequence is a functional homolog of SEQ ID NO 256 in the 11/435,388US patent application
  misc_feature: The sequence is a functional homolog of SEQ ID NO 288 in the 10/374,780US patent application
  misc_feature: The sequence is a functional homolog of SEQ ID NO 582 in the 10/225,066US patent application
  misc_feature: The sequence is a functional homolog of SEQ ID NO 662 in the 11/435,388US patent application
  misc_feature: The sequence is a functional homolog of SEQ ID NO 670 in the 10/225,066US patent application
  misc_feature: The sequence is a functional homolog of SEQ ID NO 90 in the 10/412,699US patent application
  misc_feature: The sequence is a functional homolog of SEQ ID NO 906 in the 10/412,699US patent application
  misc_feature: Useful for making plants with modulated growth and phenotype characteristics
  misc_feature: The sequence is a functional homolog of SEQ ID NO 1593 in the 20040045049 US patent application
  misc_feature: The sequence is a functional homolog of SEQ ID NO 16 in the 20040045049 US patent application
  misc_feature: The sequence is a functional homolog of SEQ ID NO 16 in the 20040045049 US patent application
  misc_feature: The sequence is a functional homolog of SEQ ID NO 1671 in the 20040045049 US patent application
  misc_feature: The sequence is a functional homolog of SEQ ID NO 1672 in the 20040045049 US patent application
  misc_feature: The sequence is a functional homolog of SEQ ID NO 90 in the 20040045049 US patent application
  misc_feature: The sequence is a functional homolog of SEQ ID NO 906 in the 20040045049 US patent application
  misc_feature: The sequence is a functional homolog of SEQ ID NO 1024 in the 10/666,642 US patent application
  misc_feature: The sequence is a functional homolog of SEQ ID NO 1646 in the 10/374,780 US patent application
  misc_feature: The sequence is a functional homolog of SEQ ID NO 1672 in the 10/412,699 US patent application
  misc_feature: The sequence is a functional homolog of SEQ ID NO. 370 in the 11/188,298 US application
MQVRCDFCGAAPAAVLCWADEAALCSACDRRVHRANKLVHKHRRIPLVQPASGNVSDADADAAAPLCDVCKERRGLVFCVEDRAILCPDCDDPIHSANDLTAKHTRFLLVGAKLSAELVDQAPASPDDDDDDDDACGRDTRAAAEPDAVPALGAQGSCAAKASALESGSVGGGSSISDYLTNICPGWRVDDLLFDDPAFSAASVPSLDADLFDVVAGGRPGKRGGVWSTGAGALGFDKATPASVVAVPTQGFVREMSWNSDSDSDVFAVPEFPHPPPAKKARPAPASTFWCF

SEQ ID NO: 12851 - DNA, 1035 bp, Sorghum bicolor
  misc_feature: Ceres ANNOT ID no. 6120669
  misc_feature: Encodes the peptide sequence at SEQ ID NO 12852
atgtcgtcaccggcgagagccggcggcgcaccggaggatcaggcggaggcggacgtggaggaggagactgggagaggcacgtggcggcacgcggccttccacgtggcgacgacgatcgccacgccggcggcctacgcccccttgccgtttgctgttgcctcccttggctggcctcttggtgtctgcagcttggttattgggacactggttacatggtgctcaagcttggttgtggcctcgctatggcggtggaacggggagaaacacaccaactaccggctcctggcagagagcatctttggatatcggatcgaaagaacgggaatcagttacagtctacaaggaagcactgcaactaagatcttcagagctttcaacgcgttgggaacgatagccttctcctttggcgacgccatgctgccagaaattcagagcactgtgcgagaaccggtgagggcaaacatgtacaaaggcgtctcttcagcgtacacgatcatcgtcgtgtcctactggaccctcgcgttcagtggatactgggcgtttggctctcaagtccagccctacatcctgtcctccctgactgctccaagatgggcaactgtaatggcaaacctgtttgcagtcattcagatagcaggttgctttcagatatactgcaggccgacatttgcgcacttcgaggagcgggttcaggcgaagaagaacaggagctgcagatcctgcctgtgccggctgacatacacgtctgcatacatggccatgatcaccctcgtctccgctgcaatgcccttctttggggactttgtatcagtctgcggagcagttgggttcacccctctggacttcgtgctgcctgcactggcccttctcaagaccaggacgatgcctgataacccaggattgcagtgtgctgtgaagatgatcagcgctgctgtcgcgatcttgttctcgatcataggtgcgctggcatgcatcggcgcaatcaggtccatcgcgctcgatgtcaaaacctacaagttcttccatgatatgtga

SEQ ID NO: 12852 - protein, 344 aa, Sorghum bicolor
  misc_feature: Ceres ANNOT ID no. 6120669
  misc_feature (24)..(329): Pfam Id: Aa_trans Pfam Desc: Transmembrane amino acid transporter protein
  misc_feature (101)..(344): NCBI GI: 78708636 NCBI Desc: transmembrane amino acid transporter protein [oryza sativa (japonica cultivar-group)]
  misc_feature (111)..(344): NCBI GI: 21593453 NCBI Desc: proline transporter 1 [arabidopsis thaliana]
  misc_feature (111)..(344): NCBI GI: 2088642 NCBI Desc: proline transporter 1 [arabidopsis thaliana]
  misc_feature (111)..(344): NCBI GI: 21069018 NCBI Desc: betaine/proline transporter [avicennia marina]
  misc_feature (101)..(341): NCBI GI: 11034686 NCBI Desc: proline transport protein 2-like [oryza sativa (japonica cultivar-group)]
  misc_feature: Useful for making plants with altered carbon content
  misc_feature: Useful for making plants with altered nitrogen content
  misc_feature: Useful for making plants with modulated nitrogen use efficiency
  misc_feature: Useful for making plants with modulated oxidative stress sensitivity
  misc_feature: Functional homolog of the protein sequence given in SEQ ID NO 13529
  misc_feature: Functional homolog of the protein sequence encoded by LOCUS at2g36590
  misc_feature: The sequence is a functional homolog of SEQ ID NO. 313 in the 11/188,298 US application
MSSPARAGGAPEDQAEADVEEETGRGTWRHAAFHVATTIATPAAYAPLPFAVASLGWPLGVCSLVIGTLVTWCSSLVVASLWRWNGEKHTNYRLLAESIFGYRIERTGISYSLQGSTATKIFRAFNALGTIAFSFGDAMLPEIQSTVREPVRANMYKGVSSAYTIIVVSYWTLAFSGYWAFGSQVQPYILSSLTAPRWATVMANLFAVIQIAGCFQIYCRPTFAHFEERVQAKKNRSCRSCLCRLTYTSAYMAMITLVSAAMPFFGDFVSVCGAVGFTPLDFVLPALALLKTRTMPDNPGLQCAVKMISAAVAILFSIIGALACIGAIRSIALDVKTYKFFHDM

SEQ ID NO: 12853 - DNA, 1737 bp, Sorghum bicolor
  misc_feature: Ceres ANNOT ID no. 6120956
  misc_feature: Encodes the peptide sequence at SEQ ID NO 12854
atgcttgttgcccttccctctaccttcttcatatcattgttgccctccttcctaccttttccttcccctttcctgctcctacctgcacatactattctgacgctcgatgagatccagccatggcggaatagagagagactgatcgatgctagagaagagcaggtggtaagagaggtcaagggtaagggggtactagttgatatccttgaggacgacgatgaggagagatcaatcgataacaacaagctgctagacctcaacgagggtttcgatgcggagagcgaagaaggggaagtcggcgatgatgaggaagacgaaggtgaggagggcgacgatggcggtagcaccaccgatgttggtgggagtgggagctcaagcaacaatagcagcaccaacaacaattcggagagcaagaaggcagatggcaagggaggcagcaagtcagaggtaagtggtgagcagagggttccatcggtgcggcagtacaaccggtcgaagctgccccggctccggtggacgcctgacctccacatggccttcgtccatgccgttgagaggcttggtgggcaagagagagcgacccctaagctggtgcttcagatgatgaatgttaggggcctcagcattgctcatgtaaaaagccatctgcagatgtacagaagcaagaagctagaccaagatggtcgcccgaggggagctgtttcctcagtgtattccccaatggatttccattttatgagagccgatcggcgcttccatgacctgtccttcttccaaagagctgctgcgctctcctcctccaggcagctggaacgcggcggcttcttcgcgaggaactgcagcgctccggagttgagccggctctatggactcctccaccatcgcccggctccgacccaaactttcgacttcagaaattctagtttcagaaagcatgagtgggcgtcgtcgaatcagcaggaggcgatcacaatgtccaggaagcacgtcacgccaccgtcgacttcgccgcagacacacccgcttgcatctcccgtagcgctgaggagcgatcggcggtggtggccattcactgacgccggcgctgctgctgctgctgctgctgctgtcgccgccgacgagcacagggaagagacaggaaccaatgtaaagttcgacagttgcatcgggagcagttctcggccacttccgttggccatgtcgccggcggccgtgtccggagatcatcgtcttccgttccgatggcggcacgggggaagtggtagagatttcgtcttcggctacccgggtagcagctccaagatcacaacaagatcgtctgatcccgtcgtcatcgacgatggccagccactcgagccacagaattcgaagcacgtcgtagaaccaacaagggcctccgccgctccgccggacgaggcgtccttcatcaggcggcggccatcgccggtggaggcccaagatgcgacgccggacttacaactcagcttgtccccttcctcctccgtgttggccagcaagaagagaaagacaatatcgtcgtcttccatggacaccaccaccagctgcgagttctcgatctctctctcgctgtcgccacccgccgctgcagtttccatgcagcagcagcagaggcaagaaaagacaagacgaagcagcgacagcagcgggggcggaggtgaaggcgttcttgggcagagtactttggatctgaccatgtcgatcagggcattggagtga

SEQ ID NO: 12854 - protein, 578 aa, Sorghum bicolor
  misc_feature: Ceres ANNOT ID no. 6120956
  misc_feature (169)..(220): Pfam Id: Myb_DNA-binding Pfam Desc: Myb-like DNA-binding domain
  misc_feature (70)..(229): NCBI GI: 92871144 NCBI Desc: homeodomain-related [medicago truncatula]
  misc_feature (108)..(235): NCBI GI: 115483751 NCBI Desc: os11g0106100 [oryza sativa (japonica cultivar-group)]
  misc_feature (102)..(224): NCBI GI: 140057815 NCBI Desc: homeodomain-related [medicago truncatula]
  misc_feature (151)..(235): NCBI GI: 7527727 NCBI Desc: t5e21.10 [arabidopsis thaliana]
  misc_feature (151)..(235): NCBI GI: 79344640 NCBI Desc: dna binding / transcription factor [arabidopsis thaliana]
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 1992 in the 11/479,226US patent application
  misc_feature: The sequence is a functional homolog of SEQ ID NO 935 in the 10/666,642US patent application
  misc_feature: Useful for making plants with modulated growth and phenotype characteristics
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1992 in the 20070022495 US patent application
  misc_feature: The sequence is a functional homolog of SEQ ID NO 935 in the 20070033671 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MLVALPSTFFISLLPSFLPFPSPFLLLPAHTILTLDEIQPWRNRERLIDAREEQVVREVKGKGVLVDILEDDDEERSIDNNKLLDLNEGFDAESEEGEVGDDEEDEGEEGDDGGSTTDVGGSGSSSNNSSTNNNSESKKADGKGGSKSEVSGEQRVPSVRQYNRSKLPRLRWTPDLHMAFVHAVERLGGQERATPKLVLQMMNVRGLSIAHVKSHLQMYRSKKLDQDGRPRGAVSSVYSPMDFHFMRADRRFHDLSFFQRAAALSSSRQLERGGFFARNCSAPELSRLYGLLHHRPAPTQTFDFRNSSFRKHEWASSNQQEAITMSRKHVTPPSTSPQTHPLASPVALRSDRRWWPFTDAGAAAAAAAAVAADEHREETGTNVKFDSCIGSSSRPLPLAMSPAAVSGDHRLPFRWRHGGSGRDFVFGYPGSSSKITTRSSDPVVIDDGQPLEPQNSKHVVEPTRASAAPPDEASFIRRRPSPVEAQDATPDLQLSLSPSSSVLASKKRKTISSSSMDTTTSCEFSISLSLSPPAAAVSMQQQQRQEKTRRSSDSSGGGGEGVLGQSTLDLTMSIRALE

SEQ ID NO: 12855 - DNA, 1518 bp, Sorghum bicolor
  misc_feature: Ceres ANNOT ID no. 6121060
  misc_feature: Encodes the peptide sequence at SEQ ID NO 12856
atggatcgcgccgaccccgcgcggggccgcctcgccgtgctctcctcccacctccgcgccggtggcgcggtggcaggggaggcggcggggctggagaggtcgccggtgtccgcggcggcgcccgggccccgcgccggcgcgctcgccgtggtggacgggaggaccgggaagcggcacgaggtcaaggtctccgaggacggcaccgtgcgcgccaccgacttcaagaagattaccgctggtaaggatgacaagggtcttaagatttatgatcctggttatcttaacactgcccctgttcgctccaccatctgctacatcgatggggacgagggaatccttcgctacaggggttatccaatcgaagagttggctgaaagcagttcgtttgttgaggtggcgtaccttttaatgtatgggaatctgcctactcagagccaattggcaagctgggaattcgctatttctcagcattctgctgttcctcaaggactgttggatatcatacaatcgatgccccatgatgctcaccccatgggtgtccttgccagcgcaatgagcaccctttctgtcttccatccggatgcaaaccctgctcttaaaggtcaagatctttataagtcaaagcaggtgagggataaacaaattgtccgagtacttgggaaggcaccaacaatagcagctgctgcctacttgagattagcaggaaggcctcccatccttccttcaaatactctatcttattcagagaacttcttgtacatgctggactctttgggtaacaaatcatataaaccaaatcctcgacttgctcgagctctagacatcctgtttattctgcatgctgaacatgaaatgaactgctctacagctgctgttaggcaccttgcttcaagtggtgtggatgtcttcactgctctttctggtggtgttggagctctatatggtcctctgcatggcggtgcaaatgaggcagtactgaaaatgttaaatgagattggaagtgtggagaatattccagatttcattgaaggagtaaagaacaggaagaggaagatgtcaggttttgggcaccgtgtgtacaagaactatgaccctcgtgctaaagtcatcaggaaattgtcagaggaggtgttctcaattgttggacgggatccacttattgaggtggccattgctctagaaaaggcagcactgtcagatgaatattttgtcaagaggaagctatatccaaacgtggacttctactctgggttaatttatagggcgatgggattccctacagaatttttccctgtgctgtttgccattcctcgcatggctggctggctagcacattggaaagagtcactcgatgatcccgacactaagattatgaggccccaacaggtatacaccggcgcctggctgaggcattataccccagtcagagaacgagtgctgccaagccagagtgaggaactcggccagattgccacctcaaacgcaactaggcgccgccgtgctggttctgccctgtag

SEQ ID NO: 12856 - protein, 505 aa, Sorghum bicolor
  misc_feature: Ceres ANNOT ID no. 6121060
  misc_feature (92)..(460): Pfam Id: Citrate_synt Pfam Desc: Citrate synthase
  misc_feature (8)..(505): NCBI GI: 115445187 NCBI Desc: os02g0232400 [oryza sativa (japonica cultivar-group)]
  misc_feature (8)..(505): NCBI GI: 119732337 NCBI Desc: citrate synthase [oryza sativa (japonica cultivar-group)]
  misc_feature (7)..(505): NCBI GI: 1345933 NCBI Desc: citrate synthase, glyoxysomal precursor (gcs)
  misc_feature (7)..(505): NCBI GI: 975633 NCBI Desc: glyoxysomal citrate synthase [cucurbita cv. kurokawa amakuri]
  misc_feature (7)..(505): NCBI GI: 1084323 NCBI Desc: citrate synthase - cucurbit
  misc_feature (7)..(505): SWISSPROT Homolog: EC 2.3.3.1 Citrate synthase, glyoxysomal precursor
MDRADPARGRLAVLSSHLRAGGAVAGEAAGLERSPVSAAAPGPRAGALAVVDGRTGKRHEVKVSEDGTVRATDFKKITAGKDDKGLKIYDPGYLNTAPVRSTICYIDGDEGILRYRGYPIEELAESSSFVEVAYLLMYGNLPTQSQLASWEFAISQHSAVPQGLLDIIQSMPHDAHPMGVLASAMSTLSVFHPDANPALKGQDLYKSKQVRDKQIVRVLGKAPTIAAAAYLRLAGRPPILPSNTLSYSENFLYMLDSLGNKSYKPNPRLARALDILFILHAEHEMNCSTAAVRHLASSGVDVFTALSGGVGALYGPLHGGANEAVLKMLNEIGSVENIPDFIEGVKNRKRKMSGFGHRVYKNYDPRAKVIRKLSEEVFSIVGRDPLIEVAIALEKAALSDEYFVKRKLYPNVDFYSGLIYRAMGFPTEFFPVLFAIPRMAGWLAHWKESLDDPDTKIMRPQQVYTGAWLRHYTPVRERVLPSQSEELGQIATSNATRRRRAGSAL

SEQ ID NO: 12857 - DNA, 804 bp, Sorghum bicolor
  misc_feature: Ceres ANNOT ID no. 6121068
  misc_feature: Encodes the peptide sequence at SEQ ID NO 12858
atggacagtcgatccatggcgaccagccgcgccggcgtggacgcggccggcggtgtggcgccgttcgtggccaagacgtaccgcatggtggacgacccggccaccgacgccgtcgtcgcgtggggcagggacagcaacagcttcgtcgtcgccgaccctttcgtcttctcgcagacgctcctgcccgcgcacttcaagcactccaacttctccagcttcgtccgccagctcaacacctacggcttccggaaggtggatccggaccggtgggagttcgcgcacgtgtcgttcctgcgcgggcagacgcacctcctgagccagatcgtccgccggagcagcggcggcggcaacggcggcaagcgcaataaggacgacggcggcggcggcggcggcgtggacgaggacgacgcggcggtggccatggaggtggtccggctgaggcgggagcagcgagcgatcgaggagcaggtggccgcgatgtggcgccgcgtgcaggagacggagcggcggcccaagcagatgctcgcgttcctcgtcaaggtcgcgggcgacccgcaggtgctgcgccgcctcgtctccggcgccaccgccgccgggaccgacgacgccgccgccgccacggagccgcaggacgccgccaacgtcaagagggcgcggctgcttctggacgccggcggcggcggtagcgacggcgccgtcgacttcagcgggttctgtagcaccggagacgaagcagacgttgggttcaccgattacctgctgcagccaccgccgtacgtgttccccgtcaacagcggctactga

SEQ ID NO: 12858 - protein, 267 aa, Sorghum bicolor
  misc_feature: Ceres ANNOT ID no. 6121068
  misc_feature (20)..(178): Pfam Id: HSF_DNA-bind Pfam Desc: HSF-type DNA-binding
  misc_feature (15)..(243): NCBI GI: 115468488 NCBI Desc: os06g0553100 [oryza sativa (japonica cultivar-group)]
  misc_feature (67)..(243): NCBI GI: 53792658 NCBI Desc: heat shock factor rhsf13-like [oryza sativa (japonica cultivar-group)]
  misc_feature (12)..(219): NCBI GI: 54290345 NCBI Desc: heat shock transcription factor hsf21-like [oryza sativa (japonica cultivar-group)]
  misc_feature (18)..(225): NCBI GI: 33087081 NCBI Desc: heat stress protein [oryza sativa (japonica cultivar-group)]
  misc_feature (18)..(253): NCBI GI: 19490 NCBI Desc: heat stress transcription factor hsf30 [lycopersicon peruvianum]
  misc_feature: The sequence is a functional homolog of SEQ ID NO 1233 in the 11/479,226US patent application
  misc_feature: The sequence is a functional homolog of SEQ ID NO 144 in the 10/666,642US patent application
  misc_feature: The sequence is a functional homolog of SEQ ID NO 16 in the 10/412,699US patent application
  misc_feature: The sequence is a functional homolog of SEQ ID NO 168 in the 10/412,699US patent application
  misc_feature: The sequence is a functional homolog of SEQ ID NO 1685 in the 10/412,699US patent application
  misc_feature: The sequence is a functional homolog of SEQ ID NO 1686 in the 10/412,699US patent application
  misc_feature: The sequence is a functional homolog of SEQ ID NO 1687 in the 10/412,699US patent application
  misc_feature: The sequence is a functional homolog of SEQ ID NO 220 in the 10/666,642US patent application
  misc_feature: The sequence is a functional homolog of SEQ ID NO 2201 in the 10/666,642US patent application
  misc_feature: The sequence is a functional homolog of SEQ ID NO 377 in the 11/479,226US patent application
  misc_feature: The sequence is a functional homolog of SEQ ID NO 865 in the 10/666,642US patent application
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 168 in the 20040045049 US patent application
  misc_feature: The sequence is a functional homolog of SEQ ID NO 1685 in the 20040045049 US patent application
  misc_feature: The sequence is a functional homolog of SEQ ID NO 1686 in the 20040045049 US patent application
  misc_feature: The sequence is a functional homolog of SEQ ID NO 1687 in the 20040045049 US patent application
  misc_feature: The sequence is a functional homolog of SEQ ID NO 1233 in the 20070022495 US patent application
  misc_feature: The sequence is a functional homolog of SEQ ID NO 220 in the 20070033671 US patent application
  misc_feature: The sequence is a functional homolog of SEQ ID NO 2201 in the 20070033671 US patent application
  misc_feature: Useful for making plants with modulated heat sensitivity
  misc_feature: Functional homolog of the protein sequence given in SEQ ID NO 13734
  misc_feature: The sequence is a functional homolog of SEQ ID NO 1233 in the 11/479,226 US patent application
  misc_feature: The sequence is a functional homolog of SEQ ID NO 144 in the 10/666,642 US patent application
MDSRSMATSRAGVDAAGGVAPFVAKTYRMVDDPATDAVVAWGRDSNSFVVADPFVFSQTLLPAHFKHSNFSSFVRQLNTYGFRKVDPDRWEFAHVSFLRGQTHLLSQIVRRSSGGGNGGKRNKDDGGGGGGVDEDDAAVAMEVVRLRREQRAIEEQVAAMWRRVQETERRPKQMLAFLVKVAGDPQVLRRLVSGATAAGTDDAAAATEPQDAANVKRARLLLDAGGGGSDGAVDFSGFCSTGDEADVGFTDYLLQPPPYVFPVNSGY

SEQ ID NO: 12859 - DNA, 669 bp, Sorghum bicolor
  misc_feature: Ceres ANNOT ID no. 6121127
  misc_feature: Encodes the peptide sequence at SEQ ID NO 12860
atggcacccaatggagaatcaccggccatgacgacagccgtggcgccgctgctggcgacgatcatcggcagcttcggcggcgagcacaggcggcagcagagggtcccgtcgtgccacgagctccgcagctgcgtcgcgggcggcgatgaccaccacaaggaactggagctgatgctcagccccgacgacgccagcggcggcggcggcggcgacccacgggacgccgccgcggccacggcgcgctcggcggcggaggtggaggacgcggagtgcgagtgctgcggcatgtcggaggagtgcacggcgtcgtacatcgccgcggtgcgccgccgcttctcgggccgcctggtgtgcggcctgtgcgccgaggccgtggccgaggaggccggcaagaacggcggcgaccgcggcgccgcgctggcggcgcacatggccgtgtgccggcggttcaacggcttcgggaggacgcaccccgcgctgttccaggccgacgccgtcattggcatcgtcaggaagctctcggggtcgggcggcccaaggtcgcccaggtctgacgctggcacgagggtcgtcgtcagtgaaggcgccaagaccgccaccgccgtcgccgccgtcggcagcatggcgctcatcgccggcgtacgcaacgatcaggtggtcaccaactag

SEQ ID NO: 12860 - protein, 222 aa, Sorghum bicolor
  misc_feature: Ceres ANNOT ID no. 6121127
  misc_feature (85)..(172): NCBI GI: 7715593 NCBI Desc: f20b17.20 [arabidopsis thaliana]
  misc_feature (85)..(144): NCBI GI: 144923428 NCBI Desc: 4fe-4s ferredoxin, iron-sulfur binding [medicago truncatula]
  misc_feature (78)..(150): NCBI GI: 4587551 NCBI Desc: f15i1.18 [arabidopsis thaliana]
  misc_feature: The plant is abnormally small.
  misc_feature: Useful for making plants with modulated biomass
  misc_feature: Functional homolog of the protein sequence given in SEQ ID NO 13055
MAPNGESPAMTTAVAPLLATIIGSFGGEHRRQQRVPSCHELRSCVAGGDDHHKELELMLSPDDASGGGGGDPRDAAAATARSAAEVEDAECECCGMSEECTASYIAAVRRRFSGRLVCGLCAEAVAEEAGKNGGDRGAALAAHMAVCRRFNGFGRTHPALFQADAVIGIVRKLSGSGGPRSPRSDAGTRVVVSEGAKTATAVAAVGSMALIAGVRNDQVVTN

SEQ ID NO: 12861 - DNA, 2238 bp, Sorghum bicolor
  misc_feature: Ceres ANNOT ID no. 6121133
  misc_feature: Encodes the peptide sequence at SEQ ID NO 12862
atgtcgggggctgttcttgtcgccatcgccgcctccatcggcaatctgttgcaggggtgggacaatgccaccatcgcaggtgctgttctgtacataaagaaggaattccaattacaaaatgagcccactgtggaggggctgattgtggccatgtcacttattggtgccaccatcatcactacattctctgggccagtatcagactggatcggccgccgccctatgctcatcctctcgtcaattctgtactttctcagcagcctcatcatgctatggtcccctaatgtctatgtcctgctgctggcacgcctcgtagacggattcggtattggcttggctgtcacgcttgtgcctttgtacatttcagaaacagcccctccagagattagaggtttgctgaatacactgccacagttcagtggatcaggagggatgttcttgtcatactgcatggtgtttgggatgtcactgttgccatcacctgattggagaattatgcttggggtgctcgcgataccttcattgttcttctttggattgacaatattttaccttcctgaatccccaagatggcttgttagcaaaggtcggatggcagaggcaaagaaggtgttgcaaaaattacgcagcaaagaagatgtctcaggtgaattgtcccttcttgttgaagggttggaggttggaggagacacttcgattgaagagtacatcattggccctgccactgacgcagccgatgatcatgttactgatggtgataaggaacaaatcacactttatgggcctgaagaaggccagtcatggattgctcgaccttccaagggacccagcatgcttggaagtgtactttctctcgcatctcgtcatggcagcttggtgaaccagagtgtaccccttatggatccgattgtgacactttttgggagtgtccatgagaatatgcctcaagctggaggaagtatgaggagcacattgtttccaaactttggaagtatgttcagtgtcacagatcagcatgccaaaaatgagcagtgggacgaagagaatcttcacagggacgatgaggagtatgcatctgatggtgcaggaggtgattatgaggacaatctccacagtccattgctgtccaggcagacaacaagtgcggaagggaaggacattgtgcaccatggtcaccgtggaagttctttgagcatgagaaggcaaagcctcttgggggaggctggagagggtgtgagcagcactgatattggtgggggatggcagcttgcatggaaatggtcagagaaggaaggtgaggatggtaagaaggaaggtggtttcaaaagagtctacttgcaccaagagggagttcctggctcaagaatgggctcaattgtttcacttcctggtggtggcgatgttcatgagggtggcgagtttgtacatgctgctgctttagtaagccagtcagcacttttctcgaaggatcttaccgaaccacgcatgtctggtgctgccatgattaacgcatccgaggtagccgccaaaggttcaagctggaaagatttgtttgaacctggtgtgaggcgtgccctgttagtcggtgttggaattcagatccttcaacagtttgctggaatcaatggtgttctgtactataccccacaaattctcgagcaagctggcgtggcagttcttctttccaatcttggtctcagctcagcatcagcatctatcttgatcagttctctcactaccttactgatgcttcctagcattggcttagccatgagacttatggatctttctggaagaaggtttttgctgctaggcacaattccaatcttgatagcatctttagttatcctggtcgtgtccaatgtgattgacctgggtacagtggcccatgctgcgctctccacagtcagtgtcatcatctacttctgctgctttgtcatgggatttggtcccatccccaacattctatgtgcagagatctttccaaccagggttcgcggtctctgcattgccatctgtgccttgacgttttggattggagacatcattgtcacctacagccttcctgtaatgctgaatgctattggactagcaggtgtttttggcatatatgcagtcgtatgcttgattgcctttgtgtttgtcttccttaaggttcctgagacaaagggaatgccccttgaagtcatcactgagttctttgcagttggtgcgaagcaagcggctgcaaaagcctaa

SEQ ID NO: 12862 - protein, 745 aa, Sorghum bicolor
  misc_feature: Ceres ANNOT ID no. 6121133
  misc_feature (6)..(734): Pfam Id: Sugar_tr Pfam Desc: Sugar (and other) transporter
  misc_feature (11)..(685): Pfam Id: MFS_1 Pfam Desc: Major Facilitator Superfamily
  misc_feature (2)..(740): NCBI GI: 26986186 NCBI Desc: hexose transporter [hordeum vulgare subsp. vulgare]
  misc_feature (1)..(744): NCBI GI: 20453189 NCBI Desc: at4g35300/f23e12_140 [arabidopsis thaliana]
  misc_feature (1)..(744): NCBI GI: 92868426 NCBI Desc: sugar transporter superfamily; major facilitator superfamily mfs_1 [medicago truncatula]
  misc_feature (1)..(743): NCBI GI: 61613105 NCBI Desc: hexose transporter 6 [vitis vinifera]
  misc_feature (41)..(743): NCBI GI: 92875095 NCBI Desc: sugar transporter superfamily; major facilitator superfamily mfs_1 [medicago truncatula]
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 488 in the 11/188,298 US application
  misc_feature: The sequence is a functional homolog of SEQ ID NO. 296 in the 11/188,298 US application
MSGAVLVAIAASIGNLLQGWDNATIAGAVLYIKKEFQLQNEPTVEGLIVAMSLIGATIITTFSGPVSDWIGRRPMLILSSILYFLSSLIMLWSPNVYVLLLARLVDGFGIGLAVTLVPLYISETAPPEIRGLLNTLPQFSGSGGMFLSYCMVFGMSLLPSPDWRIMLGVLAIPSLFFFGLTIFYLPESPRWLVSKGRMAEAKKVLQKLRSKEDVSGELSLLVEGLEVGGDTSIEEYIIGPATDAADDHVTDGDKEQITLYGPEEGQSWIARPSKGPSMLGSVLSLASRHGSLVNQSVPLMDPIVTLFGSVHENMPQAGGSMRSTLFPNFGSMFSVTDQHAKNEQWDEENLHRDDEEYASDGAGGDYEDNLHSPLLSRQTTSAEGKDIVHHGHRGSSLSMRRQSLLGEAGEGVSSTDIGGGWQLAWKWSEKEGEDGKKEGGFKRVYLHQEGVPGSRMGSIVSLPGGGDVHEGGEFVHAAALVSQSALFSKDLTEPRMSGAAMINASEVAAKGSSWKDLFEPGVRRALLVGVGIQILQQFAGINGVLYYTPQILEQAGVAVLLSNLGLSSASASILISSLTTLLMLPSIGLAMRLMDLSGRRFLLLGTIPILIASLVILVVSNVIDLGTVAHAALSTVSVIIYFCCFVMGFGPIPNILCAEIFPTRVRGLCIAICALTFWIGDIIVTYSLPVMLNAIGLAGVFGIYAVVCLIAFVFVFLKVPETKGMPLEVITEFFAVGAKQAAAKA

SEQ ID NO: 12863 - DNA, 1518 bp, Sorghum bicolor
  misc_feature: Ceres ANNOT ID no. 6121167
  misc_feature: Encodes the peptide sequence at SEQ ID NO 12864
atggtgcgcctccaccagctcctttctcgcgcgctcgcatctcaccaaatcctcccttgtaccacctccggcgtccgctccaccccgcggctgctcctccgtccccggtcgccaccgcctgctcctcctccccacggtcgtaccttgcttcccatcatcgtagcggcgtcgcggcaatacgcctcgtcgaccttcgggaggcgaaggcgctcgtcgcggccgccggtgttgctggggcggaagagagcgaggaggccgacgcggaagggccctggcgagctcagcgtgcaaattggcattgaggaggccctccccgacgatcctgaaatcctgggcattgctgaaactcttcggacagatgttgggaaggcagtgaagctggccctcaacgaccttgaaggctcagattacattaccagagatccttctgtatgcaatgtaaacaagtatgctagcattgaggtctctcttctgctttgcgatgatgatttcatcaggaagctcaacaaggaatggagggatgaggatcatgctacggatgttctgtcgatgtctcagcatatcccagagcttgatattcccattctgcagttgggtgatatagtaatttctgttgaaacagctcgacggcaagcagaagaaaggggccacacacttcttgatgagataagaattctcatggtgcacgggctgttgcatttattgggctttgaccatgaagtcagcaaggtggctgaagaagagatggagaaagaagaagaacatatattaaatactcttgaatggagtggaaagggattaattaagagtgcctatgatattgctactggcatggaacatttacaaaattctgttgaggctgatagcagtatagaggaagcgatcctacaagagaaacatcaagccaaactaagccatatcatttgtgatatagatggtactattgtggattatgaaggaggcctgcatgaaaaatcaataggatctttgagagaggcaattgcaatgggagtaaatattatcatggttactagaaagggttcacttgtctatggaagggatggcaaagaagtttatagagcagaactggatttagatgtctgcaaggaggcattgctgtactccttgaagcataaaattcctcttgtcgcgtactgtgaggaacaaggtctaaccttgtttgaacacccatttgttgacttgttgcacactgtacataatgaaaacaaggtaaaagtgatgcattcaattgaggaccttttggaatgttcatctattcagaaattgcttctttttgatagtaccaaagaggattcatctgccctaaggcagcattgttcagaactgaccaaagggaaagcacatgttatcaaaatgcatcaagatacaattgatattgttcccctcaatgcttcaaaaagtggtggtttaagaattctacttgatcatcttggaataacaaaagattgtgatcttgatgctgttggagactataccagatggctgagcaacaaatga

SEQ ID NO: 12864 - protein, 505 aa, Sorghum bicolor
  misc_feature: Ceres ANNOT ID no. 6121167
  misc_feature (307)..(499): Pfam Id: Hydrolase_3 Pfam Desc: haloacid dehalogenase-like hydrolase
  misc_feature (1)..(346): NCBI GI: 49388540 NCBI Desc: haloacid dehalogenase-like hydrolase-like [oryza sativa (japonica cultivar-group)]
  misc_feature (36)..(346): NCBI GI: 57899484 NCBI Desc: haloacid dehalogenase-like hydrolase-like [oryza sativa (japonica cultivar-group)]
  misc_feature (36)..(422): NCBI GI: 115439833 NCBI Desc: os01g0739400 [oryza sativa (japonica cultivar-group)]
  misc_feature (346)..(497): NCBI GI: 49388855 NCBI Desc: haloacid dehalogenase-like hydrolase-like protein [oryza sativa (japonica cultivar-group)]
  misc_feature (153)..(260): NCBI GI: 15887709 NCBI Desc: agr_c_626p [agrobacterium tumefaciens str. c58]
MVRLHQLLSRALASHQILPCTTSGVRSTPRLLLRPRSPPPAPPPHGRTLLPIIVAASRQYASSTFGRRRRSSRPPVLLGRKRARRPTRKGPGELSVQIGIEEALPDDPEILGIAETLRTDVGKAVKLALNDLEGSDYITRDPSVCNVNKYASIEVSLLLCDDDFIRKLNKEWRDEDHATDVLSMSQHIPELDIPILQLGDIVISVETARRQAEERGHTLLDEIRILMVHGLLHLLGFDHEVSKVAEEEMEKEEEHILNTLEWSGKGLIKSAYDIATGMEHLQNSVEADSSIEEAILQEKHQAKLSHIICDIDGTIVDYEGGLHEKSIGSLREAIAMGVNIIMVTRKGSLVYGRDGKEVYRAELDLDVCKEALLYSLKHKIPLVAYCEEQGLTLFEHPFVDLLHTVHNENKVKVMHSIEDLLECSSIQKLLLFDSTKEDSSALRQHCSELTKGKAHVIKMHQDTIDIVPLNASKSGGLRILLDHLGITKDCDLDAVGDYTRWLSNK

SEQ ID NO: 12865 - DNA, 882 bp, Sorghum bicolor
  misc_feature: Ceres ANNOT ID no. 6121192
  misc_feature: Encodes the peptide sequence at SEQ ID NO 12866
atgtcctgcttccaaggactattgttctgtcctgaagctgcttcactgctgcttcataatttttgcatttaccatattagccccccaggacatgagttaggagctgctccaatttcgccaaatgctcctataccttctgttgatgacttggcagatcaggttgcagatgtcctcgatttctttggattaggctctgttatgtgctttggtgtcactgcaggtgcctacattctaactctgtttgcgacaaagtatagggagcgggtactaggtcttatccttgtttcacccctatgtaaaggccccacttggactgagtggttatacagtaaggtgacatccaatctgctgtattactatgggatgtgtgggttggtgaaggagtgcctacttcagcggtacttcagcaaggaagtgcgaggattctctgaattacccgaatcagacatagtgcaggcttgtaaaagcttgctagatcagcggcagagcatgaatgtatggcgctttgttcagacaatgaatgagagatatgacttgactgaacagctaaagcaacttcagtgtagaaccctgatttttgtcggtgagaattctcagtttcacaccgaggctgttcacatgacatcaaagctcgacaagagatattgtgctctagttgaggtccaagcatgtggatcactcgtaactgaggagcaaccacatgcaatgcttataccaatggagtacttcttcatgggatatggcttgtacaggcctagccagctggactgcagcccgcgcagccccctgagcccattctgtatatcgccggatctcctgtcacctgagagcatgggggtgaagctaaagccgatcaaaacgcgagtcaggcttgaagtgtag

SEQ ID NO: 12866 - protein, 293 aa, Sorghum bicolor
  misc_feature: Ceres ANNOT ID no. 6121192
  misc_feature (1)..(251): Pfam Id: Ndr Pfam Desc: Ndr family
  misc_feature (1)..(289): NCBI GI: 21593137 NCBI Desc: pollen specific protein sf21 [arabidopsis thaliana]
  misc_feature (9)..(289): NCBI GI: 82547868 NCBI Desc: sf21d2 splice variant protein [helianthus annuus]
  misc_feature (9)..(289): NCBI GI: 82547866 NCBI Desc: sf21d1 splice variant protein [helianthus annuus]
  misc_feature (1)..(289): NCBI GI: 82494244 NCBI Desc: sf21c1 [helianthus annuus]
  misc_feature (9)..(288): NCBI GI: 82547870 NCBI Desc: sf21e protein [helianthus annuus]
MSCFQGLLFCPEAASLLLHNFCIYHISPPGHELGAAPISPNAPIPSVDDLADQVADVLDFFGLGSVMCFGVTAGAYILTLFATKYRERVLGLILVSPLCKGPTWTEWLYSKVTSNLLYYYGMCGLVKECLLQRYFSKEVRGFSELPESDIVQACKSLLDQRQSMNVWRFVQTMNERYDLTEQLKQLQCRTLIFVGENSQFHTEAVHMTSKLDKRYCALVEVQACGSLVTEEQPHAMLIPMEYFFMGYGLYRPSQLDCSPRSPLSPFCISPDLLSPESMGVKLKPIKTRVRLEV

SEQ ID NO: 12867 - DNA, 1497 bp, Sorghum bicolor
  misc_feature: Ceres ANNOT ID no. 6121791
  misc_feature: Encodes the peptide sequence at SEQ ID NO 12868
atggagaaccagcatcacgcggcggttgcgcgaggtggcgaggagagcatcagctcgtcgtcggtgtggatcgagaccaagaagcagctccgcctggccgcgccgctcgccgcggggttcctcctgcagaaggtgatccagaccatctccatcatgttcgtcggccgcctcggcgagctccctctcgccggcgcctccctcgccacctccttcgccagcgtcaccggcttcagcttgctggcgttcggcgcggggcagcaccacctgctaggcatctacaagcagcgtgcgatgctggtcctcgcggcggtgagcgtgccggtgtcgctggtgtgggcgtacacgggcgacatcctggtgtggttccggcaggaccgcgagatcgcggcgggcgccggcagctacatccggtgcatggtcccggcgctgttcctgttcgggcagctgcagtgccacgtccggttcctgcagccgcagaacgtggtggtgcccgtcatgctcagctccggcgccaccgtcgccgtgcacgtcgccgtctgctggctgctcgtccgcaggctcggactgggtgccgacggcgccgcgctggccaacgccgtctctaaccttgtcaacctctccgccctcgcgctgtacatcaggctctcgccgtcctgcaaggccacctggctggggttctcccgccaggcgttccatggcatcctcgggttcttgaagctcgccatgccttcggctgccatggtctgtatggagtggtggtccttcgagttcctagttctgctttccggcctcctcccgaaccccaagcttgagacggccgtcatgtctatctgcttcaacacttacgtcttcgcattcatgttcccaatgggacttggtgctgcagcaagcatacgcgtctcaaacgagcttggtgcaggacggccaccggcggcccggctggcgactcgggtggtgatgctcttggcgttctcgctgggcgtatcggagggtctcgtcatggtgctggcgcgcactctgctcggctacgcctacaccaacgacaaggaggtcgtcttgtacaccgccagactgatgccgatcctcgcggcctgcacattattggactgcctccagtgcgtcctgtcaggtgttgttaggggttgtggccgacaaaagattggtgcctttatcaaccttgctgcattctatattgtcggcatccctgtggcggccatctttgcctttgtttgccatcttggtggaatgggtctttggtttgggatcttgatcggagtagcagtgcagatggtcttgctcctttgcatcaccttgtacaccaactggaacaaagaagtattgaaagcaaatgacagagttttcagttgtcctctgcctgtcgacgacacgataacatcaggttgtagcgagcagggaaatggatgtaattttgttgggaataagcaggatgatgctaatggagcaattgagcggacaaatggtttgaacaaaggttga

SEQ ID NO: 12868 - protein, 498 aa, Sorghum bicolor
  misc_feature: Ceres ANNOT ID no. 6121791
  misc_feature (35)..(182): Pfam Id: MatE Pfam Desc: MatE
  misc_feature (243)..(406): Pfam Id: MatE Pfam Desc: MatE
  misc_feature (13)..(463): NCBI GI: 38346676 NCBI Desc: osjnba0069d17.7 [oryza sativa (japonica cultivar-group)]
  misc_feature (7)..(460): NCBI GI: 115481602 NCBI Desc: os10g0345100 [oryza sativa (japonica cultivar-group)]
  misc_feature (81)..(448): NCBI GI: 78708280 NCBI Desc: mate efflux family protein [oryza sativa (japonica cultivar-group)]
  misc_feature (81)..(448): NCBI GI: 115481598 NCBI Desc: os10g0344000 [oryza sativa (japonica cultivar-group)]
  misc_feature (21)..(453): NCBI GI: 115469850 NCBI Desc: os06g0707100 [oryza sativa (japonica cultivar-group)]
MENQHHAAVARGGEESISSSSVWIETKKQLRLAAPLAAGFLLQKVIQTISIMFVGRLGELPLAGASLATSFASVTGFSLLAFGAGQHHLLGIYKQRAMLVLAAVSVPVSLVWAYTGDILVWFRQDREIAAGAGSYIRCMVPALFLFGQLQCHVRFLQPQNVVVPVMLSSGATVAVHVAVCWLLVRRLGLGADGAALANAVSNLVNLSALALYIRLSPSCKATWLGFSRQAFHGILGFLKLAMPSAAMVCMEWWSFEFLVLLSGLLPNPKLETAVMSICFNTYVFAFMFPMGLGAAASIRVSNELGAGRPPAARLATRVVMLLAFSLGVSEGLVMVLARTLLGYAYTNDKEVVLYTARLMPILAACTLLDCLQCVLSGVVRGCGRQKIGAFINLAAFYIVGIPVAAIFAFVCHLGGMGLWFGILIGVAVQMVLLLCITLYTNWNKEVLKANDRVFSCPLPVDDTITSGCSEQGNGCNFVGNKQDDANGAIERTNGLNKG

SEQ ID NO: 12869 - DNA, 984 bp, Sorghum bicolor
  misc_feature: Ceres ANNOT ID no. 6121933
  misc_feature: Encodes the peptide sequence at SEQ ID NO 12870
atgctggcgtggaaggagaaggtggcggaccgcctcgctcgcctcctcgccgactcccctgtctccccctccccggcacaggccgccgtcgcgccaccgcaggcaaaatctttcccagcagaaccttttattccccccaagacatcatcattatcttcgtatgtattttccctcctaccaacctcaaacttggggcatgagcagaattcaccttgttctgagactttgagaccattacctcctgaatcacttcctaagaaatggagagggagtaatttaacatggaaagatcctcccctggaattgagtgaggagtctgggtctgaaagtgagagagatgaaaggaatgggaatttcggtagcgaccaggtccttcagtcatacaggtccataaataactcaaatggaaatgaggaaacatcgacttcagattgtgcgggcactcttcgttatctgactgaaaagtctatgtttgtgtctccaaaactatttgcattctttcaatcttctctccctgggaccttgaaggggtgccactgggtattgctatatagcacctggaagcatgggatatctctaagaacacttcttcgtagaagtgagaatattcagggtccatgcctattgattgtcggagatatgcaaggggctgtgtttggtggcttattgaacagtcctctgcggccaacagagaaaaggaaatatcagggaacaaaccagacgtttgtgttcacaacgatacatggtgaacctagacttttcagaccaacgggtgcaaacagattctattatttgtgcttgaatgatgctttagcatttggaggtggtggaagcttcgcattgtgtgttgatgaagatctgttacatggaagcagtggatcatgtgagacatttggaaactcatgcttggcacatagtccagagtttgaactaaagaatgtggagctatggggattcacgcattcatggaaccgttcgacataa

SEQ ID NO: 12870 - protein, 327 aa, Sorghum bicolor
  misc_feature: Ceres ANNOT ID no. 6121933
  misc_feature (182)..(320): Pfam Id: TLD Pfam Desc: TLD
  misc_feature (46)..(322): NCBI GI: 51535088 NCBI Desc: nucleolar protein-like [oryza sativa (japonica cultivar-group)]
  misc_feature (46)..(321): NCBI GI: 46805939 NCBI Desc: oxidation protection protein-like [oryza sativa (japonica cultivar-group)]
  misc_feature (152)..(319): NCBI GI: 119612309 NCBI Desc: oxidation resistance 1, isoform cra_a [homo sapiens]
  misc_feature (152)..(319): NCBI GI: 91207267 NCBI Desc: oxidation resistance protein 1 (protein c7)
  misc_feature (152)..(319): NCBI GI: 10954046 NCBI Desc: oxidation protection protein [homo sapiens]
  misc_feature: Useful for making plants with altered protein content
  misc_feature: Useful for making plants with modulated drought sensitivity
  misc_feature: Useful for making plants with modulated seed size
  misc_feature: Useful for making plants with modulated cold sensitivity
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13486
  misc_feature: GREAT-hit functional homolog of the protein sequence given in SEQ ID NO 13487
  misc_feature: Useful for making plants with altered protein content
  misc_feature: Functional homolog of the protein sequence given in SEQ ID NO 13487
MLAWKEKVADRLARLLADSPVSPSPAQAAVAPPQAKSFPAEPFIPPKTSSLSSYVFSLLPTSNLGHEQNSPCSETLRPLPPESLPKKWRGSNLTWKDPPLELSEESGSESERDERNGNFGSDQVLQSYRSINNSNGNEETSTSDCAGTLRYLTEKSMFVSPKLFAFFQSSLPGTLKGCHWVLLYSTWKHGISLRTLLRRSENIQGPCLLIVGDMQGAVFGGLLNSPLRPTEKRKYQGTNQTFVFTTIHGEPRLFRPTGANRFYYLCLNDALAFGGGGSFALCVDEDLLHGSSGSCETFGNSCLAHSPEFELKNVELWGFTHSWNRST

SEQ ID NO: 12871 - DNA, 888 bp, Sorghum bicolor
  misc_feature: Ceres ANNOT ID no. 6122199
  misc_feature: Encodes the peptide sequence at SEQ ID NO 12872
atgccaagctctgatcgtatgaccggtgctataaagctcaggcttgtcctgctcctcgtcgtcgtcggagcagcagccatctccgtcgccgccgcggcggcggcggacgtcgactccttcagctacccggtcttcgacgccaccacgacgcaggacctcgtggcgggaagcaacacctccatcctcacgccggcgtccctcctcttcaaccaggacgccctcttcgccgagttcaaccgcaccgagggcttcctgctgctctcgcgcaccgtcgacgtctggcgcgtcggcaccggcggtgcccccgccttcgaggcctccttcaacaccagcttcgctctcagcggcggcgcaccggtggcgttcgtcgtcctcagggacagctacccgacgctgtacggcacgggcgggctccgcggcttcgccaactacagcgcgtccgacgccgacgatggcgccacctcccgcaacgcttccggcagcctcgtgtccgtcgaggccggaccggtgaggtcgtatggaccggacagcccggccgtcggcctcaacgtcaccgtcacgcccaacgatgcacgcgttgccgtgtggatcgagtatgacgccggcgtgcaccggctgtccgtgtacgtcgccggcgctggcgaggcgaggccggccacggcgctcctcgacgcgccgctcggcctcgctggagagcgcaccaccgagaaagcgatggtcggattcttcgctggcgccgtccaagacattctcgtcggcgtacgtgactggaacctgacggtggacaggttcttcgacagttccggcgggggtgatggatggaaaaagggcacctcgtcgtgggtgatactgctcgccgtgctcgggtcagtggcagccatggcctga

SEQ ID NO: 12872 - protein, 295 aa, Sorghum bicolor
  misc_feature: Ceres ANNOT ID no. 6122199
  misc_feature (36)..(260): Pfam Id: Lectin_legB Pfam Desc: Legume lectin domain
  misc_feature (17)..(295): NCBI GI: 90265153 NCBI Desc: h0201g08.6 [oryza sativa (indica cultivar-group)]
  misc_feature (17)..(295): NCBI GI: 38345577 NCBI Desc: osjnba0027h06.13 [oryza sativa (japonica cultivar-group)]
  misc_feature (17)..(295): NCBI GI: 115456852 NCBI Desc: os04g0110100 [oryza sativa (japonica cultivar-group)]
  misc_feature (182)..(275): NCBI GI: 5545339 NCBI Desc: lectin-like protein kinase [populus nigra]
  misc_feature (56)..(267): NCBI GI: 90265150 NCBI Desc: h0201g08.3 [oryza sativa (indica cultivar-group)]
MPSSDRMTGAIKLRLVLLLVVVGAAAISVAAAAAADVDSFSYPVFDATTTQDLVAGSNTSILTPASLLFNQDALFAEFNRTEGFLLLSRTVDVWRVGTGGAPAFEASFNTSFALSGGAPVAFVVLRDSYPTLYGTGGLRGFANYSASDADDGATSRNASGSLVSVEAGPVRSYGPDSPAVGLNVTVTPNDARVAVWIEYDAGVHRLSVYVAGAGEARPATALLDAPLGLAGERTTEKAMVGFFAGAVQDILVGVRDWNLTVDRFFDSSGGGDGWKKGTSSWVILLAVLGSVAAMA

SEQ ID NO: 12873 - DNA, 1623 bp, Sorghum bicolor
  misc_feature: Ceres ANNOT ID no. 6122265
  misc_feature: Encodes the peptide sequence at SEQ ID NO 12874
atgcagaccctccatgccgccgcgcccgcctccttcctcgcgccgcccgctccccacctccacctccggctccgcacagcgccgccacggttgggatccgcggcaggcgctctatcagcaaacgctgctgctcatgccgccctgtcgcgcgcctggttccccctgccgcaccgcgcctgccgccgccgtcgacgcgtcatgaggtcggcgtcgtccggtgctagggcgaccgtggcctccatggatgatgccaagaaggatgtgctcatagcactctcccaaatcatcgatcctgatttcggcacggacatcgtgtcctgtgggtttgtcaaggatttggagatcagtgaggccttagaagaggtctcatttcgtctagagctgacgactcctgcatgtccaatcaaagacgagttcgaacaaaaggcgaacgaggttgttgcagcacttccatgggttaagaaggtagatgtcacaatgtctgcgcaacctgcacagccaacgtatggaggggagcttccagaaggactacagaagatttccaacatcatagcagtttcaagctgcaagggaggggttgggaaatcaactgttgctgtaaatcttgcgtatacactagctggaatgggcgccagggttggaatcttcgatgccgatgtctttggtccaagcttaccaactatggtttctcctgaaaaccggttgctagtgatgaacccagaaaacagagctattcttccgactgagtatttgggcgtcaaaatggtgtcctttggatttgctggacaaggaagggcgatcatgcgaggtccaatggtttcaggagtcatcaatcagctgctgaccactactgactggggcgaacttgactaccttgtcattgatatgcctcctggaactggcgacatacacttaacactctgtcaggtggctccattgactgcagcggtgattgttaccacccctcagaagctggctttcattgatgttgcaaagggtgtaaggatgttctctaaactgaaggttccttgtgttgcagttgttgagaacatgtgctattttgatgctgatggaaaacgttattacccatttggacaaggttctggaactcaggtcgtgcagcagtttggaatacctcacctctttgatttgccaatacggccaactctttcggcttctggagatactggaattcctgaggtggtggctgatccgctaggggatgtggctaatatatttcagaatcttggagcatgtgttgttcaacaatgtgctaaaattaggcaacaagtttcaacagcggtgtcctatgatagatccattaaagcaatcagagtgaaagtgccagattcagacgaagagttcttgttgcatccagcaacagttagacggaatgatcgatctgctcaaagtgtggatgaatggacaggggagcaaaagcttcagtacagtgatataccagatgacatcgagccagaagagattaggcccatgggaaactatgcagtttctataacttggcctgatggatttagtcagatagcaccttatgaccaactggaaatgctggagcggttagtggatgttccgagtccaacagcgtctgcagtggcctcatcatga

SEQ ID NO: 12874 - protein, 540 aa, Sorghum bicolor
  misc_feature: Ceres ANNOT ID no. 6122265
  misc_feature (184)..(392): Pfam Id: CbiA Pfam Desc: CobQ/CobB/MinD/ParA nucleotide binding domain
  misc_feature (345)..(539): NCBI GI: 115439613 NCBI Desc: os01g0719700 [oryza sativa (japonica cultivar-group)]
  misc_feature (79)..(268): NCBI GI: 66357728 NCBI Desc: mrp like mind family atpase [cryptosporidium parvum]
  misc_feature (79)..(268): NCBI GI: 46227303 NCBI Desc: mrp like mind family atpase [cryptosporidium parvum]
  misc_feature (88)..(436): NCBI GI: 114777466 NCBI Desc: mrp protein [mariprofundus ferrooxydans pv-1]
  misc_feature (88)..(432): NCBI GI: 118194679 NCBI Desc: atpases involved in chromosome partitioning [cenarchaeum symbiosum]
MQTLHAAAPASFLAPPAPHLHLRLRTAPPRLGSAAGALSANAAAHAALSRAWFPLPHRACRRRRRVMRSASSGARATVASMDDAKKDVLIALSQIIDPDFGTDIVSCGFVKDLEISEALEEVSFRLELTTPACPIKDEFEQKANEVVAALPWVKKVDVTMSAQPAQPTYGGELPEGLQKISNIIAVSSCKGGVGKSTVAVNLAYTLAGMGARVGIFDADVFGPSLPTMVSPENRLLVMNPENRAILPTEYLGVKMVSFGFAGQGRAIMRGPMVSGVINQLLTTTDWGELDYLVIDMPPGTGDIHLTLCQVAPLTAAVIVTTPQKLAFIDVAKGVRMFSKLKVPCVAVVENMCYFDADGKRYYPFGQGSGTQVVQQFGIPHLFDLPIRPTLSASGDTGIPEVVADPLGDVANIFQNLGACVVQQCAKIRQQVSTAVSYDRSIKAIRVKVPDSDEEFLLHPATVRRNDRSAQSVDEWTGEQKLQYSDIPDDIEPEEIRPMGNYAVSITWPDGFSQIAPYDQLEMLERLVDVPSPTASAVASS

SEQ ID NO: 12875 - protein, 107 aa, Arabidopsis thaliana
  misc_feature: Ceres CLONE ID no. 1001761
  misc_feature: Useful for making plants with altered Lignin content
  misc_feature (92)..(92): Xaa is any aa, unknown, or other
MSSRGKRKDEDVRASDDESETHAPAKKVAKPADDSDQSDDIVVCNISKNRRVSVRNWNGKIWIDIREFYVKDGKTLPGKKGISLSVDQWNTXRNHAEDIEKALSDLS

SEQ ID NO: 12876 - protein, 357 aa, Arabidopsis thaliana
  misc_feature: Ceres CLONE ID no. 1002819
  misc_feature: The plant is abnormally small.
  misc_feature: Useful for making plants with modulated biomass
MKPVFCGNFEYDARESDLERLFRKYGKVERVDMKAGFAFVYMEDERDAEDAIRALDRFEYGRTGRRLRVEWTKNDRGGAGRSGGSRRSSSGLRPSKTLFVINFDAQNTRTRDLERHFEPYGKIVNVRIRRNFAFIQYEAQEDATRALDATNSSKLMDKVISVEYAVKDDDSRGNGYSPERRRDRSPDRRRRSPSPYRRERGSPDYGRGASPVAHKRERTSPDYGRGRRSPSPYKRARLSPDYKRDDRRRERVASPENGAVRNRSPRKGRGESRSPPPYEKRRESRSPPPYEKRRESRSPPPYEKRRERSRSRSKSSPENGQVESPGQIMEVEAGRGYDGADSPIRESSPSRSPPAEE

SEQ ID NO: 12877 - protein, 263 aa, Arabidopsis thaliana
  misc_feature: Ceres CLONE ID no. 100319
  misc_feature: The plant produces a reduced number of seeds.
  misc_feature: Useful for biocontainment applications
  misc_feature: Useful for making plants with altered alkaloid content
MLSIPDTRMWNLASSYLTGNIGPKNDIRRPVHAHAECSDDDVSSVGSKDEGLECPICWESFNIVENVPYVLWCGHTMCKNCILGLQWAIVKLPTHPVQLPLFISCPWCNLLSFRLVFRGTLRFPHKNYFVLWMVERMNGERRNSPGGAQTDGNNDHTRETPSPCLHNRHHRSQPEPSRSVNDHRIPRDNIQTSLRKSLVFFVQLTAKFPLVVIFLLIILYAIPTSAAILAMYILVTLLLALPSFLILYFAYPCLDWLVREIVT

SEQ ID NO: 12878 - protein, 114 aa, Arabidopsis thaliana
  misc_feature: Ceres CLONE ID no. 1006934
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MCGIFAYLNFHANKERRYILDVLFNGLRRLEYRGYDSAGIAIDNSSPSSSPLVFRQAGNIESLVNSVNEEITNTDLNLDEVFYFHAGIAHTRWATHGEPAPRNSHPQSSGPGDD

SEQ ID NO: 12879 - protein, 147 aa, Arabidopsis thaliana
  misc_feature: Ceres CLONE ID no. 1007869
  misc_feature: Useful for making plants with altered alkaloid content
  misc_feature (94)..(94): Xaa is any aa, unknown, or other
MEEKPKKAIPVTETAVKAKHYRGVRQRPWGKFAAEIRDPAKNGARVWLGTFETAEDAALAYDIAAFRMRGSRALLNFPLRVNSGEPDPVRITSXRSSSSSSSSSSSTSSSENGKLKRRRKAENLTSEVVQVKCEVGDETRVDELLVS

SEQ ID NO: 12880 - protein, 283 aa, Arabidopsis thaliana
  misc_feature: Ceres CLONE ID no. 1014844
  misc_feature: The plant is abnormally small.
  misc_feature: Useful for making plants with altered Lignin content
  misc_feature: Useful for making plants with modulated biomass
MMMGKEDLGLSLSLGFSQNHNPHQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 12881 - protein, 464 aa, Arabidopsis thaliana
  misc_feature: Ceres CLONE ID no. 101686
  misc_feature: Useful for making plants with modulated nitrogen use efficiency
MSRLLQTPFLPSVSLPTKTRSSVTGFRVKPRIIPIQAKIREIFMPALSSTMTEGKIVSWVKSEGDKLNKGESVVVVESDKADMDVETFYDGYLAAIMVEEGGVAPVGSAIALLAETEDEIADAKAKASGGGGDSKAPPPASPPTATVVAPVAVEKKIAAPPVAIKAVAASAVHPASEGGKRIVASPYAKKLAKELNVELAGLVGSGPMGRIVAKDVEAVAAGGGVQAAVAVKEVVAVPGVELGSVVPFTTMQGAVSRNMVESLAVPTFRVGYTISTDALDALYKKIKSKGVTMTALLAKATALALAKHPVVNSSCRDGNSFVYNSSINVAVAVAIDGGLITPVLQNADKVDIYSLSRKWKELVDKARAKQLQPQEYNTGTFTLSNLGMFGVDRFDAILPPGTGAIMAVGASQPSVVATKDGRIGMKNQMQVNVTADHRVIYGADLAQFLQTLASIIEDPKDLTF

SEQ ID NO: 12882 - protein, 149 aa, Arabidopsis thaliana
  misc_feature: Ceres CLONE ID no. 1030019
  misc_feature: Useful for making plants with modulated nitrogen use efficiency
MSLQRPNGNSSSSSSHKKHKTEESDEELLMVPDMEAAGSTCVLSSSADDGVNNPELDQTQNGVSTAKRRRGRNPVDKEYRSLKRLLRNRVSAQQARERKKVYVSDLESRANELQNNNDQLEEKISTLTNENTMLRKMLINTRPKTDDNH

SEQ ID NO: 12883 - protein, 130 aa, Arabidopsis thaliana
  misc_feature: Ceres CLONE ID no. 10525
  misc_feature: Useful for making plants with modulated nitrogen use efficiency
MAFDLHHGSASDTHSSELPSFSLPPYPQMIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTGSA

SEQ ID NO: 12884 - protein, 461 aa, Arabidopsis thaliana
  misc_feature: Ceres CLONE ID no. 106263
  misc_feature: Useful for making plants with modulated oxidative stress sensitivity
  misc_feature (88)..(88): Xaa is any aa, unknown, or other
  misc_feature (180)..(180): Xaa is any aa, unknown, or other
  misc_feature (243)..(243): Xaa is any aa, unknown, or other
  misc_feature (370)..(370): Xaa is any aa, unknown, or other
  misc_feature (377)..(377): Xaa is any aa, unknown, or other
MGKKAKWFSSVKKAFSPDSKKSKQKLAEGQNGVISNPPVVDNVRQSSSSPPPALAPREVRVAEVIVERNRDLSPPSTADAVNVTATDXPVVPSSSAPGVVRRATPTRFAGKSNEEAAAILIQTIFRGYLARRALRAMRGLVRLKLLMEGSVVKRQAANTLKCMQTLSRVQSQIRARRIRXSEENQARQKQLLQKHAKELAGLKNGDNWNDSIQSKEKVEANLLSKYEATMRRERALAYSYSHXQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHXIAGSSVXDDESLAGSPALPSYMVPTKSARARLKPQSPLGGTTQENEGFTDKASAKKRLSYPTSPALPKPRRFSAPPKVESGGVTVTNGAGS

SEQ ID NO: 12885 - protein, 291 aa, Arabidopsis thaliana
  misc_feature: Ceres CLONE ID no. 106887
  misc_feature: Useful for making plants with altered Lignin content
MQEAALGMMGASVGGDGDAAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESEKSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 12886 - protein, 309 aa, Arabidopsis thaliana
  misc_feature: Ceres CLONE ID no. 107973
  misc_feature: Useful for making plants with modulated salt sensitivity
  misc_feature: Useful for making plants with modulated nitrogen use efficiency
MTTPPVLSLALPSDTGRVLSIQSHTVQGYVGNKSAVFPLQLLGYDVDPINSVQFSNHTGYPTFKGQVLNGQQLCDLIEGLEANDLLFYTHVLTGYIGSVSFLDTILEVINKLRSVNPNLTYVCDPVMGDEGKLYVPEELVHVYREKVVPLASMLTPNQFEAEKLTGLRINSEEDGREACAILHAAGPSKVVITSITIGGILLLIGSHQKEKGLKPEQFKILIHKIPAYFTGTGDLMTALLLGWSNKYPDNLDKAAELAVSTLQALLRRTLDDYKRAGYDPTSSSLEIRLIQSQEDIRNPKVELKAERYS

SEQ ID NO: 12887 - protein, 356 aa, Arabidopsis thaliana
  misc_feature: Ceres CLONE ID no. 108056
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature (8)..(8): Xaa is any aa, unknown, or other
  misc_feature (209)..(209): Xaa is any aa, unknown, or other
  misc_feature (213)..(213): Xaa is any aa, unknown, or other
  misc_feature (214)..(214): Xaa is any aa, unknown, or other
  misc_feature (225)..(225): Xaa is any aa, unknown, or other
  misc_feature (228)..(228): Xaa is any aa, unknown, or other
  misc_feature (229)..(229): Xaa is any aa, unknown, or other
  misc_feature (243)..(243): Xaa is any aa, unknown, or other
  misc_feature (244)..(244): Xaa is any aa, unknown, or other
  misc_feature (245)..(245): Xaa is any aa, unknown, or other
  misc_feature (253)..(253): Xaa is any aa, unknown, or other
  misc_feature (259)..(259): Xaa is any aa, unknown, or other
  misc_feature (262)..(262): Xaa is any aa, unknown, or other
  misc_feature (273)..(273): Xaa is any aa, unknown, or other
  misc_feature (280)..(280): Xaa is any aa, unknown, or other
  misc_feature (284)..(284): Xaa is any aa, unknown, or other
  misc_feature (293)..(293): Xaa is any aa, unknown, or other
  misc_feature (302)..(302): Xaa is any aa, unknown, or other
  misc_feature (311)..(311): Xaa is any aa, unknown, or other
  misc_feature (318)..(318): Xaa is any aa, unknown, or other
  misc_feature (322)..(322): Xaa is any aa, unknown, or other
  misc_feature (328)..(328): Xaa is any aa, unknown, or other
  misc_feature (333)..(333): Xaa is any aa, unknown, or other
  misc_feature (336)..(336): Xaa is any aa, unknown, or other
  misc_feature (343)..(343): Xaa is any aa, unknown, or other
  misc_feature (352)..(352): Xaa is any aa, unknown, or other
MSIVAKLXLNKGMSPHVLVAYRMAVASALITPFALILERNTRPKLTFKILLQIAILSLFEPVVEQNLYYSGMKLTTATFTSALCNALPAMTFIMACVFKLEKVTIERRHSQAKLVGTMVAIGGAMLMTFVKGNVIELPWTSNSRGLNGHTHAMRIPKQADIARGSIMLVASCFSWSCYIILQAKILAQYKAELSLTALMCIMGMLEATXMGLXXERKNMSVWKIXPDXXLLASIYGGLVSGLXXXVIGWASKXRGPVFXSAXNPLSMVLVAIXSTFVFLXKVYXGRVIGSVVXVIGIYLVLXGKSKDKGGXLQPNAGXAETXVKIDQXKVPTXDNXQVVSISXHLMIPKAAXRSQE

SEQ ID NO: 12888 - protein, 193 aa, Arabidopsis thaliana
  misc_feature: Ceres CLONE ID no. 108362
  misc_feature: Useful for making plants with altered Lignin content
  misc_feature: Useful for making plants with altered cell wall content and/or composition
MTAALSTALFNDGASCGECYRITCDHAADSRWCLKGASVVITATNFCPPNFALPNNNGGWCNPPLKHFDMAQPAWEKIGIYRGGIVPVVFQRVSCYKKGGVRFRINGRDYFELVNIQNVGGAGSIKSVSIKGSKTGWLAMSRNWGANWQSNAYLDGQALSFSITTTDGATRVFLNVVPSSWSFGQIYSSNVQF

SEQ ID NO: 12889 - protein, 593 aa, Arabidopsis thaliana
  misc_feature: Ceres CLONE ID no. 109490
  misc_feature: Useful for making plants with altered Lignin content
  misc_feature: Useful for making plants with altered alkaloid content
MVEQTVVREHIKARVMSLVRSAEPSSYRNPKLYTLNENGNNNGVSSAQIFDPDRSKNPCLTDDSYPSQSYEKYFLDSPTDEFVQHPIGSGASVSSFGSLDSFPYQSRPVLGCSMEFQLPLDSTSTSSTRLLGDYQAVSYSPSMDVVEEFDDEQMRSKIQELERALLGDEDDKMVGIDNLMEIDSEWSYQNESEQHQDSPKESSSADSNSHVSSKEVVSQATPKQILISCARALSEGKLEEALSMVNELRQIVSIQGDPSQRIAAYMVEGLAARMAASGKFIYRALKCKEPPSDERLAAMQVLFEVCPCFKFGFLAANGAILEAIKGEEEVHIIDFDINQGNQYMTLIRSIAELPGKRPRLRLTGIDDPESVQRSIGGLRIIGLRLEQLAEDNGVSFKFKAMPSKTSIVSPSTLGCKPGETLIVNFAFQLHHMPDESVTTVNQRDELLHMVKSLNPKLVTVVEQDVNTNTSPFFPRFIEAYEYYSAVFESLDMTLPRESQERMNVERQCLARDIVNIVACEGEERIERYEAAGKWRARMMMAGFNPKPMSAKVTNNIQNLIKQQYCNKYKLKEEMGELHFCWEEKSLIVASAWR

SEQ ID NO: 12890 - protein, 270 aa, Arabidopsis thaliana
  misc_feature: Ceres CLONE ID no. 110428
  misc_feature: Useful for making plants with altered Lignin content
MGDTAEDQDDRAMMEAEGVTSFSELLMFSDGVLSSSSDHQPEGNVGDGGEDSLGFVFSGKTGSRMLCFSGGYQNDDESLFLEPSVPTSGVSDLDPSCIKIDCRNSNDACTVDKSTKSSTKKRTGTGNGQESDQNRKPGKKGKRNQDKSSVGIAKVRKERLGERIAALQQLVSPYGKTDAASVLHEAMGYIKFLQDQIQVLCSPYLINHSLDGGVVTGDVMAAMKAKDLRSRGLCLVPVSSTVHVENSNGADFWSPATMGHTTSPSLPQGF

SEQ ID NO: 12891 - protein, 304 aa, Brassica napus
  misc_feature: Ceres CLONE ID no. 1105554
  misc_feature: Abnormal phyllotaxy, leaf number higher than wild-type
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MMTNLSLAREGEAEAKKPIEKVEREHMFDKVVTPSDVGKLNRLVIPKQHAERYFPLDSSSNGKGLLLNFEDLTGKSWRFRYSYWNSSQSYVMTKGWSRFVKDKKLDAGDIVSFQRCVGDSRLFIDWRRRPKVPDYPTSTAHFAGGVMFPRFYSFPTATTSTCYDLYNHQPPRHHHIGYGYPQIPREFGYGYFVRSVDQRSVVADPLVIESVPVMMRGGARVSQEVVGTAGKRLRLFGVDMECGESGVTNSTEEESSSSGGSLPRAGGGGASSSSSLFQLRLGSSCEDDHFSKKGKSSLPFDLDQ

SEQ ID NO: 12892 - protein, 259 aa, Arabidopsis thaliana
  misc_feature: Ceres CLONE ID no. 111598
  misc_feature: Useful for making plants with altered alkaloid content
MEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRRFDTHSKTNEQTVQEMLSLAAKYNKAVQEEDELSPEKLAIVNVGRQDAKKHLEEHVSNLMSSNIVQTLGTMLDTVVF

SEQ ID NO: 12893 - protein, 131 aa, Glycine max
  misc_feature: Ceres CLONE ID no. 1120124
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature (115)..(115): Xaa is any aa, unknown, or other
  misc_feature (116)..(116): Xaa is any aa, unknown, or other
MTSSNRSSSPTSSSSDQSDVTTTTSTHLSETSPRNNKRKRSKDSSSSSSSSSSKLKHPVYRGVRMRSWGKWVSEIRQPRKKTRIWLGTFATADMAARAHDVAALAIKGSSAVINXXGACLYPPSSGVILAA

SEQ ID NO: 12894 - protein, 246 aa, Arabidopsis thaliana
  misc_feature: Ceres CLONE ID no. 112194
  misc_feature: Useful for making plants with altered Lignin content
  misc_feature (98)..(98): Xaa is any aa, unknown, or other
MKIQCNVCEAAEATVLCCADEAALCWACDEKIHAANKLAGKHQRVPLSASASSIPKCDICQEASGFFFCLQDRALLCRKCDVAIHTVNPHVSAHQRFXLTGIKVGLESIDTGPSTKSSPTNDDKTMETKPFVQSIPEPQKMAFDHHHHQQQQEQQEGVIPGTKVNDQTSTKLPLVSSGSTTGSIPQWQIEEIFGLTDFDQSYEYMENNGSSKADTSRRGDSDSSSMMRSAEEDGEDNNNCLGGETS

SEQ ID NO: 12895 - protein, 211 aa, Brassica napus
  misc_feature: Ceres CLONE ID no. 1124135
  misc_feature: The plant flowers significantly late compared to wild-type.
  misc_feature: Useful for making plants with modulated biomass
  misc_feature: Useful for making plants with modulated flowering time
MNTTSSKSKKKQEEGSARFLGVRRRPWGRYAAEIRDPTTKERHWLGTFDTAEEAALAYDRAARSMRGTRARTNFVYSDMPPSSSVTSIISPDDPPPPPPPTAAAPPCSNDPVDYMVMFNQYSSTDSLMLQPHSDQVESSYMFGGSSSCYSNSSSELPPLPSDLSNSSYSQPQWSVDDYSTATYFEGDYVHGPMFSTMPPVSDSFSHFGSYN

SEQ ID NO: 12896 - protein, 121 aa, Arabidopsis thaliana
  misc_feature: Ceres CLONE ID no. 112423
  misc_feature: The plant is abnormally small.
  misc_feature: Useful for making plants with modulated biomass
  misc_feature: Useful for making plants with modulated nitrogen use efficiency
MAASASSLALSSFNPKSLPFGVSRPASVSLLSPSLSFKLNSDSVSFSIAAKWNSPASRFARNVAITSEFEVEEDGFADVAPPKEQSFSADLKLFVGNLPFNVDSAQLAQLFESAGEFHLAA

SEQ ID NO: 12897 - protein, 147 aa, Arabidopsis thaliana
  misc_feature: Ceres CLONE ID no. 11357
  misc_feature: Useful for making plants with modulated nitrogen use efficiency
MVGLSIVLEMTNNNNNNNNNNNNKNPLSEGVLISPKVVNKANIIVTTAVTTDTTNLRRCYQDSGFLEHCFLCRRKLLPAKDIYMYKGDRAFCSVECRSKQMIMDEEESLRREYCSLMDVKKKKFDSPATAPSRYRRDPRNQAGGFAY

SEQ ID NO: 12898 - protein, 359 aa, Arabidopsis thaliana
  misc_feature: Ceres CLONE ID no. 113719
  misc_feature: The plant is abnormally small.
  misc_feature: Useful for making plants with modulated biomass
MGIGKYVTSDTFMVGGYSWAIYFYPDGKSPEDNSVYVSLFIALASEGADVRALFELTLVDQSGNERHKVHSHFGRTLESGPYTLKYRGSMWGYKRFFKRSLLESSDYLKDNGLLVRCCVGVVKSRTEGPRCYNIPVPVSGLGQQFGKLLESGKGADVTFEVDGETFPAHKLVLAARSAVFRAQLFGPLRSENTNCIIIEDVQAPIFKMLLHFIYWDEMPDMQDLIGTDLKWASTLVAQHLLAAADRYALERLRTICESKLCEGISINTVATTLALAEQHHCFQLKATCLKFIALPENLKAVMETDGFDYLKESCPSLLSELLEYVARLSEHSLTSSGHRKELFADGCDLNGRRVKQRLH

SEQ ID NO: 12899 - protein, 172 aa, Arabidopsis thaliana
  misc_feature: Ceres CLONE ID no. 114074
  misc_feature: Useful for making plants with altered Lignin content
  misc_feature: Useful for making plants with altered alkaloid content
MMMLESRNSMRASNSVPDLSLQISLPNYHAGKPLHGGDRSSTSSDSGSSLSDLSHENNFFNKPLLSLGFDHHHQRRSNMFQPQIYGRDFKRSSSSMVGLKRSIRAPRMRWTSTLHAHFVHAVQLLGGHERATPKSVLELMNVKDLTLAHVKSHLQMYRTVKCTDKGSQEKER

SEQ ID NO: 12900 - protein, 433 aa, Arabidopsis thaliana
  misc_feature: Ceres CLONE ID no. 114130
  misc_feature: Useful for making plants with altered Lignin content
  misc_feature: Useful for making plants with altered cell wall content and/or composition
MKINIRDSTMVRPATETPITNLWNSNVDLVIPRFHTPSVYFYRPTGASNFFDPQVMKEALSKALVPFYPMAGRLKRDDDGRIEIDCNGAGVLFVVADTPSVIDDFGDFAPTLNLRQLIPEVDHSTGIHSFPLLVLQVTFFKCGGASLGVGMQHHAADGFSGLHFINTWSDMARGLDLTIPPFIDRTLLRARDPPQPAFHHVEYQPAPSMKIPLDPSKSGPENTTVSIFKLTRDQLVALKAKSKEDGNTVSYSSYEMLAGHVWRSVGKARGLPNDQETKLYIATDGRSRLRPQLPPGYFGNVIFTATPLAVAGDLLSKPTWYAAGQIHDFLVRMDDNYLRSALDYLEMQPDLSALVRGAHTYKCPNLGITSWVRLPIYDADFGWGRPIFMGPGGIPYEGLSFVLPSPTNDGSLSVAIALQSEHMKLFEKFLFEI

SEQ ID NO: 12901 - protein, 427 aa, Arabidopsis thaliana
  misc_feature: Ceres CLONE ID no. 115366
  misc_feature: Useful for making plants with altered Lignin content
MQNPRLKQHQQQQQQQAMMQQQALMQQHSLYHPGVLAPPQLEPVPSGNLPPGFDPSTCRSVYVGNIHTQVTEPLLQEIFTSTGPVESSKLIRKDKSSYGFVHYFDRRSAALAILSLNGRHLFGQPIKVNWAYATGQREDTSSHFNIFVGDLSPEVTDATLYQSFSVFSSCSDARVMWDQKTGRSRGFGFVSFRNQQDAQTAINEMNGKWLSSRQIRCNWATKGATSGDDKLSSDGKSVVELTTGSSEDGKETLNEETPENNSQFTTVYVGNLAPEVTQLDLHRYFHALGAGVIEEVRVQRDKGFGFVRYNTHPEAALAIQMGNTQPYLFNRQIKCSWGNKPTPPGTASNPLPPPAPAPVPGLSAADLLNYERQLALSKMASVNALMHPQGQHPLRQAHGINAAGATAAMYDGGFQNVAAAQQLMYYQ

SEQ ID NO: 12902 - protein, 286 aa, Arabidopsis thaliana
  misc_feature: Ceres CLONE ID no. 115924
  misc_feature: Useful for making plants with altered Lignin content
  misc_feature: Useful for making plants with altered terpenoid content
MEADNGGPNSSHASKQRLRWTHELHERFVDAVAQLGGPDRATPKGVLRVMGVQGLTIYHVKSHLQKYRLAKYLPDSSSEGKKTDKKESGDMLSGLDGSSGMQITEALKLQMEVQKRLHEQLEVQRQLQLRIEAQGKYLKKIIEEQQRLSGVLGEPSAPVTGDSDPATPAPTSESPLQDKSGKDCGPDKSLSVDESLSSYREPLTPDSGCNIGSPDESTGEERLSKKPRLVRGAAGYTPDIVVGHPILESGLNTSYHQSDHVLAFDQPSTSLLGAEEQLDKVSGDNL

SEQ ID NO: 12903 - protein, 612 aa, Arabidopsis thaliana
  misc_feature: Ceres CLONE ID no. 115946
  misc_feature: Useful for making plants with altered alkaloid content
QGYCKVKAGSEQREAAAAVMDSSANINKALTETRFSDLEPPLSGDIIEALNQSDFEFCTPVQAATIPLLCSYKDVAVDAATGSGKTLAFVVPLVEILRRSTSFPPKPHQVMGVIISPTRELSTQIYNVAQPFVSTLANVNSVLLVGGREVKADMKIIEEEGCNVLIGTPGRLSDIMERMEILDFRNLEILILDEADRLLEMGFQRQVNYIISRLPKQRRTGLFSATQTEGVEELAKAGLRNPVRVEVRAKSKSESSQQLTNSKTPSGLHLEYMECEADKKSSQLVDLLIKNSDKKLIVFFMTCASVDYWGLVLSKIPALKSISLIPIHGDMKQNARDKALASFTKASSGALLCTDVAARGLDIPGIDYVVQYDPPQDPNMFNHRAGRTARLGRQGRAIVFLLPKEEAYVEFMRIRRVPLEERKCSEDASDVIPIIRSAAMKDRAVMEKGLKAFVSFVRAYKEHHCSFIFRWKDLEIGKLAMGYGLLYLPSMSEVKQHRLSSEGFTPVEGVKFEEIKFKDKYREKQRQQNLQVRKEKRQEEKKEKGKRKRVDASASNDPKKASRKLTGKQRQTIQTAEDEEVMDRDYKLMIKVKKGLIKEDEYERLTGDDDLF

SEQ ID NO: 12904 - protein, 449 aa, Arabidopsis thaliana
  misc_feature: Ceres CLONE ID no. 116381
  misc_feature: Useful for making plants with modulated oxidative stress sensitivity
MYIKAIMNRHRLLSAATDECNKKLGQACSSSLSPVHNFLNVQPEHRKTPFIRSQSPDSPGQLWPKNSSQSTFSRSSTFCTNLYLSSSSTSETQKHLGNSLPFLPDPSSYTHSASGVESARSPSIFTEDLGNQCDGGNSGSLLKDFLNLSGDACSDGDFHDFGCSNDSYCLSDQMELQFLSDELELAITDRAETPRLDEIYETPLASNPVTRLSPSQSCVPGAMSVDVVSSHPSPGSAANQKSRMRWTPELHESFVKAVIKLEGPEKATPKAVKKLMNVEGLTIYHVKSHLQKYRLAKYMPEKKEEKRTDNSEEKKLALSKSEADEKKKGAIQLTEALRMQMEVQKQLHEQQEVQRVLQLRIEEHAKYLEKMLEEQRKTGRWISSSSQTVLSPSDDSIPDSQNMSKTKASSPQPPLPAENKASETEDDKCESPQKRRRLENIAESEDPKR

SEQ ID NO: 12905 - protein, 300 aa, Arabidopsis thaliana
  misc_feature: Ceres CLONE ID no. 118001
  misc_feature: Useful for making plants with altered Lignin content
MNFTGLNHSVPDFLPAPENSSGSCGLSPLFSNRAKVLKPLQVMASSGSQPTLFQKRAAMRQSSTSKSESSSEMRKSSYEREIDDTSTGIIDISGLNYESDDHNTNNNKGKKKGMPAKNLMAERRRRKKLNDRLYMLRSVVPKISKMDRASILGDAIDYLKELLQRINDLHTELESTPPSSSSLHPLTPTPQTLSYRVKEELCPSSSLPSPKGQQPRVEVRLREGKAVNIHMFCGRRPGLLLSTMRALDNLGLDVQQAVISCFNGFALDVFRAEQCQEDHDVLPEQIKAVLLDTAGYAGLV

SEQ ID NO: 12906 - protein, 298 aa, Arabidopsis thaliana
  misc_feature: Ceres CLONE ID no. 11854
  misc_feature: The plant flowers significantly late compared to wild-type.
  misc_feature: Useful for making plants with modulated flowering time
MSDVTGDLAAVSEAKGGSDAARISEVKAWLTSQFEAVGKEVPNFEYTHRSITHLYNLATASQAKSQAATIVANDFRLKASEYRAQAARIREILESAGMSQESLPSNVVSSAQVLANVANLLNIRDTELSSFLVAMGDISLRKTGVEEKRAKAQKESNALLDYTRKAIQRLTYLKKILAQLEDDVVPCESQMENWKTNLEVMAVKEEQYIQQYKKYEMLLNRVGYTPKISHRELVEMAEHRKELDKMTKPVLDTLRSYQDLPPDKALAALAIEDKKRQFTAAEKYLEEVLQSALETNDE

SEQ ID NO: 12907 - protein, 265 aa, Arabidopsis thaliana
  misc_feature: Ceres CLONE ID no. 118756
  misc_feature: Useful for making plants with altered Lignin content
MSNHHTVVYVNGLVRPVLAEAEYSMRTESPADNAIDIYDGDTTENEEEDPLISSAECRICQDECDIKNLESPCACNGSLKYAHRKCVQRWCNEKGNTICEICHQPYQAGYTSPPPPPQSEETTIDIGGGWRISGLDLDDPRLLAIAEAERQILESEYDDYTASDTSGAAFFRSAALILMTLLLLRHALTIPDYSDSEDDDPSSILSLFLLRAASFLLPCYIMASAISILHRRRQRQEAADLATRFALVLSSRQPRPVINYLSMEP

SEQ ID NO: 12908 - protein, 295 aa, Arabidopsis thaliana
  misc_feature: Ceres CLONE ID no. 119104
  misc_feature: Useful for making plants with altered terpenoid content
MDDLHGRNGRMHIGVAQNPMHVQYEDHGLHHIDNENGMMDDHADGGMDEGVETDIPSHPGNSADNRGEVVDRGIENGDQLTLSFQGQVYVFDRVSPEKVQAVLLLLGGREVPHTLPTTLGSPHQNNRGLSGTPQRLSVPQRLASLLRFREKRKGRNFDKTIRYTVRKEVALRMQRKKGQFTSAKSSNDDSGSTGSDWGSNQSWAVEGTETQKPEVLCRHCGTSEKSTPMMRRGPDGPRTLCNACGLMWANKGTLRDLSKVPPPQTPQHLSVNKNEDANLEADQMMEVTGDISNTQ

SEQ ID NO: 12909 - protein, 236 aa, Arabidopsis thaliana
  misc_feature: Ceres CLONE ID no. 119300
  misc_feature: Useful for making plants with modulated nitrogen use efficiency
MASSRFQSGFCPISSCPSLENFIERIKDACRFTLSAVLGTILSAVLTFFFALVGTLLGALTGALIGQETESGFIRGAAVGAISGAVFSIEVFESSLVLWKSNESRFGCLLYLIDVIVSLISGRLVRERIGPAMLSAVQSQMGAVDSTFEELSSIFDTGGSKGLTGDLVDKIPKIKITGKNNLDASGNKDSCSVCLQDFQLGETVRSLPHCHHMFHLPCIDNWLFRHGSCPMCRRDL

SEQ ID NO: 12910 - protein, 141 aa, Arabidopsis thaliana
  misc_feature: Ceres CLONE ID no. 11938
  misc_feature: Useful for making plants with altered alkaloid content
MKGAKSKAETRSTKLSVTKKPAKGAKGAAKDPNKPKRPSSAFFVFMEDFRVTYKEEHPKNKSVAAVGKAGGEKWKSLSDSEKAPYVAKADKRKVEYEKNMKAYNKKLEEGPKEDEESDKSVSEVNDEDDAEDGSEEEEDDD

SEQ ID NO: 12911 - protein, 234 aa, Arabidopsis thaliana
  misc_feature: Ceres CLONE ID no. 11975
  misc_feature: The plant is abnormally small.
  misc_feature: Useful for making plants with modulated biomass
MGEKQEVKLLGVWYSPYAIRTKIALRLKSVDYDYVEEDLFGSKSELLLKSNPVHKKVPVLLHYNKPIVESLNIVEYIDETWNSSAPSILPSHPYDRALARFWSDFVDNKWFPALRVAAIAKSEDAKAKAMEEVEEGLLQLEDAFVSISKGKPFFGGEVIGFMDICFGSFVVLLKAREKFKAEKLLDESKTPSLCKWADRFLSDETVKNVAPDIEKVAEFLQELEVRAQSAASRS

SEQ ID NO: 12912 - protein, 92 aa, Arabidopsis thaliana
  misc_feature: Ceres CLONE ID no. 119790
  misc_feature: Useful for making plants with altered Lignin content
  misc_feature: Useful for making plants with modulated nitrogen use efficiency
MMEWDNQLQPNNHHSSNLQGIDVNGGSGAGGGMYVKVMTDEQYETLRKQIAIYGTICERLVEMHKTLTAQQDLAGGRMGGLYADPNDVIFRS

SEQ ID NO: 12913 - protein, 358 aa, Arabidopsis thaliana
  misc_feature: Ceres CLONE ID no. 119910
  misc_feature: Useful for making plants with modulated oxidative stress sensitivity
MAMAIAMLPALFSSPSILTSRIRCGATANSGGAISSTSSNSDPRRGVPLYKPKSYEVLATDAANSLAFALQDSKSRLEIDFPPLPSSISSYKGSSDDFIDANIQLAVTVVRKLQEKIETRACIVFPDKPEKRRASQRFKAAFDSVDGISIGSLDDIPGTSVTNFFRSIRSTLDFDFENENEGTWEPKEPPTLYIFINCSTRELSFIEKFVETFASSTPALLFNLELDTLRADLGLLGFPPKDLHYRFLSQFIPVFYIRTREYSKTVAVAPFVLNYNGALFRQYPGPWQVMLKQTDGSFACVAESPTRFTLGETKEELLQVLGLQEEKGSSLEFLRRGYKSATWWEEDVELEASSNWRN

SEQ ID NO: 12914 - protein, 481 aa, Arabidopsis thaliana
  misc_feature: Ceres CLONE ID no. 120310
  misc_feature: Useful for making plants with modulated nitrogen use efficiency
MSLKALDYESLNENVKNCQYAVRGELYLRASELQKECKKIIFTNVGNPHALGQKPLTFPRQVVSLCQAPFLLDDPNVGMIFPADAIARAKHYLSLTSGGLGAYSDSRGLPGVRKEVADFIERRDGYPSDPELIFLTDGASKGVMQILNCVIRGQKDGILVPVPQYPLYSATISLLGGTLVPYYLEESENWGLDVNNLRQSVAQARSQGITVRAMVIINPGNPTGQCLSEANIREILRFCCDERLVLLGDEVYQQNIYQDERPFISSKKVLMDMGAPISKEVQLISFHTVSKGYWGECGQRGGYFEMTNIPPRTVEEIYKVASIALSPNVSAQIFMGLMVSPPKPGDISYDQFVRESKGILESLRRRARMMTDGFNSCKNVVCNFTEGAMYSFPQIKLPSKAIQAAKQAGKVPDVFYCLKLLEATGISTVPGSGFGQKEGVFHLRTTILPAEEEMPEIMDSFKKFNDEFMSQYADNFGYSRM

SEQ ID NO: 12915 - protein, 174 aa, Arabidopsis thaliana
  misc_feature: Ceres CLONE ID no. 12071
  misc_feature: Useful for making plants with altered Lignin content
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 12916 - protein, 229 aa, Arabidopsis thaliana
  misc_feature: Ceres CLONE ID no. 120947
  misc_feature: Useful for making plants with altered terpenoid content
MPSFAFGSHHHLANPTDSPPYSVEISIDGDSSDLDSLSQVDLESGGVPAPEKQLHSGGKKRRTRRRKRRKKKKKKKGGRDCRICHLPLETNKEAEDEDEEEEDDSDDDEDEEDEEEEEEEEEYYGLPLQLGCSCKGDLGVAHSKCAETWFKIKGNMTCEICGAMALNVAGEQSNPESTASTHSQAAAGQSLTQTEPRGIWHGRPVMNFLLAAMVFAFVVSWLFHFKVLK

SEQ ID NO: 12917 - protein, 114 aa, Arabidopsis thaliana
  misc_feature: Ceres CLONE ID no. 12256
  misc_feature: Useful for making plants with altered Lignin content
MSTMKFCRECNNILYPKEDKEQSILLYACRNCDHQEAADNNCVYRNEVHHSVSEQTQILSDVASDPTLPRTKAVRCAKCQHGEAVFFQATARGEEGMTLFFVCCNPNCSHRWRE

SEQ ID NO: 12918 - protein, 385 aa, Arabidopsis thaliana
  misc_feature: Ceres CLONE ID no. 12272
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
  misc_feature: Useful for making plants with modulated drought sensitivity
MVSDQDLAKGVETLLRQSDPSSLTSLSSIVQQLEAKLGLDLTEKTTFIRDQINILLRAHQNPSASVASASSVQQSHPPPPPSSHQQQNLHSGVNVPPMAKGHFTLSHPSQFSVSSQSQQYPSHFALQPPYHSYDLNFRQPYPVYMPPQQHQHQQQSPRQQQSSVMLSHGGNASLSVNQAPKESAPAGTKRKGGPGGLNKVCRVSPELEVVVGEPALPRTEIVRQLWAYIRKNNLQDPSNKRKIICDDALRVVFETDCTDMFKMNKLLAKHILPLDPSKDSGQAKKAKTEVETKTETTEPVSSTAISSTVTLSEPLGKFFGTGETEMADEEIIRRVWEYIKLNNLEDPVNPMAIQCDEKLRDLLGCESISAVGINEMLRRHMYKQS

SEQ ID NO: 12919 - protein, 244 aa, Arabidopsis thaliana
  misc_feature: Ceres CLONE ID no. 124720
  misc_feature: The plant produces a reduced number of seeds.
  misc_feature: Useful for biocontainment applications
  misc_feature: Useful for making plants with altered Lignin content
  misc_feature: Useful for making plants with altered cell wall content and/or composition
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEAAAASSSVAKPLHAIKRYPRTPPVAPEDCHSDCDSSSSVIDDGDDIASSSSRRKTPFQFDLNFPPLDGVDLFAGGIDDLHCTDLRL

SEQ ID NO: 12920 - protein, 358 aa, Arabidopsis thaliana
  misc_feature: Ceres CLONE ID no. 13024
  misc_feature: Useful for making plants with modulated phosphate use efficiency
MSSFTSKFADELIANAAYIGTPGKGILAADESTGTIGKRLASINVENVESNRRALRELLFTTPGALPCLSGVILFEETLYQKSSDGTPFVDMLKSAGVLPGIKVDKGTVELAGTNGETTTQGLDGLGDRCKKYYEAGARFAKWRAVLKIGVNEPSQLAIHENAYGLARYAVICQENGLVPIVEPEILVDGSHDIQKCAAVTERVLAACYKALSDHHVLLEGTLLKPNMVTPGSESAKVAPEVIAEHTVRALQRTVPAAVPAIVFLSGGQSEEEATRNLNAMNQLKTKKPWSLSFSFGRALQQSTLKTWGGKEENVKKAQEAFLVRCKANSEATLGAYKGDAKLGEGAAESLHVKDYKY

SEQ ID NO: 12921 - protein, 173 aa, Arabidopsis thaliana
  misc_feature: Ceres CLONE ID no. 13092
  misc_feature: The plant flowers significantly late compared to wild-type.
  misc_feature: Useful for making plants with modulated flowering time
MGASSSSSVSEKSIHQFTVKDSSGKEVDLSVYQGKVLLVVNVASKCGFTESNYTQLTELYRKYKDQGFVVLAFPCNQFLSQEPGTSEEAHQFACTRFKAEYPVFQKVRVNGQNAAPVYKFLKSKKPSFLGSRIKWNFTKFLVGKDGQVIDRYGTTVSPLSIQKDIEKALAQEL

SEQ ID NO: 12922 - protein, 199 aa, Arabidopsis thaliana
  misc_feature: Ceres CLONE ID no. 13186
  misc_feature: Abnormal phyllotaxy, leaf number higher than wild-type
  misc_feature: The plant is abnormally small.
  misc_feature: Useful for making plants with modulated biomass
  misc_feature (147)..(147): Xaa is any aa, unknown, or other
  misc_feature (148)..(148): Xaa is any aa, unknown, or other
MASSSTNSPCAACKFLRRKCQPECVFAPYFPPDQPQKFANVHKVFGASNVTKLLNELHPSQREDAVNSLAYEADMRLRDPVYGCVGVISLLQHQLRQLQIDLSCAKSELSKYQSLGILAATHQSLGINLLAGAADGTATAVRDHYHXXQFFPREQMFGGLDVPAGNNYDGGILAIGQITQFQQPRAAAGDDGRRTVDPS

SEQ ID NO: 12923 - protein, 240 aa, Arabidopsis thaliana
  misc_feature: Ceres CLONE ID no. 13263
  misc_feature: The plant flowers significantly late compared to wild-type.
  misc_feature: The plant produces a reduced number of seeds.
  misc_feature: The plant senesces significantly late compared to wild-type.
  misc_feature: There is a problem with the ovules such that no fertilization is occurring
  misc_feature: Useful for biocontainment applications
  misc_feature: Useful for making plants with modulated biomass
  misc_feature: Useful for making plants with modulated flowering time
  misc_feature: Useful for making plants with modulated time to senescence
MSSMSMSSSSAPAFPPDHFSSTDQLCYVHCSFCDTVLAVSVPPSSLFKTVTVRCGHCSNLLSVTVSMRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 12924 - protein, 323 aa, Arabidopsis thaliana
  misc_feature: Ceres CLONE ID no. 1334
  misc_feature: Useful for making plants with modulated heat sensitivity
MESFPIINLEKLNGEERAITMEKIKDACENWGFFECVNHGISLELLDKVEKMTKEHYKKCMEERFKESIKNRGLDSLRSEVNDVDWESTFYLKHLPVSNISDVPDLDDDYRTLMKDFAGKIEKLSEELLDLLCENLGLEKGYLKKVFYGSKRPTFGTKVSNYPPCPNPDLVKGLRAHTDAGGIILLFQDDKVSGLQLLKDGEWVDVPPVKHSIVVNLGDQLEVITNGKYKSVEHRVLSQTDGEGRMSIASFYNPGSDSVIFPAPELIGKEAEKEKKENYPRFVFEDYMKLYSAVKFQAKEPRFEAMKAMETTVANNVGPLATA

SEQ ID NO: 12925 - protein, 77 aa, Arabidopsis thaliana
  misc_feature: Ceres CLONE ID no. 13391
  misc_feature: The plant produces a reduced number of seeds.
  misc_feature: Useful for biocontainment applications
MAEPKQSSLSEVKTNVIGSRKEEKESMFHGKETHGRSEDIDEKTRVDDVKGPGVLGRMMEEMEAIVDAVTPNKSSDK

SEQ ID NO: 12926 - protein, 190 aa, Arabidopsis thaliana
  misc_feature: Ceres CLONE ID no. 13620
  misc_feature: The plant is abnormally small.
  misc_feature: Useful for making plants with modulated biomass
MGDAIDLSGDGGVLKKIVRSAKPDAISPSDDLPVVDVHYEGILAEDEKVFDTTREDNLVFSFELGTGSVIRSWDIALKTMKVGEVAKITCKPEYAYGRAGSPPDIPPDATLIFEVELVACRPRKGASVGSVSEERARLEDLKKQREIAAAAKEDDKKKREEAKAAAAARIQAKLDAKKGPGKGKGKGKAK

SEQ ID NO: 12927 - protein, 339 aa, Arabidopsis thaliana
  misc_feature: Ceres CLONE ID no. 13767
  misc_feature: The plant is abnormally small.
  misc_feature: The plant produces a reduced number of seeds.
  misc_feature: Useful for biocontainment applications
  misc_feature: Useful for making plants with modulated biomass
MAIPLPLTSCSPISTSSSISRTSFVPLTLRNRTFFSNQNYSRRVLISCSSSLSSDNGSSPDSMNGNGNGNGSSLNGQSSFPRLPSFDGTSKPPLKWRRVLLKVSGEALAGDEEQNIDPKVTMAIAREVAAVTRLGIEVAIVVGGGNIFRGSTWAGCSGLDRSSADYIGMLATVMNAIFLQATMESIGIPTRVQTAFRMSEVAEPYIRRRAIRHLEKGRVVIFAAGTGNPFFTTDTAAALRCAEINAEVVLKATNVDGVFDDDPKRNPNARLLDSLTYQEITSKDLSVMDMTAITLCQENNIPVVVFNLSEPGNIAKAIKGERVGTLIGGTWNSIVTTTS

SEQ ID NO: 12928 - protein, 466 aa, Zea mays
  misc_feature: Ceres CLONE ID no. 1396695
  misc_feature: The plant senesces significantly late compared to wild-type.
  misc_feature: Useful for making plants with modulated time to senescence
MHSLVRRGNGYGYGYGGYGSSNPHMNYHRQNTESVTTVVTEMNRMAVDDKPCYGGGVQKQACKVEAFQEHDEAYKGAVAVQQKHSSFKEDKEEVRGAAAAVRSWHDELYKEEEEEKHVVDTEYGARYGGGAAAVKKPGYNYKQHEAYGETEGAGYGYGAGGVKKQAGYSYAQEASEESYGGAQSHHGGAGAAAQTYAYDQQQAYKHKDAAGAGYGARYGGGAVQQHDGHGYRPKDAYGYGAAAGGKVKKNGGTDAGGYGAHYGGGGGAVQQYGYGGATTDGKVKKGGYQYYGGSGAGGYDAHYGGGGGGAVQQYGGYHKDAYGYGGGATAGGKVKKSGYQNEEAYAGTGAGGYGAHYGGGPAVAQKQGYRQGIYESESESESESDESDCEEAFLPHGGVQHSYGYGGGAYMQEKHGAGNLGGVRRYESYESRDDLGGGRRYESSYQSTVQYTGSPTKNRHVLRYGA

SEQ ID NO: 12929 - protein, 159 aa, Arabidopsis thaliana
  misc_feature: Ceres CLONE ID no. 14084
  misc_feature: Useful for making plants with modulated cold sensitivity
MDNLEDLKIVAEQWSKQGLEFVQKIPPPQLYTAIGVLLLATIWLLSIRLFRRTKSNTVLLSGLSGSGKTVLFYQLRDGSSHQGAVTSMEPNEGTFVLHNENNTKKGKVKPVHLIDVPGHSRLISKLEEYLPRAAAVVFVVDALSSSQISGQLQSTFTTF

SEQ ID NO: 12930 - protein, 152 aa, Zea mays
  misc_feature: Ceres CLONE ID no. 1408950
  misc_feature: Useful for making plants with modulated nitrogen use efficiency
MTRHVILTSEERNSPPTTMIKHAERRKVGEVAGGAAAECAAVWCCGPCAVVNLVVLAVYRVPAAVCKKAWRQTKRQRFMRRRHGLLASAAAESTVHARLKEEDPTAEIVFEENVVNVELNDVVVLEDEMFERFYGAGFWRSPSQRDTSSGSI

SEQ ID NO: 12931 - protein, 253 aa, Arabidopsis thaliana
  misc_feature: Ceres CLONE ID no. 141806
  misc_feature: The plant flowers significantly late compared to wild-type.
  misc_feature: Useful for making plants with modulated flowering time
MQPETSDQMLYSFLAGNEVGGGGYCVSGDYMTTMQSLCGSSSSTSSYYPLAISGIGETMAQDRALAALRNHKEAERRRRERINSHLNKLRNVLSCNSKTDKATLLAKVVQRVRELKQQTLETSDSDQTLLPSETDEISVLHFGDYSNDGHIIFKASLCCEDRSDLLPDLMEILKSLNMKTLRAEMVTIGGRTRSVLVVAADKEMHGVESVHFLQNALKSLLERSSKSLMERSSGGGGGERSKRRRALDHIIMV

SEQ ID NO: 12932 - protein, 273 aa, Arabidopsis thaliana
  misc_feature: Ceres CLONE ID no. 141875
  misc_feature: Useful for making plants with altered terpenoid content
MWMATQSNSGFDSLSSMMSRHAINFQSNTSSEMTPMSPYLGMNMNMINVGSPGFLQTGNSSNGSDSGSGLKLDTSMVSEWSNEEQYILDAGLEKYKDMPSIDMYIQIGNTLPDKSIRDIALRCRWLRRKRRKSEELNCGRRASSSKGKQVESSSKSSIPSVLPHNMASYPFSGPSTSTSKQITSEDLSSYATNLIEQNVRAFSQIRANLSSYKAGDNLDLFRQARNNLITIQNEINNMPGLMNKMPPLPVTINDDLSVMMPFNTMQSGGFHRK

SEQ ID NO: 12933 - protein, 343 aa, Arabidopsis thaliana
  misc_feature: Ceres CLONE ID no. 141890
  misc_feature: The plant is abnormally small.
  misc_feature: Useful for making plants with modulated biomass
MNTRYSNQPELSSSNITITISSSALLSSSPRGDNSHVAAANGQERSPSSFYIRLAMKVSRARWFIFLRRVFHYQNGSRSDLGSNPFNSSTWMMSELIALLVQLTVITFTLAISKEERPIWPVRLWITGYDVGCLLNLMLLYGRYRQLDINQGNGFVLGDVEQQQRGREETRSSHLMNKCRTSLELFFAIWFVIGNVWVFDSRFGSFHHAPKLHVLCVSLLAWNAICYSFPFLLFLFLCCLVPLISSLLGYNMNMGSSDRAASDDQISSLPSWKFKRIDDSASDSDSDSATVTDDPECCICLAKYKDKEEVRKLPCSHKFHSKCVDQWLRIISCCPLCKQDLPR

SEQ ID NO: 12934 - protein, 163 aa, Arabidopsis thaliana
  misc_feature: Ceres CLONE ID no. 14203
  misc_feature: Useful for making plants with altered Lignin content
MAEEHRLQEPRLCANNCGFFGSTATQNLCSKCFRDLQHQEQNSSTAKHALTQSLAAVGAAASSSVSPPPPPPADSKEIVEAKSEKRAAAEPEEADGPPQDPKRCLTCRRRVGITGFRCRCGFVFCGTHRYAEQHECSFDFKRMGKDKIAKANPIVKADKLEKI

SEQ ID NO: 12935 - protein, 329 aa, Arabidopsis thaliana
  misc_feature: Ceres CLONE ID no. 14246
  misc_feature: Useful for making plants with altered Lignin content
  misc_feature: Useful for making plants with altered cell wall content and/or composition
  misc_feature: Useful for making plants with altered terpenoid content
MSSAYCSSAVAVSAAATASSAATFNPLLSSHSNSQLFYRFTPKSFKLVANCPNPLILHSNIRRHRFFCAAETEASSADDEIQASVEEEEEVEEEGDEGEEEVEEEKQTTQASGEEGRLYVGNLPYTITSSELSQIFGEAGTVVDVQIVYDKVTDRSRGFGFVTMGSIEEAKEAMQMFNSSQIGGRTVKVNFPEVPRGGENEVMRTKIRDNNRSYVDSPHKVYAGNLGWNLTSQGLKDAFGDQPGVLGAKVIYERNTGRSRGFGFISFESAENVQSALATMNGVEVEGRALRLNLASEREKPTVSPPSVEEGETEEASLESNEVLSNVSA

SEQ ID NO: 12936 - protein, 473 aa, Arabidopsis thaliana
  misc_feature: Ceres CLONE ID no. 142711
  misc_feature: Useful for making plants with modulated cold sensitivity
MIKLWMMTSLQLAELFVSSIVHLLYGFYIFSSAVAGDISQTLNDYLFKSNVAFGETGQNQTNVEGLPPIVLVHGIFGFGKGRLGGLSYFGGAEKKDERVLVPEGGSLTSIYDRARELFYYLKGGVVDFGEEHSEACGHSRFGRRYEQGQYPEWDEDHPIHFVGHSAGAQVVRVLQQMLADQAFEGFEETNENWVLSVTSLSGAFNGTTRTYLDGMRTDDGVSMKPICLLQLCRIGVIMYDWLDISWLKTYYNFGFDHFNISWKKTGVRGLVDCLMGNTGPFASGDWILPDLTIQGSTSINSNLQTFPNTYYFSYATKRTRRVMGMTIPSGVLGIHPMLFLRVFQMSQWKFPQDVSPPYKGYRDEDWQENDGALNTISMTHPRLPVEHPSRFIRSDSECQTLQPGIWYYKIVEADHIMFIVNRERAGVQFDLIYDSIFQRCRKHVFRKIPQTLPNQSPSSPRSSSSPRINNFVH

SEQ ID NO: 12937 - protein, 67 aa, Arabidopsis thaliana
  misc_feature: Ceres CLONE ID no. 14272
  misc_feature: Useful for making plants with modulated nitrogen use efficiency
MDKALTGISAAALTASMVIPEIAEAAGSGISPSLKNFLLSIASGGLVLTVIIGVVVGVSNFDPVKRT

SEQ ID NO: 12938 - protein, 81 aa, Arabidopsis thaliana
  misc_feature: Ceres CLONE ID no. 143475
  misc_feature: Useful for making plants with altered Lignin content
  misc_feature: Useful for making plants with modulated low light sensitivity
MASNSMSSSASWTRKENKLFERALATYDQDTPDRWHNVARAVGGKSAEEVRRHYELLIRDVNDIESGRYPHPNYRSNGNNH

SEQ ID NO: 12939 - protein, 258 aa, Arabidopsis thaliana
  misc_feature: Ceres CLONE ID no. 14365
  misc_feature: The plant is abnormally small.
  misc_feature: Useful for making plants with modulated biomass
MKIFHVPCLQDNYSYLIIDESTGDAAVVDPVDPEKVIASAEKHQAKIKFVLTTHHHWDHAGGNEKIKQLVPDIKVYGGSLDKVKGCTDAVDNGDKLTLGQDINILALHTPCHTKGHISYYVTGKEGENPAVFTGDTLFVAGCGKFFEGTAEQMYQSLCVTLAALPKPTQVYCGHEYTVKNLEFALTVEPNNGKIQQKLAWARQQRQADLPTIPSTLEEELETNPFMRVDKPEIQEKLGCKSPIDTMREVRNKKDQWRG

SEQ ID NO: 12940 - protein, 143 aa, Arabidopsis thaliana
  misc_feature: Ceres CLONE ID no. 14462
  misc_feature: Useful for making plants with modulated heat sensitivity
MAMTAAAVPSSGSFQKQDEEWRAVLSPEQFRVLRLKGTDKRGKGEFTKKFEEGTYSCAGCGTALYKSTTKFDSGCGWPAFFDAIPGAIKQTPEAGGRRMEITCAVCDGHLGHVFKGEGYSTPTDQRHCVNSVSLKFASADSSK

SEQ ID NO: 12941 - protein, 315 aa, Zea mays
  misc_feature: Ceres CLONE ID no. 1449250
  misc_feature: The plant is abnormally small.
  misc_feature: The plant produces a reduced number of seeds.
  misc_feature: Useful for biocontainment applications
  misc_feature: Useful for making plants with modulated biomass
MEGSRNSPDRQSSGGSPEERGSGGSGGRGAGEPVRSRWTPKPEQILILESIFNSGMVNPPKDETVRIRKLLERFGAVGDANVFYWFQNRRSRSRRRQRQMQAAAAAAATAAAASSAANSSPGASATVGLPSGALQYPLVMSGSGSACQYEQQASSSSSSGSTGGSSLGLFALGAGVPSTGGGFFQESCGASSPLATGLMMGDVDRSGGSDDLFAIFRQMGFAAATPVASASVTPPSTTAHHQQYYSCQSPTGTITVFINGVPMEVPSGPIDMRAIFGQDVLLVHSTGALLPVDDYGILTQSLQTGESYFLVARPT

SEQ ID NO: 12942 - protein, 254 aa, Arabidopsis thaliana
  misc_feature: Ceres CLONE ID no. 14570
  misc_feature: Useful for making plants with modulated nitrogen use efficiency
MVIINPNNPCGNVYTYDHLNKVAEMARKLGIMIISDEVYDHVVYGDKPFIPMGKFASIAPVITLGSISKGWVNPGWRVGWIAMNDPNGIFVSTGVVQAIEDFLDLTPQPSFILQEALPDILEKTPKEFFEKKIKAMRRNVELSCERLKDIPCLFCPKKPESCSYLWLKLDTSMLNNIKNDFDFCTKLVSEESLILIPGVALGAENWVRISIGTDESVVQEIFDRLKGFYDRHAISKEAIKLSGHAINQIVVSVN

SEQ ID NO: 12943 - protein, 318 aa, Arabidopsis thaliana
  misc_feature: Ceres CLONE ID no. 1461
  misc_feature: Useful for making plants with modulated nitrogen use efficiency
  misc_feature: Useful for making plants with modulated salt sensitivity
  misc_feature (39)..(39): Xaa is any aa, unknown, or other
MATVPLFTQFPCKTLNPSSSNTKHQSKSPILLPINSINXRSEIGVSVHRPDFKIRATDIDDEWGQDGVERVFASSSTVSVADKAIESVEETERLKRSLADSLYGTDRGLSVSSDTRAEISELITQLESKNPTPAPNEALFLLNGKWILAYTSFVGLFPLLSRRIEPLVKVDEISQTIDSDSFTVQNSVRFAGPFSTTSFSTNAKFEIRSPKRVQIKFEQGVIGTPQLTDSIEIPESVEVLGQKIDLNPIKGLLTSVQDTASSVARTISNQPPLKFSLPSDNTQSWLLTTYLDKDLRISRGDGGSVYVLIKEGSSLLNP

SEQ ID NO: 12944 - protein, 107 aa, Arabidopsis thaliana
  misc_feature: Ceres CLONE ID no. 1480
  misc_feature: Useful for making plants with altered Lignin content
MGRGKIEIKRIENANNRVVTFSKRRNGLVKKAKEITVLCDAKVALIIFASNGKMIDYCCPSMDLGAMLDQYQKLSGTNYGMLSMRTLAMRLIGSRKRMIAYNWSSGI

SEQ ID NO: 12945 - protein, 181 aa, Arabidopsis thaliana
  misc_feature: Ceres CLONE ID no. 14909
  misc_feature: Useful for making plants with altered Lignin content
  misc_feature: Useful for making plants with altered alkaloid content
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 12946 - protein, 202 aa, Arabidopsis thaliana
  misc_feature: Ceres CLONE ID no. 1492
  misc_feature: Useful for making plants with altered Lignin content
MNPEYDYLFKLLLIGDSGVGKSCLLLRFADDSYLDSYISTIGVDFKIRTVEQDGKTIKLQIWDTAGQERFRTITSSYYRGAHGIIVTYDVTDLESFNNVKQWLNEIDRYASENVNKLLVGNKNDLTSQKVVSTETAKAFADELGIPFLETSAKNATNVEEAFMAMTAAIKTRMASQPAGGAKPPTVQIRGQPVNQQSGCCSS

SEQ ID NO: 12947 - protein, 210 aa, Arabidopsis thaliana
  misc_feature: Ceres CLONE ID no. 149211
  misc_feature: Useful for making plants with altered alkaloid content
MGQMLKKFPKEELWEPPPKSRRSRSRSPRRSRSPRRSRSPPRRRSPRRSRSPRRRSRDDYREKDYRKQSRSRSYDRRERHEEKDRDHRRRTRSRSASPDEKRRVRGRYDNESRSHSRSLSASPARRSPRSSSPQKTSPAREVSPDKRSNERSPSPRRSLSPRSPALQKASPSKEMSPERRSNERSPSPGSPAPLRKVDAASRSQSPYAAE

SEQ ID NO: 12948 - protein, 304 aa, Arabidopsis thaliana
  misc_feature: Ceres CLONE ID no. 150912
  misc_feature: The plant is abnormally small.
  misc_feature: Useful for making plants with modulated biomass
MAPSSSSGLTFKLHPLVIVNISDHYTRVKTQLNPPASICASGHGSNNGEAMFQQNPRVYGCVIGVQRGRTVEIFNSFELLYDPSTQTLDRSFLEKKQELYKKVFPDFYILGWYSTGSDAEESDMHIHKALMDINESPVYVLLNPAINHTQKDLPVTIYESELHVIDGIPQLIFAHTSYTIETVEAERISVDHVAHLKPSDGGSAATQLAAHLTGIHSAIKMLNSRIRVLYQNLAAMQKGDKSCDNSVLRQVSSLLRRLPAMESERFQDNFYDGVQRQITNNLPSDDYKLFQQHERDGRQIQHRI

SEQ ID NO: 12949 - protein, 324 aa, Arabidopsis thaliana
  misc_feature: Ceres CLONE ID no. 151034
  misc_feature: The plant produces a reduced number of seeds.
  misc_feature: Useful for biocontainment applications
  misc_feature: Useful for making plants with altered cell wall content and/or composition
  misc_feature: Useful for making plants with altered lignin content
  misc_feature: Useful for making plants with modulated biomass
MDNIMQSSMPPGFRFHPTEEELVGYYLDRKINSMKSALDVIVEIDLYKMEPWDIQARCKLGYEEQNEWYFFSHKDRKYPTGTRTNRATAAGFWKATGRDKAVLSKNSVIGMRKTLVYYKGRAPNGRKSDWIMHEYRLQNSELAPVQEEGWVVCRAFRKPIPNQRPLGYEPWQNQLYHVESSNNYSSSVTMNTSHHIGASSSSHNLNQMLMSNNHYNPNNTSSSMHQYGNIELPQLDSPSLSPSLGTNKDQNESFEQEEEKSFNCVDWRTLDTLLETQVIHPHNPNILMFETQSYNPAPSFPSMHQSYNEVEANIHHSLGCFPDS

SEQ ID NO: 12950 - protein, 404 aa, Arabidopsis thaliana
  misc_feature: Ceres CLONE ID no. 152141
  misc_feature: The plant is abnormally small.
  misc_feature: Useful for making plants with modulated biomass
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 12951 - protein, 356 aa, Arabidopsis thaliana
  misc_feature: Ceres CLONE ID no. 152633
  misc_feature: Useful for making plants with altered alkaloid content
MGSTGNPNPWGTTYDSYRDCSQGVCSVYCPQWCYVIFPPPPSFYLDDEDDSSSSDFSPLLIALIGILASAFILVSYYTLISKYCHRRRHNSSSTSAAAINRISSDYTWQGTNNNNNNGATNPNQTIGGGGGDGLDESLIKSITVYKYRKMDGFVESSDCSVCLSEFQENESLRLLPKCNHAFHVPCIDTWLKSHSNCPLCRAFIVTSSAVEIVDLTNQQIVTENNSISTGDDSVVVVNLDLENSRSRNETVNEGSTPKPPEMQDSRDGEERRSASLNSGGGVVSIADILREIEDDEESAGVGTSRWVEEGEGEKTPPPSGSAANQTNGISNFLVRSSMAAMKRSGYDRAKNYRLPK

SEQ ID NO: 12952 - protein, 251 aa, Arabidopsis thaliana
  misc_feature: Ceres CLONE ID no. 156298
  misc_feature: Useful for making plants with altered Lignin content
MYYQLTKSSYRDSLKILEADIEHANGLAAEIPMGKSGVRLQMKLVCSNLAPFFIFLLQWMDFSCLLPRYFDFFHILIYKVRADGRWNRSRYGRKATIREFYGVILPSLERLHINFADLPDESLWYPNPKAITKKQYDIEGSRYMNSIDLEREDECGICLEPCTKMVLPNCCHAMCIKCYRNWNTKSESCPFCRGSIKRVNSEDLWVLTCDEDVVDPETVTKEDLLRFYLHINSLPKDYPEAAFLVYNEYLI

SEQ ID NO: 12953 - protein, 181 aa, Arabidopsis thaliana
  misc_feature: Ceres CLONE ID no. 157730
  misc_feature: The plant is abnormally large.
  misc_feature: Useful for biocontainment applications
  misc_feature: Useful for making plants with modulated biomass
MRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPPGSNRKDLMPIEEQPIDPNEPTYCVCHQVSFGDMIACDNENCQGGEWFHYTCVGLTPETRFKGKWYCPTCRLLPQSH

SEQ ID NO: 12954 - protein, 435 aa, Arabidopsis thaliana
  misc_feature: Ceres CLONE ID no. 158155
  misc_feature: Useful for making plants with altered terpenoid content
MQTTNGSDSTLATSGATPPNQQTPPPPQQWQQQQQQQQQWMAAMQYPPAAAMMMMQQQQMLMYPHQYVPYNQGPYQQHHPQLHQYGSYQQHQHQQHKAIDRGSGDDVKTLWVGDLLHWMDETYLHSCFSHTGEVSSVKVIRNKLTSQSEGYGFVEFLSRAAAEEVLQNYSGSVMPNSDQPFRINWASFSTGEKRAVENGPDLSVFVGDLSPDVTDVLLHETFSDRYPSVKSAKVVIDSNTGRSKGYGFVRFGDENERSRALTEMNGAYCSNRQMRVGIATPKRAIANQQQHSSQAVILAGGHGSNGSMGYGSQSDGESTNATIFVGGIDPDVIDEDLRQPFSQFGEVVSVKIPVGKGCGFVQFADRKSAEDAIESLNGTVIGKNTVRLSWGRSPNKQWRGDSGQQWNGGYSRGHGYNNGGGYANHHDSNNYHGEN

SEQ ID NO: 12955 - protein, 379 aa, Arabidopsis thaliana
  misc_feature: Ceres CLONE ID no. 158240
  misc_feature: Useful for making plants with altered Lignin content
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTGIYLVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVKAMLGADAGAVTQEEENPVELWSLDEINFMLEGDF

SEQ ID NO: 12956 - protein, 134 aa, Arabidopsis thaliana
  misc_feature: Ceres CLONE ID no. 158765
  misc_feature: Useful for making plants with modulated heat sensitivity
MSALSEKAASNATSLISLFNSKERKDKVGERISALQQIVSPYGKTDTASVLLDAMHYIEFLHEQVKVLSAPYLQTIPDATQEELEQYSLRNRGLCLVPMENTVGVAQSNGADIWAPVKTPLSPAFSVTSQSPFR

SEQ ID NO: 12957 - protein, 98 aa, Arabidopsis thaliana
  misc_feature: Ceres CLONE ID no. 15990
  misc_feature: Useful for making plants with altered Lignin content
  misc_feature: Useful for making plants with modulated drought sensitivity
MDEDDSDGEDSEEEEPTPKKPASSKKRANETTPKAPVSAKKAKVAVTPQKTDEKKKGGKAANQSPKSASQVSCGSCKKTFNSGNALESHNKAKHAAAK

SEQ ID NO: 12958 - protein, 245 aa, Parthenium argentatum
  misc_feature: Ceres CLONE ID no. 1604678
  misc_feature: Abnormal phyllotaxy, leaf number higher than wild-type
  misc_feature: The plant flowers significantly earllier than wild-type.
  misc_feature: Useful for making plants with modulated biomass
  misc_feature: Useful for making plants with modulated flowering time
MGRGRVQLKRIENKISRQVTFSKRRTGLLKKAHEISVLCDADVALIVFSTKGKLFEYSTHSSMEAILERYERYSYAEKLLTGPEAETQGSWALESSKLRTKIEVLEKNIRHYGGEDLEPLNLRELQGVEQQLDTALKRIRTRKNQVMHESISELHKKERVLQEQNNALSKKLKEDDKNTEQQNVGLLLSQAQAPVPTSLPQPPRLVPLAVGSGPFQGSSITREDDSAQVLSAGMMPAWLYRHVNQ

SEQ ID NO: 12959 - protein, 226 aa, Arabidopsis thaliana
  misc_feature: Ceres CLONE ID no. 16284
  misc_feature: Useful for making plants with altered Lignin content
MVSPENTNWLSDYPLIEGAFSDQNPTFPWQIDGSATVSVEVDGFLCDADVIKEPSSRKRIKTESCTGSNSKACREKQRRDRLNDKFTELSSVLEPGRTPKTDKVAIINDAIRMVNQARDEAQKLKDLNSSLQEKIKELKDEKNELRDEKQKLKVEKERIDQQLKAIKTQPQPQPCFLPNPQTLSQAQAPGSKLVPFTTYPGFAMWQFMPPAAVDTSQDHVLRPPVA

SEQ ID NO: 12960 - protein, 331 aa, Arabidopsis thaliana
  misc_feature: Ceres CLONE ID no. 16527
  misc_feature: The plant is abnormally small.
  misc_feature: The plant produces a reduced number of seeds.
  misc_feature: Useful for biocontainment applications
  misc_feature: Useful for making plants with modulated biomass
  misc_feature (112)..(112): Xaa is any aa, unknown, or other
  misc_feature (292)..(292): Xaa is any aa, unknown, or other
  misc_feature (293)..(293): Xaa is any aa, unknown, or other
  misc_feature (298)..(298): Xaa is any aa, unknown, or other
  misc_feature (311)..(311): Xaa is any aa, unknown, or other
  misc_feature (312)..(312): Xaa is any aa, unknown, or other
  misc_feature (313)..(313): Xaa is any aa, unknown, or other
  misc_feature (314)..(314): Xaa is any aa, unknown, or other
  misc_feature (323)..(323): Xaa is any aa, unknown, or other
MPTNSNHQHHLQHQLNENGSIISGHGLVLSHQLPPLQANPNPNHHHVATSAGLPSRMGGSMAERARQANIPPLAGPLKCPRCDSSNTKFCYYNNYNLTQPRYFCKGCRRYWXQGGALRNVPVGGGCRRNNKKGKNGNLKSSSSSSKQSSSVNAQSPSSGQLRTNHQFPFSPTLYNLTQLGGIGLNLAATNGNNQAHQIGSSLMMSDLGFLHGRNTSTPMTGNIHENNNNNNNENNLMASVGSLSPFALFDPTTGLYAFQNDGNIGNNVGISGSSTSMVDSRVYQTPPVKMEXXPNLAXLSRPVSGLTSPGXXXXQYFWPGSDXSGPSNDIL

SEQ ID NO: 12961 - protein, 360 aa, Arabidopsis thaliana
  misc_feature: Ceres CLONE ID no. 16533
  misc_feature: Useful for making plants with modulated nitrogen use efficiency
MGSNEEGNPTNNSDKPSQAAAPDQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 12962 - protein, 289 aa, Panicum virgatum
  misc_feature: Ceres CLONE ID no. 1724980
  misc_feature: The plant produces a reduced number of seeds.
  misc_feature: Useful for biocontainment applications
MGAPKQKWTSEEEDALRRGVLKHGAGKWRTIQKDPEFSPVLSSRSNIDLKDKWRNLSFSASGMGSRDKTKRTTGPSCSPSSTSQASSQASAVPVANKVAEAPPDAEKKQQEVKPQPKYGAMILEALSELNEPNGTELTEICSFIEQKHGVPTTFRRAIGTKLRRLVDSKKIEKVDTKSYRLTDSFATRTPAPIKASAPKQKDPSKPSKVSKNLGLFATSSPALEAAIAAAAKVADAEVKAHDAHDQMMEAERILKMAEETESLLTIAAEIYDRCSRGEITTLNPAQREV

SEQ ID NO: 12963 - protein, 227 aa, Arabidopsis thaliana
  misc_feature: Ceres CLONE ID no. 17402
  misc_feature: Useful for making plants with altered Lignin content
MVNGESSTSTSYSDNNNDTNDQGGDFECNICFELAQDPIVTLCGHLFCWPCLYRWLHHHSHSQECPVCKAVVQDDKLVPLYGRGKNQTDPRSKRYPGLRIPNRPTGQRPETAAPPPQPEAASNFFNYGIGLMGGIMPMMATTRFGNFSMGFGGLLPSLFNFQFHGFHDATLYGSTPGYPYGGYHNGFRGVPPRGQERPMARGGNQSDAFLKNILFFVGICVVIFLIW

SEQ ID NO: 12964 - protein, 235 aa, Arabidopsis thaliana
  misc_feature: Ceres CLONE ID no. 17482
  misc_feature: The plant flowers significantly late compared to wild-type.
  misc_feature: Useful for making plants with modulated flowering time
MSNVLLSPNGYVFASPKPLGRFINSKSGGRKLFFSVVRASSDDADCNAEECAPEKEVGTVSMEWLAGEKTKVVGTFPPRKPRGWTGYVEKDTAGQTNVYSIEPAVYVAESAISSGTAGSSADGAENTAAIVAGIALIAVAAASSILLQVGKDAPTRPKAVDYSGPSLSYYINKFKPSEIVQPSTPSVTEAPPVAELETSLPETPPVAQQETSLPETMASEAQPEASFVPTTSSTS

SEQ ID NO: 12965 - protein, 248 aa, Arabidopsis thaliana
  misc_feature: Ceres CLONE ID no. 17632
  misc_feature: Useful for making plants with altered terpenoid content
MDTRKRGRPEAGSFNSNGGGYKKSKQEMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 12966 - protein, 135 aa, Panicum virgatum
  misc_feature: Ceres CLONE ID no. 1777966
  misc_feature: Useful for biocontainment applications
MVHRLRAISLTGFTILLSLALLFTSQKAQGASSNLGRRSGKEKRRQASEEHYVPVRSVVYRSRSVAPAATEAVGYEPFEVCEGCRCCSTSNTSSCVDTSCCYAIDCNLPGKPFGTCAFTPQTCGCGGTTNCTQPS

SEQ ID NO: 12967 - protein, 393 aa, Panicum virgatum
  misc_feature: Ceres CLONE ID no. 1780759
  misc_feature: Useful for biocontainment applications
MGPISNDASHKRFFSIAPPAALIFFFVLIFVAGAIVTLDHKENLSILQLHPREAFATEEIRPPATSALRAEPTEEPNLCENQCRPSGSEALPRGIVQDKSNFQMESLGGNPGRKKAVRPSKSLLAIPVGIKQKAVVDKLVAKFPASNFVVMLFHYDGVVDGWRDLKWSDRAIHVAVRDQTKWWFAKRFLHPDVVAEYEYIFLWDEDIEVDSFDPLEYLRIVWREGLEISQPALDRRSQIHHRLTARARNVDVHRRFYKTSGHGRCNGNSTGPPCTGWVEMMVPVFSRAAWRCAWHMIQNDLIYAWGMDFKLGYCAQGDRRRNVGVVDSQYVLHRGIPTLGDGGKPQVSASAADRLAVRQRSYTELKLFNRRWKEAVAEDGCWTDPYPDPATTG

SEQ ID NO: 12968 - protein, 135 aa, Arabidopsis thaliana
  misc_feature: Ceres CLONE ID no. 18152
  misc_feature: Useful for biocontainment applications
MANTACFIIVGRNDIPIYEAEVGSAAKREDAAQLHQFILHAALDVVQDLAWTTSAMFLKSVDRFNDLVVSVYVTAGHTRLMLLHDSRNEDGIKSFFQEVHELYIKILLNPLYLPGSRITSSHFDTKVRALARKYL

SEQ ID NO: 12969 - protein, 488 aa, Panicum virgatum
  misc_feature: Ceres CLONE ID no. 1818680
  misc_feature: The plant flowers significantly late compared to wild-type.
  misc_feature: Useful for making plants with modulated flowering time
MGEEGTWPLLKEYHYHPGCPGCAYDRRKDLLRGMPYKEFLYVWMVSLTAALPISSLFPFLYFMIRDLNVAKRTEDIGFYAGFVGASFMFGRCLTSTAWGIAADRIGRKPVVMFGIFSVVVFNTLFGLSVNYWMAIATRFLLGALNGLLGPIKAYAIEVCRPEHESLALSLVSTAWGIGLIIGPALGGYLALPAENFPNIFSPDSFFGRFPYFLPCLCTSVFAVVVLISCIWMPKTLHKHKVSENENQSIEALEAHLIDPKEKVEESGSLGTKKKSLFKNRPLMSSIIIYCIFSFHDMAYTEVFSLWAESDKKYGGLSLSSEDVGQVLAVTGASLLVYQLFLYPRINKVIGPINSSRIAAILCIPILFAYPYMTYLSEPGLSIVLNIASVIKNNLSVTIITGTFILQNNAVPQDQRGAANGLSMTGMSFFKAVAPAGAGIVFSWAQKRQHGFFFPGDQMVFFLLNVIELLGLILTFKPFLAVPEQYNRN

SEQ ID NO: 12970 - protein, 350 aa, Panicum virgatum
  misc_feature: Ceres CLONE ID no. 1824525
  misc_feature: The plant is abnormally small.
  misc_feature: The plant produces a reduced number of seeds.
  misc_feature: Useful for biocontainment applications
  misc_feature: Useful for making plants with modulated biomass
MEEITHQYFGVGASGHGQHHHLWGSSLSAVVAPPPPQPPSAGLPLTLNTAATVNSGANGGNPVLQLANGGSLLDACIKAKEPSSSSPYAGDVEAIKAKIMSHPHYYSLLAAYLECQKVGAPPEVSARLAAMTQELEARQRTALGGLGAATEPELDQFMEAYHEMLVKFREELTRPLQEAMEFMRRVESQLSSLSISGGSLRNILSSGSSEEDQEGSGGETELPEIDAHGVDQELKHHLLKKYSGYLSSLKQELSKKKKKGKLPKEARQQLLSWWDLHYKWPYPSETQKVALAESTGLDLKQINNWFINQRKRHWKPSEEMHHLMMDGYHTTGAFYMDGHFINDGGLYRLG

SEQ ID NO: 12971 - protein, 221 aa, Arabidopsis thaliana
  misc_feature: Ceres CLONE ID no. 18246
  misc_feature: The plant produces a reduced number of seeds.
  misc_feature: Useful for biocontainment applications
MANSGEEKLKLYSYWRSSCAHRVRIALALKGLDYEYIPVNLLKGDQFDSDFKKINPMGTVPALVDGDVVINDSFAIIMYLDEKYPEPPLLPRDLHKRAVNYQAMSIVLSGIQPHQNLAVIRYIEEKINVEEKTAWVNNAITKGFTALEKLLVNCAGKLATGDEIYLADLFLAPQIHGAINRFQINMEPYPNLAKCYESYKELPVFQNALPEKQPDAPSSTN

SEQ ID NO: 12972 - protein, 441 aa, Arabidopsis thaliana
  misc_feature: Ceres CLONE ID no. 18612
  misc_feature: The plant is abnormally small.
  misc_feature: Useful for making plants with modulated biomass
MDFDLNGGNKRVFNRLGGGGGVGGGSTRPMAPTDTRQKVCFHWRAGRCNRSPCPYLHRELPGPGPGQGQGPGYTNKRVAEESGFAGPSHRRGPGFNGNSSSSWGRFGGNRTVTKTEKVCNFWVDGNCTYGDKCRYLHCWSKGESFALLTQLDGHEKLVSGIALPSGSDKLYTGSKDETLRVWDCASGQCTGVLKLGGEIGCVLSEGPRLLVGMPNLVKAWNIETNADQSLSGPVGQVYSLVVGTDLLFAGTQDGSILAWRYNAATNCFEPAASLTGHTLAVVTLYVGANRLYSGSMDKTIKVWSLDNLQCIQTLTDHTSVVMSLICWDQFLLSCSLDNTVKIWAAIEGGNLEVTYTHKEEHGVLALCGVHDAEAKPVLLCACNDNTLRLYDLPSFTERGKIFAKQEIRAIQIGPGGIFFTGDGTGQVKVWKWCTEPTAALP

SEQ ID NO: 12973 - protein, 101 aa, Arabidopsis thaliana
  misc_feature: Ceres CLONE ID no. 18663
  misc_feature: Useful for making plants with altered alkaloid content
  misc_feature: Useful for making plants with modulated nitrogen use efficiency
MAKLITSFLLLTILFTFVCLTMSKEAEYHPESYGPGSLKSYQCGGQCTRRCSSTKYHKPCMFFCQKCCAKCLCVPPGTYGNKQVCPCYNNWKTQQGGPKCP

SEQ ID NO: 12974 - protein, 208 aa, Panicum virgatum
  misc_feature: Ceres CLONE ID no. 1878174
  misc_feature: The plant is abnormally small.
  misc_feature: Useful for making plants with modulated biomass
MGDDDGACEAALHGRRRRGEGDRWDGGGSWVSAGSTAAGSASAGTVSGGGSSATTSPLFSSASSLTDEEGDGDGATSSSSRPDRAVSSSSLSSLTSSGSETVQMGAAGGGTPGPLYALSTMLDDLPALRTGLSKYYKGRSQSFTSLADVSCVEDLAKKTTPYIRRKKQTPRCYAEVLGAKNRLSKTIAKKAPRGKPPAYQGKGEMHRC

SEQ ID NO: 12975 - protein, 303 aa, Arabidopsis thaliana
  misc_feature: Ceres CLONE ID no. 18857
  misc_feature: The plant is abnormally large.
  misc_feature: Useful for making plants with altered alkaloid content
  misc_feature: Useful for making plants with modulated biomass
MNWLPEAEAEDDFKGLLSGDFFDDLINHLDVPLDDIDTTNGEGDWVDRFQDLEPPPMDMFPTLPSDLTSCGSGMAKAPRVDIQRNIPALKQSYSSEALSSTLHQSSAPPEIKVSKLFQSLSPVSVLENSYGSLSTHNNGSQRLAFPVKGMRSKRKRPTTLRLSYLFPSEPRKPEKSTPGKPESECYFSSEQHAKKKRKIHLTTRTVSSTLEASNSDGIVRKCTHCETTKTPQWREGPSGPKTLCNACGVRFRSGRLVPEYRPASSPTFIPAVHSNSHRKIIEMRRKDDEQFDSSMIRAVISRG

SEQ ID NO: 12976 - protein, 75 aa, Arabidopsis thaliana
  misc_feature: Ceres CLONE ID no. 19092
  misc_feature: Useful for making plants with modulated heat sensitivity
MRRIPRIKFPQRHSISSGSGPAPGSVSGVKKNVTASSDVPAAPKNTADGGKASLQPKRTPVSDKEIESIMLGGCI

SEQ ID NO: 12977 - protein, 238 aa, Arabidopsis thaliana
  misc_feature: Ceres CLONE ID no. 19188
  misc_feature: The plant is abnormally small.
  misc_feature: Useful for making plants with modulated biomass
MATLKASFLIKTLDNDVTGDFLSDLERRGSGAVHVIMGPMFSGKSTSLLRRIKSEISDGRSVAMLKSSKDTRYAKDSVVTHDGIGFPCWALPDLMSFPEKFGLDAYNKLDVIGIDEAQFFGDLYEFCCKVADDDGKIVIVAGLDGDYLRRSFGAVLDIIPIADSVTKLTARCEVCGHKAFFTLRKNCDTRTELIGGADVYMPVCRKHYITNHIVIKASKKVLEDSDKARAESCVAATI

SEQ ID NO: 12978 - protein, 97 aa, Arabidopsis thaliana
  misc_feature: Ceres CLONE ID no. 19255
  misc_feature: Useful for making plants with modulated nitrogen use efficiency
MAMSGLPVEAYIFNPPISLIPLEQCVNHKLNCVYRLTRDLFKAGIAKVLDLDEGQEGPRYKNLPSWRPHLFVNQSDVICSEYIGYFNHVVTMRGGIR

SEQ ID NO: 12979 - protein, 352 aa, Arabidopsis thaliana
  misc_feature: Ceres CLONE ID no. 19561
  misc_feature: Useful for making plants with altered Lignin content
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSNKQAIINAL

SEQ ID NO: 12980 - protein, 161 aa, Arabidopsis thaliana
  misc_feature: Ceres CLONE ID no. 19578
  misc_feature: Useful for making plants with altered alkaloid content
MKRIIRISFTDAEATDSSSDEDTEERGGASQTRRRGKRLVKEIVIDPSDSADKLYVCKTRFKIRIPAEFLKTAKTEKKYRGVRQRPWGKWVAEIRCGRGSCKGRRDRLWLGTFNTAEEAALAYDNASIKLIGPHAPTNFGLPAENQEDKTVIGASEVARGA

SEQ ID NO: 12981 - protein, 457 aa, Arabidopsis thaliana
  misc_feature: Ceres CLONE ID no. 19586
  misc_feature: Useful for making plants with modulated nitrogen use efficiency
  misc_feature: Useful for making plants with modulated nitrogen use efficiency
MASLGQITLPRAPSSEIGLLRRRFERPIIRTRIGFNGRIASVLTNAGDQAVSVKASVSQKVIEEEAKVIVGTYARAPVVLSSGKGCKLFDPEGKEYLDCASGIAVNALGHGDPDWLRAVTEQAGVLAHVSNVYYTIPQIELAKRLVASSFADRVFFCNSGTEANEAAIKFSRKFQRFTHPEDKEVATGFIAFTNSFHGRTLGALALTSKEQYRTPFEPIMPGVTFLEYGNIQAATDLIRSGKIAAVFVEPIQGEGGIYSATKEFLQSLRSACDAAGSLLVFDEVQCGLGRTGLMWAYEAFGVTPDIMTVAKPLAGGLPIGAVLVTEKVAETINYGDHGSTFAGSPLVCSAAIAVMDKVSKPSFLSSVSNKGRYFRDLLVKKLGGNSYVKEVRGEGLIIGVELDVPASSLVDACRDSGLLILTAGKGNVVRIVPPLVISEEEIERAVEIMAQNLTALD

SEQ ID NO: 12982 - protein, 118 aa, Arabidopsis thaliana
  misc_feature: Ceres CLONE ID no. 1986
  misc_feature: The plant produces a reduced number of seeds.
  misc_feature: Useful for biocontainment applications
  misc_feature: Useful for making plants with modulated nitrogen use efficiency
MARGKIQIKRIENQTNRQVTYSKRRNGLFKKAHELTVLCDARVSIIMFSSSNKLHGFVVSDFYDKYPKFLELVLPRIKEGKITYVEDVADGLEKAPEALVGLFHGKNVGKQVVVIARE

SEQ ID NO: 12983 - protein, 124 aa, Arabidopsis thaliana
  misc_feature: Ceres CLONE ID no. 19991
  misc_feature: Useful for making plants with modulated phosphate use efficiency
MATAYQPMKPGKAGLEEPLEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 12984 - protein, 253 aa, Arabidopsis thaliana
  misc_feature: Ceres CLONE ID no. 2036
  misc_feature: The plant produces a reduced number of seeds.
  misc_feature: Useful for biocontainment applications
MASNFWTSTHYKELKDPEEVNVVHPLDAQRGISVEDFRLIKLHMSNYISKLAQHIKIRQRVVATAVTYMRRVYTRKSLTEYEPRLVAPTCLYLACKAEESVVHAKLLVFYMKKLYADEKFRYEIKDILEMEMKVLEALNFYLVVFHPYRSLPEFLQDSGINDTSMTHLTWGLVNDTYRMDLILIHPPFLITLACIYIASVHKEKDIKTWFEELSVDMNIVKNIAMEILDFYENHRLFTEERVHAAFNKLATNP

SEQ ID NO: 12985 - protein, 324 aa, Arabidopsis thaliana
  misc_feature: Ceres CLONE ID no. 205648
  misc_feature: Useful for making plants with altered Lignin content
METEEEMKESSISMVEAKLPPGFRFHPKDDELVCDYLMRRSLHNNHRPPLVLIQVDLNKCEPWDIPKMACVGGKDWYFYSQRDRKYATGLRTNRATATGYWKATGKDRTILRKGKLVGMRKTLVFYQGRAPRGRKTDWVMHEFRLQGSHHPPNHSLSSPKEDWVLCRVFHKNTEGVICRDNMGSCFDETASASLPPLMDPYINFDQEPSSYLSDDHHYIINEHVPCFSNLSQNQTLNSNLTNSVSELKIPCKNPNPLFTGGSASATLTGLDSFCSSDQMVLRALLSQLTKIDGSLGPKESQSYGEGSSESLLTDIGIPSTVWNC

SEQ ID NO: 12986 - protein, 120 aa, Arabidopsis thaliana
  misc_feature: Ceres CLONE ID no. 206149
  misc_feature: Useful for making plants with modulated oxidative stress sensitivity
  misc_feature (24)..(24): Xaa is any aa, unknown, or other
  misc_feature (31)..(31): Xaa is any aa, unknown, or other
MGFKDELAGVALCESLPEFGVVQXADRLDAXGAIGIARCFTFGGSRNRVLHDPEIKPRTELTKEQYIKREEQTTINHFHEKLLKLKKLMKTEAGKRRAEKRHKFMEEYLKEFYEEWDGST

SEQ ID NO: 12987 - protein, 311 aa, Arabidopsis thaliana
  misc_feature: Ceres CLONE ID no. 207419
  misc_feature: Useful for making plants with altered Lignin content
  misc_feature: Useful for making plants with altered terpenoid content
MEKLAASTVTDLACVTAINSPPPPLSPISEQSFSNKHQEEFAASFASLYNSIFSPESQFSPSPPSSSSPPSRVDTTTEHRLLQAKLILEYDELNDHYELCLNRLQSLMTELDSLRHENDSLRFENSDLLKLIHISTSSSSSVSPPAPIHNRQFRHQISDSRSAKRNNQERNSLPKSISVRSQGYLKINHGFEASDRQTSQLSSNSVLSSQKVCVVQTKGEREALELEVYRQGMMKTELCNKWQETGACCYGDNCQFAHGIDELRPVIRHPRYKTEVCRMIVTGAMCPYGHRCHFRHSLTDQERMMMMMLTR

SEQ ID NO: 12988 - protein, 309 aa, Arabidopsis thaliana
  misc_feature: Ceres CLONE ID no. 20769
  misc_feature: Useful for making plants with altered Lignin content
  misc_feature: Useful for making plants with altered terpenoid content
MFGRHSIIPNNQIGTASASAGEDHVSASATSGHIPYDDMEEIPHPDSIYGAASDLIPDGSQLVAHRSDGSELLVSRPPEGANQLTISFRGQVYVFDAVGADKVDAVLSLLGGSTELAPGPQVMELAQQQNHMPVVEYQSRCSLPQRAQSLDRFRKKRNARCFEKKVRYGVRQEVALRMARNKGQFTSSKMTDGAYNSGTDQDSAQDDAHPEISCTHCGISSKCTPMMRRGPSGPRTLCNACGLFWANRGTLRDLSKKTEENQLALMKPDDGGSVADAANNLNTEAASVEEHTSMVSLANGDNSNLLGDH

SEQ ID NO: 12989 - protein, 72 aa, Zea mays subsp. mays
  misc_feature: Ceres CLONE ID no. 207829
  misc_feature: Useful for making plants with modulated nitrogen use efficiency
MGKTPVRMKAVVYALSPFQQKVMPGLWKDITTKIHHKVTENWISATLLLTPVVGTYQYAMWYKEQEKLSHRY

SEQ ID NO: 12990 - protein, 153 aa, Zea mays
  misc_feature: Ceres CLONE ID no. 208303
  misc_feature: Useful for making plants with altered terpenoid content
MMNNNSGGGAGGPGGGMGTGVGGGGDGRHDDEAALTEFLSSLMDYTPTIPDELVEHYLGRSGFHCPDLRLTRLVAVATQKFLSDIASDSLQHCKARVAAPIKDNKSKQPKDRRLVLTMDDLSKALREHGVNLKHAEYFADSPSAGMAPSTREE

SEQ ID NO: 12991 - protein, 212 aa, Zea mays
  misc_feature: Ceres CLONE ID no. 208429
  misc_feature: Useful for making plants with altered Lignin content
  misc_feature: Useful for making plants with altered alkaloid content
MAGGKSTGNAARSRKRVEATVLKRSRDGSAFTRCEACNKDVPVVLIDMHSCSLDEKIRMTLEAQVVEKTVEVASADRKKSSAKGGGNKDAKRKRSPTAFFLFMDDFRKEFKATHPDNKSVATVAKEGGERWKSMTDEEKKPYIEKAAELKAEAENGEGSGENNVATKKAKTDDQEVDQPAKKLRKCKALHEDEDDDGDQEDEDEKNELDDDM

SEQ ID NO: 12992 - protein, 133 aa, Arabidopsis thaliana
  misc_feature: Ceres CLONE ID no. 21374
  misc_feature: Useful for making plants with altered Lignin content
  misc_feature: Useful for making plants with altered alkaloid content
  misc_feature (95)..(95): Xaa is any aa, unknown, or other
MSMKISEVEYKRTRFFARRKKVCPVKMLEILNYDSSRTWVIDKPGLPRTPRGFKRSLILRKDYSKMDAYYITPTGKKLKSRNEIAAFIDANQDYXYALLGDFNFTVPKVMEETVPSGILSDRTPKPSRKVTID

SEQ ID NO: 12993 - protein, 324 aa, Arabidopsis thaliana
  misc_feature: Ceres CLONE ID no. 21391
  misc_feature: Useful for making plants with modulated nitrogen use efficiency
  misc_feature (248)..(248): Xaa is any aa, unknown, or other
MGSKMLFSLTSPRLFSAVSRKPSSSFSPSPPSPSSRTQWTQLSPGKSISLRRRVFLLPAKATTEQSGPVGGDNVDSNVLPYCSINKAEKKTIGEMEQEFLQALQSFYYDGKAIMSNEEFDNLKEELMWEGSSVVMLSSDEQRFLEASMAYVSGNPILNDEEYDKLKLKLKIDGSDIVSEGPRCSLRSKKVYSDLAVDYFKMLLLNVPATVVALGLFFFLDDITGFEITYIMELPEPYSFIFTWFAAVXVIVYLALSITKLIIKDFLILKGPCPNCGTENTSFFGTILSISSGGKTNTVKCTNCGTAMVYDSGSRLITLPEGSQA

SEQ ID NO: 12994 - protein, 149 aa, Arabidopsis thaliana
  misc_feature: Ceres CLONE ID no. 21672
  misc_feature: Useful for making plants with modulated low light sensitivity
MESHNGAEGIFPKALRRSSTIAADATVRDTADKVLATTARGATRWSRAILVSRFGTSLRRRRNTKPASALAAAIRGSGGSGRRRKLSAVGNRVRVLGGLVPGCRRTALPELLDETADYIAALEMQVRAMTALSKILSELQPSTNLGSAL

SEQ ID NO: 12995 - protein, 329 aa, Zea mays
  misc_feature: Ceres CLONE ID no. 218597
  misc_feature: The plant is abnormally small.
  misc_feature: Useful for making plants with modulated biomass
MAVDEVNSVYVGGLPYEANEEMLRDAFGYYGTIVSVKVINDHAVKGKCYGFVTFTHPRATEQAIAGMDGKKLGNRIVRVNEVRTRGPRDFGRDGFRRDPRRYGRDPYWDRRDRERSYDRERDPYHDRDSDRSREHDRERDYEHGGFNREIDYPMDRDREGDERRPREHDRTAEMHNVDSDNDKDKEHVSRKRFSRPKGRDSRDLSSSSDGLQNDGKHQLDKTIQMREDLENEINQIKDKISGKEQHIADLQKKAQKLEDELVAARKVSSERQLAVTDLYKHFLQLQDYNDRVKTAEQRLQSLVDAALVELDMAEDATTRDGSMYENGVL

SEQ ID NO: 12996 - protein, 185 aa, Arabidopsis thaliana
  misc_feature: Ceres CLONE ID no. 21868
  misc_feature: Useful for making plants with altered alkaloid content
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTVGSAYAKKTVESAEQAEKSSKRKRKNQYRGIRQRPWGKWAAEIRDPRKGSREWLGTFDTAEEAARAYDAAARRIRGTKAKVNFPEEKNP

SEQ ID NO: 12997 - protein, 248 aa, Arabidopsis thaliana
  misc_feature: Ceres CLONE ID no. 21999
  misc_feature: The plant is abnormally small.
  misc_feature: Useful for making plants with modulated biomass
MVRSTKGRQKIEMKKMENESNLQVTFSKRRFGLFKKASELCTLSGAEILLIVFSPGGKVFSFGHPSVQELIHRFSNPNHNSAIVHHQNNNLQLVETRPDRNIQYLNNILTEVLANQEKEKQKRMVLDLLKESREQVGNWYEKDVKDLDMNETNQLISALQDVKKKLVREMSQYSQVNVSQNYFGQSSGVIGGGNVGIDLFDQRRNAFNYNPNMVFPNHTPPMFGYNNDGVLVPISNMNYMSSYNFNQS

SEQ ID NO: 12998 - protein, 175 aa, Zea mays
  misc_feature: Ceres CLONE ID no. 221477
  misc_feature: The plant is abnormally small.
  misc_feature: Useful for making plants with modulated biomass
MEGEDDGAQMKLQQQQQSPCSDNLSLSAASSWLPPQVRSSSSSSSYTCGYCKKEFRSAQGLGGHMNIHRLDRARLIHQQYTSHRIAAPHPNPNPSCTSVLDLELSLSSLLAHGAASSDGGLSVPVAKLAGNRFSSASLPTTKDVEGKNLELRIGACSHGDGAEERLDLQLRLGYY

SEQ ID NO: 12999 - protein, 199 aa, Zea mays
  misc_feature: Ceres CLONE ID no. 222404
  misc_feature: Useful for making plants with altered alkaloid content
MEALLVTVLLLLLSSTLAAAQWCVCRQDASQAALQKTIDYACGSGADCNSIHETGACYNPNTVPAHCSWAANSYYQNNKAKGATCDFAGTATLTTSDPSSSGCSYPTTSASAAGTVTPTTGGTMGGAGGPGTLTPAGTGAGTAGTTGMGTAGTTGTGFGGLGPAGMDTAAAAAGGLLLLPEAGLCAALVALLLSAIVLA

SEQ ID NO: 13000 - protein, 434 aa, Zea mays
  misc_feature: Ceres CLONE ID no. 222894
  misc_feature: Useful for making plants with altered terpenoid content
  misc_feature (410)..(410): Xaa is any aa, unknown, or other
  misc_feature (411)..(411): Xaa is any aa, unknown, or other
MQTYLYSVLNSRVSRPSPLLRNPFPSSAEASPPAAETLASAAAVMASSNVSTVYISVIDDVISKVREDFITYGVGDAVLNELQALWEMKMLHCGAISGNIDRTKAAAASVGGTTGTTAPVHDLNVPYEATSEEYATPTADMLFPPTPLQTPIQTPLPGTDTAMYNIPTGPSDYAPSPISDVRNGMAINGADPTAGHPSPYMPPPSPWMNQRPLGVDVNVAYVEGREDPDRGVQPQPLTQDFFMMSSGKRKRDEYPGQLPSGSFVPQQDGSADQIVEFVVSKENVNQLWSSIGNKLETPTKTITPVIPQRDGIQDNYNDQFFFPGVPTEDYNTPGESAEYRAPTPAVGTPKQRNDAGDDDNDDDDDEPPLNEDDDEELDDLEQGEDEPNTQHLVLAQFDKVSRTKNRWKCXXKDGIMHLNGRDVLFNKATGEFDF

SEQ ID NO: 13001 - protein, 267 aa, Arabidopsis thaliana
  misc_feature: Ceres CLONE ID no. 22324
  misc_feature: Useful for making plants with modulated cold sensitivity
MALSTVFRRASSTVSNLAFRAGRSPVSFRSGAVSVERLIRGSHQIRRGSVSSFSVSSFSTESAISKTTADENLVSVIESEIECAVAEEAPHDTDFLEDKPEGFPFEIIDNSGERTVLLTRKFEDETIQVEVDSVASYDDEDEEEEAEPNNEEDDEDQESSGKVRVPMVVSVQKGDGVCLEFGVSAYPDEIVFDSLSIKQPQGSDNDLAYEGPDFDDLDENLQKAFHRYLEIRGIKPSFTTFLADYVANKDSREYLQWLKDLKSFVEK

SEQ ID NO: 13002 - protein, 405 aa, Arabidopsis thaliana
  misc_feature: Ceres CLONE ID no. 22350
  misc_feature: Useful for making plants with altered alkaloid content
MAVAIPQATSLTNLVFLTKLIPRGSFTTILPKHHRKPIFVFSLQTQFSSPVTTLTSKNPKDDEQQQKLSFTLNYLIDSCGLSPDSATVASRKLLLDSPERPNTVLNLLRDHGFTTAQISSLVKKRPVLLLANAESVLLPKLSFFLSIGVSKSLLARTLASDPTILTRSLVNQLIPSYNFLKSVLDSDEKIVAALRRTTWVFLEDHTKNLVPNINYMAETGVPEKCIKLLLTHFPEAVMQKNHEFQAIAKQAQEMGFNPQKSTFVLAIHALSGKGNKSIWDKCFEVYQRWGWSEDDIMCAFKKHPHCMMLSERKINRTMEYFVNEMNMAPRSIAQCPVVLFFSLEKRIIPRCSVTKVLVSNGLVKEDWSLTSLLVPVEKVFLEKLVIKYEEELPELMNLYLGCTKL

SEQ ID NO: 13003 - protein, 135 aa, Arabidopsis thaliana
  misc_feature: Ceres CLONE ID no. 22413
  misc_feature: Useful for making plants with modulated nitrogen use efficiency
MYTASLYAAFASLIHNKHNDLAGKRVVMFSYGSGSTATMFSLRLNDNKPPFSISNIASVMDVGGKLKARHEYAPEKFVETMKLMEHRYGAKDFVTTKEGIIDLLAPGTYYLKEVDSLYRRFYGKKGEDGSVANGH

SEQ ID NO: 13004 - protein, 223 aa, Zea mays
  misc_feature: Ceres CLONE ID no. 225597
  misc_feature: The plant is abnormally small.
  misc_feature: The plant produces a reduced number of seeds.
  misc_feature: Useful for biocontainment applications
  misc_feature: Useful for making plants with modulated biomass
MEDLVSSPSFRSVLSSSSEGQAQSGESSWTDYFVDFMLSEEERKRQADASSYSYCATEDEGGSKYGGDGSNRDEEEEEEEESMVSDAASHAPTTAGATALIPAGRYKELKKLKKKPFGKALDHDGSLEDTASSPVNSPKVSVVSQLELSPKRRCNIRDLTKGVVGIGDDHGGEGMDVCTDATTTEGARLGDQYHTSIAPCAELKDKGICLFPFSVLLHYHGPN

SEQ ID NO: 13005 - protein, 397 aa, Zea mays subsp. mays
  misc_feature: Ceres CLONE ID no. 226512
  misc_feature: Useful for making plants with modulated oxidative stress sensitivity
MRERLVAMMNPAAGAASRSKIKDMSAEVVDNNPYSRLMALQRMGVVENYERIRDYSVAIVGIGGVGSVAAEMLTRCGIGRLLLYDYDTVELANMNRLFFRPEQVGMTKTDAAVQTLSGINPDVVLESYSLNITTVKGFETFLASLKAQSSHERSTGVDLVLSCVDNYEARMVVNQACNELGQTWMESGVSEDAVSGHIQLLVPGETACFACAPPLVVASGVDERTLKREGVCAASLPTTMGVVAGLLVQNALKYLLNFGQVSPYLGYNSLKDYFPAMEMRPNPQCLNPACVHRQKEYMESKPARDAAAKTKMEAEASTENECPVHLDNEWNISVLDDEETETSSIRNTPDILPEGLVRELPDADSYAGPAAPVSSSAIDDDDDLEELQRQLDALNAS

SEQ ID NO: 13006 - protein, 84 aa, Arabidopsis thaliana
  misc_feature: Ceres CLONE ID no. 22671
  misc_feature: Useful for making plants with altered Lignin content
MDNTNRLRRLHCHKQPKFTHSSQEVSSMKWEFINMTEQEEDLIFRMYRLVGDRWDLIARRVVGREAKEIERYWIMRNCDYFSHK

SEQ ID NO: 13007 - protein, 126 aa, Zea mays
  misc_feature: Ceres CLONE ID no. 227651
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
MAAAAVYGGFKGKLGVEDAPELQLNRIRITLSSKNVKNLEKVCADLVKGAKDKHLRVKGPVRIPTKVLHITTRKSPCGEGTNTWDRFEFRIHKRVIDLISSPDVVKQITSITIEPGVEVEVTIADV

SEQ ID NO: 13008 - protein, 222 aa, Arabidopsis thaliana
  misc_feature: Ceres CLONE ID no. 22775
  misc_feature: Useful for making plants with altered alkaloid content
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQLLDLDLNLPPPSEQA

SEQ ID NO: 13009 - protein, 545 aa, Zea mays subsp. mays
  misc_feature: Ceres CLONE ID no. 230477
  misc_feature: Useful for making plants with modulated heat sensitivity
  misc_feature (509)..(509): Xaa is any aa, unknown, or other
FLFLLLAPRAADAAAMNGDGSKEDANRRLEWATLNLERGVVVSETTKGDGNGNAGRKAPISIVRLFLACMVSGGIQYGWALQLSLLSPYSQTLGISHSYVSLTWICGPIAGFVVQPIVGYYSDRCTSKMGRRRPFILAGCIIICLSVLVIGFSADIGRRLGDTKEHCSTFTGSRWSAAAVYIVGFWFLDFANNTVQGPARAMMADLAAGQHGPNVGQAIFSLWMALGSVLGYLSGANAKWHDWLPWLKTAACCDACANLKGAFLTAVVLIIISMSVTLWLAGEERLDKESVDTSGGACSAFMDLFKTLKKLPPAMFSVLAVTAVTWLSWFPFFQYNTDWMGREIFHGEPQGAGGKADLYEAGVREGAIGLLFCSVALGVTSFFIPRLCRKLTSRVVWSVSSLMVFVLMTAMVVLGMVSMKGYRPSLAASLSGPDHSFKGGALAIFALIGIPQAVLYSVPWAVASEVATEDGGGQGLTIGVLNIAIVLPQLVIALGAGPIDGAFNKGNTXAFGIGAAFALICAVLALILLPKTRGVSNATVMAGGH

SEQ ID NO: 13010 - protein, 207 aa, Zea mays
  misc_feature: Ceres CLONE ID no. 230582
  misc_feature: Useful for making plants with altered alkaloid content
MAGSPRHLSLFPLRLLLLLPLLAAGKPVLEDGYTVTTFADLNPLPASGPHPYAVLPRSRAGDLLLLDSAGSALYTISLSSSPGEPRRLAGGKRGSGFNDGGPGDAAFDRPRSVAVDAADNVYVADRLHGAVRKVAPSGYTTTIAGGFSSGPGHRDGPAQNATFSSDFALVYVPKICALLVADRGNRMVRQINLKPEDCAHEKQSGKY

SEQ ID NO: 13011 - protein, 370 aa, Arabidopsis thaliana
  misc_feature: Ceres CLONE ID no. 231109
  misc_feature: Useful for making plants with altered Lignin content
MNNPVPCQSVSGGNSGGYLFPSSSGYCNVSAVLPHGRNLQNQPPVSTVPRDRLAMQDCPLIAQSSLINHHPQEFIDPLHEFFDFSDHVPVQNLQAESSGVRVDSSVELHKKSEWQDWADQLISVDDGSEPNWSELLGDSSSHNPNSEIPTPFLDVPRLDITANQQQQMVSSEDQLSGRNSSSSVATSKQRMRWTPELHEAFVEAVNQLGGSERATPKAVLKLLNNPGLTIYHVKSHLQKYRTARYKPETSEVTGEPQEKKMTSIEDIKSLDMKTSVEITQALRLQMEVQKRLHEQLEIQRSLQLQIEKQGRYLQMMFEKQQKIQDNKSSSSEASPKQCNGSFAEVEVGLETLTGDQNESASASRKRVRED

SEQ ID NO: 13012 - protein, 268 aa, Zea mays
  misc_feature: Ceres CLONE ID no. 232985
  misc_feature: Useful for making plants with altered terpenoid content
MATVGQSGALRRVTVHYANSPTGSTVAEVSFDDLDDELLLFVLADLLPGQEGLHQSILEGTYNNQENHMRGAAPSAPYGYSRPEEYRAESSTAAAAATGSRNSGMDEQIASDFEYAKQLQQEMEDLSVKDEDDNDISCVPSPSDSDDEHEHHDEEEEADRQEDGDGDDGPDNMTYEQGQALVESVGTEYRGLSDELISYLQSWKYKSSGLFSRKTNHEDCPICLSTFRNRETMITLPCRHHYHAACVTRWLKVNKTCPVCKYELFGPS

SEQ ID NO: 13013 - protein, 190 aa, Arabidopsis thaliana
  misc_feature: Ceres CLONE ID no. 23518
  misc_feature: The plant is abnormally large.
  misc_feature: The plant is abnormally small.
  misc_feature: Useful for making plants with modulated biomass
MFSAQNKINKDKNAEPTECEEQVAQALFDLENTNQELKSELKDLYINQAVHMDISGNRKAVVIYVPFRLRKAFRKIHPRLVRELEKKFSGKDVIFVTTRRIMRPPKKGAAVQRPRNRTLTSVHEAMLEDVAFPAEIVGKRTRYRLDGSKIMKVFLDAKEKNNTEYKLETMVGVYRKLTGKDVVFEYPVEA

SEQ ID NO: 13014 - protein, 75 aa, Zea mays
  misc_feature: Ceres CLONE ID no. 235672
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
MEPKKSSAQHQPHAMEPKKSSPRGAGAVAATATEAESPLSSLFYPPAPAANGKDQELYSIIYKGQSGSATSWRDR

SEQ ID NO: 13015 - protein, 87 aa, Zea mays subsp. mays
  misc_feature: Ceres CLONE ID no. 236035
  misc_feature: Useful for making plants with modulated nitrogen use efficiency
MNVEEEVGRLKEEIHRLGQQQPDGSYKVKFGVLFNDDRCANIFEALVGTLRAAKKRKILTYEGELLLQGVHDNVEITLLPPPAVAAA

SEQ ID NO: 13016 - protein, 209 aa, Zea mays
  misc_feature: Ceres CLONE ID no. 238496
  misc_feature: The plant flowers significantly earllier than wild-type.
  misc_feature: The plant produces a reduced number of seeds.
  misc_feature: Useful for biocontainment applications
  misc_feature: Useful for making plants with modulated flowering time
MDKILERYERYSYAEKALISAESESEGNWCHEYRKLKAKIETIQRCHKHLMGEDLESLNPKELQQLEQQLESSLKHIRSRKSHLMAESISELQKKERSLQEENKALQKELSERQKAVASRQQQQQQLQWDQQTQVQVQTSSSSSSFMMRQDQQGLPPPQNICFPPLSIGERGEEVAAAAQQQLPPPPGQAQPQLRIAGLPPWMLSHLNA

SEQ ID NO: 13017 - protein, 201 aa, Zea mays
  misc_feature: Ceres CLONE ID no. 239806
  misc_feature: Useful for making plants with modulated nitrogen use efficiency
MSYYGDRRAESSIVEAFTLSPLPYPVILVLLMVTLLLGASWFFTYDDFIEEASQQLSWALLGVPIALVLLIRWISSVDSFEGYLGFYPRESRWKGRYERGPAEGSSPWGVALLVLLLLVLARAGCGKVVYGNPGRLGRKRRGGDKVKEQAGDEAAKFPWSGMRLATEKRRRVRRSPSKKGIVLKQKSRKVSLQHRSKKLKA

SEQ ID NO: 13018 - protein, 338 aa, Zea mays
  misc_feature: Ceres CLONE ID no. 240112
  misc_feature: Useful for making plants with altered Lignin content
MGLDVGGIGMGLDLGLDLGLFAARSAGGMAAAAKGAPAEIESCIRSLEEERRKIEVFRRELPLCVRLLADVIDELKDEAAKRGGDAEAKADDGDKRKWMSTAQLWLDSDAKSDESDKEQLSEITSPEPKLLGGAPMPIRAVAAVPPLPPPFFRREDSSAGSGLSLVPPAAKPPIPPMSASDNASGRFCATMPPSGSGANLHSQAQQQARKARRCWSPELHRLFVAALHQLGGPQVATPKQIREVMKVDGLTNDEVKSHLQKYRLHNRRSPGVVAPVSQSVMLAGGLWAPPHQEQSSSQSGSPQGPLQFSGSGVAATVGGDSSSSDEDDKSEGYSRKYV

SEQ ID NO: 13019 - protein, 299 aa, Zea mays
  misc_feature: Ceres CLONE ID no. 241131
  misc_feature: The plant flowers significantly late compared to wild-type.
  misc_feature: Useful for making plants with modulated flowering time
MDVRPANAADDSSLGDLFPHQPAGLESDESNTEWLSGYVEDCFSSSTSYTNPVSAMASEGVGKPKLPPPPSSNGRRKKRSLASVMTNGDYQQFVLPLYVEPPLILIDQKHWMAESELIHPKKDDDDREVCQQQGQEQEKGVPRLVKMCSNCLSSQTPRWRDGPSGRQMMCSACGMRLKPETRLSAEQQYGQEEPTRKEQEPDRKRKKAAKKTCYESSDAPPSSDQQEKRCAHCLSSKTPQWRAGPLGPKTLCNACGVRFKSGRLLPEYRPANSPTFVSCLHSNSHKKVMQMRQAVAQQQ

SEQ ID NO: 13020 - protein, 229 aa, Zea mays
  misc_feature: Ceres CLONE ID no. 241379
  misc_feature: There is no branching.
  misc_feature: Useful for making plants with modulated biomass
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRYVMESGAKGCEVIVSGKLRAQRAKSMKFKDGYMISSGQPVNEYIDSAVRHVLLRQGVLGIKVKIMLDWDPKGKVGPITPLPDLVTIHTPKDEDEPRPPVLAPPEV

SEQ ID NO: 13021 - protein, 166 aa, Zea mays
  misc_feature: Ceres CLONE ID no. 241491
  misc_feature: Useful for making plants with altered alkaloid content
  misc_feature: Useful for making plants with altered terpenoid content
  misc_feature: Useful for making plants with modulated flowering time
MGRGRVELKRIENKINRQVTFSKRRNGLLKKAYELSVLCDAEVALIIFSGRGKLYEFGSAGVTKTLERYQHFCYNAQDSNNGALSESQSWYQEISKLRAKFEALQRTQRHLLGEDLGPLSTVKELQQLEKQLECALSQARQRKTQLMMEQVEELRRTVFYTRLCLQ

SEQ ID NO: 13022 - protein, 225 aa, Arabidopsis thaliana
  misc_feature: Ceres CLONE ID no. 2416
  misc_feature: Useful for making plants with modulated nitrogen use efficiency
MASGIVEGGGSLSDVYSSAKRILLKARDGIERLERFESSSMDSPDLASSVKRDITEVRSLCSNMDTLWRSIPVKSQRDLWRRKTEQVGEEAEYLNLSLEKYMSRNQRKMLEAKERADLLGRASGEGAHILQIFDEEAQAMSSVKNSKRMLEESFSSGVAILSKYAEQRDRLKSAQRKALDVLNTVGLSNSVLRLIERRNRVDTWIKYAGMIATLVILYLFIRWTR

SEQ ID NO: 13023 - protein, 338 aa, Zea mays
  misc_feature: Ceres CLONE ID no. 244306
  misc_feature: Useful for making plants with modulated nitrogen use efficiency
MASANAISTASPFRPLSQGRATRSQRFVVRANAKDIAFDQKSRAALQAGVEKLANAVGVTLGPRGRNVVLDEYGNPKVVNDGVTIARAIELYDPMENAGAALIREVASKTNDSAGDGTTTACVLAREIIKLGLLSVTSGANPVSLKKGIDKTVQGLIQELENKSRPIKGGGDIKAVASISAGNDEFIGSMIAEAIDKVGPDGVLSIESSSSFETTVEVEEGMEIDRGYISPQFVTNLEKSIVEFENCKVLITDQKITSIKEILPILEKTTQLRAPLFIIAEDITGEALATLVVNKLRGILNVAAIKAPSFGERRKAVLQDIAIVTGAEFLAKDLGLLG

SEQ ID NO: 13024 - protein, 235 aa, Zea mays
  misc_feature: Ceres CLONE ID no. 244916
  misc_feature: Useful for making plants with altered alkaloid content
MVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTRLIEENSRLKEQLQVTRMSRMETQLGADPEFVYEEGQSSESVTNTSYPRPSTDTDDCSDTSLRLGLPLFSSK

SEQ ID NO: 13025 - protein, 264 aa, Arabidopsis thaliana
  misc_feature: Ceres CLONE ID no. 24644
  misc_feature: The plant is abnormally small.
  misc_feature: Useful for making plants with modulated biomass
  misc_feature (157)..(157): Xaa is any aa, unknown, or other
  misc_feature (173)..(173): Xaa is any aa, unknown, or other
  misc_feature (174)..(174): Xaa is any aa, unknown, or other
  misc_feature (178)..(178): Xaa is any aa, unknown, or other
  misc_feature (211)..(211): Xaa is any aa, unknown, or other
  misc_feature (212)..(212): Xaa is any aa, unknown, or other
  misc_feature (232)..(232): Xaa is any aa, unknown, or other
  misc_feature (234)..(234): Xaa is any aa, unknown, or other
  misc_feature (260)..(260): Xaa is any aa, unknown, or other
MDPSGMMNEGGPFNLAEIWQFPLNGVSTAGDSSRRSFVGPNQFGDADLTTSANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREXISERMKILQDLVPGCXXVIGXALVLDEIINYIQSLQRQVEFLSMKLEAVNSRMXXGIEVFPPKEFGQQAFENPEXQXGSQSTREYSRGASPEWLHMQIGSGGXERTS

SEQ ID NO: 13026 - protein, 183 aa, Arabidopsis thaliana
  misc_feature: Ceres CLONE ID no. 24885
  misc_feature: The plant is abnormally small.
  misc_feature: Useful for making plants with modulated biomass
  misc_feature (152)..(152): Xaa is any aa, unknown, or other
MTQSQTNDGAGAGAVTTVESVPPQPQSQPQPQPQQQSNEMVLHTGSLSFSSHMSREDEEMTRSALSAFRAKEDEIEKRRMEVRERIQAQLGRVEQETKRLSTIREELESMADPMRKEVSVVRKKIDSVNKELKPLGSTVQKKEREYKEALDXIQREEQGESTADHKTHGDGTVGWRKREVEDD

SEQ ID NO: 13027 - protein, 204 aa, Arabidopsis thaliana
  misc_feature: Ceres CLONE ID no. 251343
  misc_feature: Useful for making plants with altered alkaloid content
  misc_feature: Useful for making plants with modulated nitrogen use efficiency
  misc_feature: Useful for making plants with modulated nitrogen use efficiency
MQDPAAYYQTMMAKQQQQQQPQFAEQEQLKCPRCDSPNTKFCYYNNYNLSQPRHFCKSCRRYWTKGGALRNVPVGGGSRKNATKRSTSSSSSASSPSNSSQNKKTKNPDPDPDPRNSQKPDLDPTRMLYGFPIGDQDVKGMEIGGSFSSLLANNMQLGLGGGGIMLDGSGWDHPGMGLGLRRTEPGNNNNNPWTDLAMNRAEKN

SEQ ID NO: 13028 - protein, 286 aa, Arabidopsis thaliana
  misc_feature: Ceres CLONE ID no. 252299
  misc_feature: Useful for making plants with modulated oxidative stress sensitivity
MTLARHFRFHLPTNQKMAFAIASALTSTLTLSTSRVQNPTQRRPHVASTSSTGGRLMRERLVVVRAGKEVSSVCEPLPPDRPLWFPGSSPPEWLDGSLPGDFGFDPLGLGSDPDTLKWFAQAELIHSRWAMLAVTGIIIPECLERLGFIENFSWYDAGSREYFADSTTLFVAQMVLMGWAEGRRWADLIKPGSVDIEPKYPHKVNPKPDVGYPGGLWFDFMMWGRGSPEPVMVLRTKEIKNGRLAMLAFLGFCFQATYTSQDPIENLMAHLADPGHCNVFSAFTSH

SEQ ID NO: 13029 - protein, 79 aa, Arabidopsis thaliana
  misc_feature: Ceres CLONE ID no. 254065
  misc_feature: The plant is abnormally small.
  misc_feature: Useful for making plants with modulated biomass
MSMVTVKVSNVSLEATERDLKEFFSFSGDIAYLETQSENDGSKLAYVTFKDLQGAETAVLLTGSTIVDSSVTVTMSPDY

SEQ ID NO: 13030 - protein, 281 aa, Arabidopsis thaliana
  misc_feature: Ceres CLONE ID no. 25538
  misc_feature: The plant is abnormally small.
  misc_feature: Useful for making plants with modulated biomass
MAVSYNALAQSLARSSCFIPKPYSFRDTKLRSRSNVVFACNDNKNIALQAKVDNLLDRIKWDDKGLAVAIAQNVDTGAVLMQGFVNREALSTTISSRKATFFSRSRSTLWTKGETSNNFINILDVYVDCDRDSIIYLGTPDGPTCHTGEETCYYTSVFDQLNNDEASGNKLALTTLYSLESIISKRKEESTVPQEGKPSWTRRLLTDDALLCSKIREEADELCRTLEDNEEVSRTPSEMADVLYHAMVLLSKRGVKMEDVLEVLRKRFSQSGIEEKQNRTK

SEQ ID NO: 13031 - protein, 117 aa, Arabidopsis thaliana
  misc_feature: Ceres CLONE ID no. 2561
  misc_feature: The plant is abnormally small.
  misc_feature: Useful for making plants with modulated biomass
MSSPLSKDLRNKHNVRSMPIRKDDEVQVVRGTFKGREGKVMQVYRRKWVIHIERITREKVNGSTVNVGVNASNVMITKLRLDKDRKSLLERKANGRAAADKEKGTKFSAEDVMENVD

SEQ ID NO: 13032 - protein, 104 aa, Arabidopsis thaliana
  misc_feature: Ceres CLONE ID no. 256157
  misc_feature: Useful for making plants with modulated nitrogen use efficiency
MKGAKSKAETRSTKLSVTKKPAKGAKGAAKDPNKPKRPSSAFFVFMEDFRVTYKEEHPKNKSVAAVGRSSQQQRMGLRNQLCSRKVSQVLSVCILLFFQSFEFE

SEQ ID NO: 13033 - protein, 134 aa, Arabidopsis thaliana
  misc_feature: Ceres CLONE ID no. 25793
  misc_feature: Useful for making plants with altered Lignin content
MNHGQQSGEAKHEDDAALTEFLASLMDYTPTIPDDLVEHYLAKSGFQCPDVRLIRLVAVATQKFVADVASDALQHCKARPAPVVKDKKQQKDKRLVLTMEDLSKALREYGVNVKHPEYFADSPSTGMDPATRDE

SEQ ID NO: 13034 - protein, 94 aa, Arabidopsis thaliana
  misc_feature: Ceres CLONE ID no. 25795
  misc_feature: Useful for making plants with altered Lignin content
  misc_feature: Useful for making plants with altered terpenoid content
  misc_feature: Useful for making plants with modulated nitrogen use efficiency
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 13035 - protein, 98 aa, Arabidopsis thaliana
  misc_feature: Ceres CLONE ID no. 25886
  misc_feature: The plant is abnormally small.
  misc_feature: The plant produces a reduced number of seeds.
  misc_feature: Useful for biocontainment applications
  misc_feature: Useful for making plants with modulated biomass
MCEVEGNHLTHAAIFGQDGSVWAQSSAFPQLKPAEIAGINKDFEEAGHLAPTGLFLGGEKYMVVQGEAGAVIRGKKGPGGVTIKKTTQALVFGIYDER

SEQ ID NO: 13036 - protein, 319 aa, Arabidopsis thaliana
  misc_feature: Ceres CLONE ID no. 261272
  misc_feature: Useful for making plants with altered Lignin content
MSSFFPLPTSSSNESTRKKPYQTSSFRGMGCYAAAAAAAQEVSVPSVIRYSADLDARIRKDKKKKKHKHKKKKKKNKGSYEDGSIRILSEEARDVIDVWCRPGLGFSTDAVIGRSVDPPRGRNIPSSRRKIDVDNNNYNHTLGSSVLPIRFLNQETHSHDIFNSDSTFVTSSRAEPTMLSSRCRGHLPRSYPDDLTEMRMLQNGFVMGRITDSRDNYHELRLDVDSMSYEQLLELGDRIGYVNTGLKESEIHRCLGKIKPSVSHTLVDRKCSICQDEYEREDEVGELNCGHSFHVHCVKQWLSRKNACPVCKKAAYGKP

SEQ ID NO: 13037 - protein, 68 aa, Arabidopsis thaliana
  misc_feature: Ceres CLONE ID no. 2617
  misc_feature: Useful for making plants with modulated nitrogen use efficiency
MTTSKRLADRKIEKFDKNILKRGFVPETTTKKGKDYPVGPILLGFFVFVVIGSSLFQIIRTATSGGMA

SEQ ID NO: 13038 - protein, 346 aa, Zea mays subsp. mays
  misc_feature: Ceres CLONE ID no. 263907
  misc_feature: Useful for making plants with modulated cold sensitivity
MAGEEAGRRGVPSLLNPPSASSEGQQEHIASDVTQLIGWTPLVELKRIAAKEGVCARIVGKVEAYQPLCSVKDRSALRMIEDAEERGLISPGTTTLVEPTSGNLGLGLVLVALRKGYRFVAVMPGQYSLDKQILLTYMGAELYVTDPSLGFPGITAKVEELKKELPNVHVLDQFSNRANPEAHVRWTGPEIWKDTAGKVDVFVAGSGSGGTVSGVGKYLKTQNPSVKVICVEPAESPVVSGGEPGSHKIQGIGPGFIPEVLDTSVIDEAVTVTTEEAMAGARRLAREEGLLVGISSGANLAACLKVAAREESKGKMIVTVFPSGGERYMTSDLFAAAREECIAMTF

SEQ ID NO: 13039 - protein, 407 aa, Arabidopsis thaliana
  misc_feature: Ceres CLONE ID no. 26542
  misc_feature: The plant is abnormally small.
  misc_feature: Useful for making plants with modulated biomass
MVASAAARPLVTVQGLDGDMSTDQSTTVTLPDVMTAPVRPDIVNFVHAQISNNSRQPYAVSKKAGHQTSAESWGTGRAVSRIPRVPGGGTHRAGQAAFGNMCRGGRMFAPTKIWRRWHRRVNVNMKRHAIVSAIAATAVPALVMARGHKIENVPEMPLVVSDSAEAVEKTSAAIKVLKQIGAYDDAEKAKNSIGIRPGKGKMRNRRYISRKGPLVVFGTEGAKIVKAFRNLPGVELCHVERLNLLKLAPGGHLGRFVIWTKSAFEKLESIYGSFEKPSEKKKGYVLPRAKMVNADLARIINSDEVQSVVNPIKDGSKRAVLKKNPLKNLNVMFKLNPYAKTAKRMSLLAEASRVKAKKEKLEKKRKVVTKEEAQAIKAAGKAWYQTMISDSDYTEFDNFTKWLGASQ

SEQ ID NO: 13040 - protein, 106 aa, Arabidopsis thaliana
  misc_feature: Ceres CLONE ID no. 267315
  misc_feature: Useful for making plants with modulated nitrogen use efficiency
MTRSWVLLFVLMFIVLTSQFEWNEQVENESETSSRPLILSDKEQQHIPQGKESVQVKKILFQEKKIQKLNELVRDLRRQLLQCRNENQVELTELETELDQLLVTGV

SEQ ID NO: 13041 - protein, 244 aa, Arabidopsis thaliana
  misc_feature: Ceres CLONE ID no. 267626
  misc_feature: The plant is abnormally small.
  misc_feature: Useful for making plants with modulated biomass
MSTGLDMSLDDMIAKNRKSRGGAGPARGTGSGSGPGPTRRNNPNRKSTRSAPYQSAKAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQQRGGGRGGGGRGGGGRGRRPGKGPAEKISAEDLDADLDKYHSGDMETN

SEQ ID NO: 13042 - protein, 272 aa, Arabidopsis thaliana
  misc_feature: Ceres CLONE ID no. 267657
  misc_feature: The cauline leaves are abnormally small.
  misc_feature: The plant produces a reduced number of seeds.
  misc_feature: Useful for biocontainment applications
  misc_feature: Useful for making plants with modulated biomass
MAQQHSFLLLCFFLSISYLLSSAQTEATSIERLVPRDLYNKIFIHKDNTACPANGFYTYESFVQATRRFPRFGSVGSPVTQRLEVAAFLAQISHETTGGWATAPDGPYAWGLCFKEEVSPQSTYCDSSNTQWPCFPNKTYQGRGPIQLSWNYNYGPAGRALGFDGLRNPETVSNNSVIAFQTALWFWMTPQSPKPSCHDVMIGKYRPTAADLAANRTGGFGLTTNIINGGLECGIPGDGRVNDRIGFFQRYTGLFKVATGPNLDCENQRPYA

SEQ ID NO: 13043 - protein, 289 aa, Arabidopsis thaliana
  misc_feature: Ceres CLONE ID no. 27197
  misc_feature: The plant produces a reduced number of seeds.
  misc_feature: Useful for biocontainment applications
MANRYDPNPFAEEEEVNPFANARGVPPASNSRLSPLPPEPVGFDYGRTVDIPLDRAGTQDLKKKEKELQAKEAELKRREQDLKRKEDAAARAGIVIEVKNWPPFFPLIHHDIANEIPVHLQRLQYVTFATYLGLVLCLFWNIIAVTTAWIKGEGVTIWLLALIYFIAGVPGGYVLWYRPLYRAFRTDSALSFGWFFLFYMLHIAFCVFAAVAPPVVFKGKSLAGILPAIDVLSGQAIVGIFYFIGFAFFCLESVVSIWVIQQVYMYFRGSGKQDQMRREAARGALRAAV

SEQ ID NO: 13044 - protein, 173 aa, Zea mays
  misc_feature: Ceres CLONE ID no. 272716
  misc_feature: Useful for making plants with altered terpenoid content
MLAHRLLLLLAVAAASGTAFAKPTAYEALADYDFPPGILPKGVVAYTLDNATGAFTATLDASASGSGSSVCEFSIQGSYSLRYQTKITGKIAPDHLTDLEGVSVKVLFFWLNIVEVTRRGDNLEFSVGIVSADFGIENFLECPTCGCGFDCNNLLMLQKPGAATAKLRLRGAF

SEQ ID NO: 13045 - protein, 161 aa, Arabidopsis thaliana
  misc_feature: Ceres CLONE ID no. 27375
  misc_feature: Useful for making plants with modulated oxidative stress sensitivity
MSSSGAPSRKTLSKIATNRLQKELVEWQMNPPTGFKHKVTDNLQRWIIEVIGAPGTLYANDTYQLQVDFPEHYPMESPQVIFLHPAPLHPHIYSNGHICLDILYDSWSPAMTVSSICISILSMLSSSTEKQRPTDNDRYVKNCKNGRSPKETRWWFHDDKV

SEQ ID NO: 13046 - protein, 263 aa, Zea mays
  misc_feature: Ceres CLONE ID no. 274627
  misc_feature: Useful for making plants with altered alkaloid content
TIMSRYCVNEQSSTRPHPASAGSWHGSTPAGSSPSNLKQATTGKEQLGGGCCSAARLRVRDDDMGRGRSEIKRIENPTQRQSTFYKRRDGLFKKARELAVLCDVDLLLLLFSGSGKLYHYLSPTVPTVKDLVERYEAATHSKVWADVRQERRAELEKAERMCELMEKELRFMTVDDGEQYTVPSLELLEHSLEAAVHRVRSEKDRKIGGEIDCLQNIIRGRHEERYGLCDKLAHSQAWNNGGEGGGSTPPSGGGGLELKLGFN

SEQ ID NO: 13047 - protein, 63 aa, Arabidopsis thaliana
  misc_feature: Ceres CLONE ID no. 27485
  misc_feature: Useful for making plants with modulated nitrogen use efficiency
MKKIEDNNTLVFIVDIRADKKKIKDAVKKMYDIQTKKVNTLIRYFKEYFSMKPCCEIDYVQYI

SEQ ID NO: 13048 - protein, 166 aa, Arabidopsis thaliana
  misc_feature: Ceres CLONE ID no. 27635
  misc_feature: Useful for making plants with altered alkaloid content
MAPTVKTAAVKTNEGNGVRYRGVRKRPWGRYAAEIRDPFKKSRVWLGTFDTPEEAARAYDKRAIEFRGAKAKTNFPCYNINAHCLSLTQSLSQSSTVESSFPNLNLGSDSVSSRFPFPKIQVKAGMMVFDERSESDSSSVVMDVVRYEGRRVVLDLDLNFPPPPEN

SEQ ID NO: 13049 - protein, 135 aa, Zea mays
  misc_feature: Ceres CLONE ID no. 276809
  misc_feature: Useful for making plants with modulated nitrogen use efficiency
  misc_feature: Useful for making plants with modulated nitrogen use efficiency
MAPPPLSSWPWASLGQYKYVLLGPLVWKVLQEWREQAGLPLGSWWLHLLLLFAARGLTYQFWFSYGNMLFFTRRRRVVADGVDFRQIDAEWDWKKILWIPPPNNQPWSPSDTGNAQAHLAGIGRLFFLRLVPAFG

SEQ ID NO: 13050 - protein, 311 aa, Arabidopsis thaliana
  misc_feature: Ceres CLONE ID no. 27793
  misc_feature: Useful for making plants with altered terpenoid content
MRTGKRNQEEEDYGEEDFNSKREGPSSNTTVHSNRDSKENDKASAIRSKHSVTEQRRRSKINERFQILRELIPNSEQKRDTASFLLEVIDYVQYLQEKVQKYEGSYPGWSQEPTKLTPWRNNHWRVQSLGNHPVAINNGSGPGIPFPGKFEDNTVTSTPAIIAEPQIPIESDKARAITGISIESQPELDDKRLPPLQPILPMVQGEQANECPATSDGLGQSNDLVIEGGTISISSAYSHELLSSLTQALQNAGIDLSQAKLSVQIDLGKRANQGLTHEEPSSKNPLSYDTQGRDSSVEEESEHSHKRMKTL

SEQ ID NO: 13051 - protein, 273 aa, Zea mays
  misc_feature: Ceres CLONE ID no. 278992
  misc_feature: Bushy plant with varying petiole angles, abnormal phyllotaxy, leafnumber higher than wild-type
  misc_feature: The plant is abnormally small.
  misc_feature: Useful for making plants with modulated biomass
MTNLSAMAASQSYVIRFDGHFDEPSPSSAGAEPPGPQPPFAGRMISLEREHQVIVAALLHVVSGYATPPPQVFTPPPAAARCQVCGMERCLGCEFFAAGEGALGGGAEKAAATGGAAALAAGQRRRRKKKNKYRGVRQRPWGKWAAEIRDPRRAVRKWLGTFDTAEEAARAYDQAAIEFRGPRAKLNFPFPEQPPTGHDEPISSNGDASAAARSSDTTPSPSLCSADAEERGQPEWPSAGQEAGDQLLWEGLQDLMRLDEGEPWLHPASSAWN

SEQ ID NO: 13052 - protein, 269 aa, Zea mays
  misc_feature: Ceres CLONE ID no. 280814
  misc_feature: Useful for making plants with altered Lignin content
MATAVEVPVEAPVRTVKVTNVSLSATVQDIKEFFSFSGDIDHVEMQSGDEWSQVAYVTFKDAQGAETALLLSGATIVDLSVIIAPAPEHQPPPTASAPPMSGTRVPVGGGDNNVVHKAEDVVSTMLAKGFVLGKDAVGKAKAFDEKHGFTSTAGATVASIDKKIGLTDKITTGTSLVSGKVKEMDQKFQVSDKTKSALAAAEQKVSSAGSAIMKNRYVFTGASWVTSAFNKVAKTATDVGTMTKEKMAAEEHHKGSGPSSGGHSYTPIR

SEQ ID NO: 13053 - protein, 140 aa, Arabidopsis thaliana
  misc_feature: Ceres CLONE ID no. 2835
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
MMNIDDTTSPMAHPIGPSQPPSDQTKQDPPSLPQEAASSVSADKKDLALLEEKPKQSQEEDRVDTGRERLKKHRREIAGRVWIPEIWGQEELLKDWIDCSTFDTCLVPAGISSARTALVEEARRAASASGGLHNRCLILR

SEQ ID NO: 13054 - protein, 301 aa, Zea mays
  misc_feature: Ceres CLONE ID no. 283597
  misc_feature: Useful for making plants with altered terpenoid content
METSKSPQSSKNSHIVVPSDSNGPRFDNDGFSSEAASNQMVVFNSEAGDKEQDELGENRLQKSIITRGISPSIGAFTVQCAKCFKWRLIPTKEKYEEIRERIIEEPFVCKRAREWRPDVTCNDPEDISQDGSRLWAIDKPNIAQPPRGWERQIRIRGEGGTKFADVYYTSPTGRKLRSLVEVDRFLQENPEYGAQGVTLAQFSFQIPRPLRQDYVKKKPKLINPSDEASMIASKSFQPEEVKPIAWAVATKHEGDASEEASLTDEAPTSEVMLARKRKAGSSLSIEPNHLSDELEPKLEDA

SEQ ID NO: 13055 - protein, 173 aa, Arabidopsis thaliana
  misc_feature: Ceres CLONE ID no. 28528
  misc_feature: The plant is abnormally small.
  misc_feature: Useful for making plants with modulated biomass
MAPLQRTISDISHQISIDNTLTKEPSPTATATTLLSLSAISEVEDAKCECCGMSEECTPEYIHRVRSKFSGKLICGLCEKAVEGEMEKMNNSEVLMEKRREEAVKVHMSACSRFNRLGRSYPVLYQAEAVKEMLKKRSKKMVVATKPEKGGLARSSSCMPALAKELKDRTLVN

SEQ ID NO: 13056 - protein, 287 aa, Zea mays
  misc_feature: Ceres CLONE ID no. 286402
  misc_feature: Useful for making plants with altered terpenoid content
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAIKYNKAVQEEDELPPEKLAIANVGRQDAKKHLEEHVL

SEQ ID NO: 13057 - protein, 151 aa, Arabidopsis thaliana
  misc_feature: Ceres CLONE ID no. 28832
  misc_feature: Useful for making plants with modulated heat sensitivity
MASSSSRGEMEKMGIDQLKALKEQADLEVNLLQDSLNNIRTATVRLDAAAAALNDLSLRPQGKKMLVPLTASLYVPGTLDEADKVLVDIGTGYFIEKTMDDGKDYCQRKINLLKSNFDQLFEVAAKKKSVADEAGMVLQAKVKQLTAATTS

SEQ ID NO: 13058 - protein, 123 aa, Arabidopsis thaliana
  misc_feature: Ceres CLONE ID no. 2898
  misc_feature: Useful for making plants with altered Lignin content
MVYDVTRRDTFTNLSDIWAKEIDLYSTNQDCIKMLVGNKVDKESERAVSKKEGIDFAREYGCLFLECSAKTRVNVEQCFEELVLKILETPSLTAEGSSGGKKNIFKQNPAQTTSTSSSYCCSS

SEQ ID NO: 13059 - protein, 142 aa, Arabidopsis thaliana
  misc_feature: Ceres CLONE ID no. 29009
  misc_feature: The plant is abnormally small.
  misc_feature: Useful for making plants with modulated biomass
MTDLQMEVEVDTNSSLQESLPKPQVMYRCKKCRRIVAIEENIVPHEPGKGEECFAWKKRSGNSEQVQCSSIFVEPMKWMQTIHDGVVEEKLLCFGCNGRLGYFNWAGMQCSCGAWVNPAFQLNKSRIDECKSEPNPNLNMET

SEQ ID NO: 13060 - protein, 377 aa, Zea mays
  misc_feature: Ceres CLONE ID no. 292789
  misc_feature: The plant is abnormally small.
  misc_feature: Useful for making plants with modulated biomass
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPAIVHRKCF

SEQ ID NO: 13061 - protein, 203 aa, Zea mays
  misc_feature: Ceres CLONE ID no. 293389
  misc_feature: The plant is abnormally large.
  misc_feature: Useful for making plants with modulated biomass
LPTPLFLSAELRKSPLVSPSPIPPAAADAPRLFKMNVEKLKKMAGAVRTGGKGSMRRKKKAVHKTATTDDKRLQSTLKRIGVNTIPGIEEVNIFKDDIVIQFQNPKVQASIPANTWVVSGVPQTKSLQDLLPTIINQLGPDNLENLKRLAEHFQKQVPGAEASASAAAQDEDDVPELVPGETFEEAAEVKEVPEAEPEEKKDS

SEQ ID NO: 13062 - protein, 267 aa, Arabidopsis thaliana
  misc_feature: Ceres CLONE ID no. 2942
  misc_feature: Useful for making plants with altered Lignin content
MAASANPSGNNQEGSSATQKVSSSSAAAANGAAVNSVDNGGNTGAAADNSQTIGALRHNPGISTDWTLEEQSLLEDLLVKYATEPSVFRYAKIAMKMKDKTVRDVALRCRWMTKKENGKRRKEDHSSRKSKDKKEKATDSSAKSSSHLNVHPNGPSYAPPMMPIDTDDGISYKAIGGVSGDLLEQNAQMFNQLSTNFSAFQVNSTSTFHLLHENVNILCKARDNILAILNDLNDMPEVMKQMPPLPVKLNEELANSILPRPSHQRKS

SEQ ID NO: 13063 - protein, 228 aa, Zea mays
  misc_feature: Ceres CLONE ID no. 297374
  misc_feature: Useful for making plants with altered alkaloid content
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDQQFLEQINDLERKSTQLAEENMQLRNQVSQIPPAGKQAVADTENVIAEEGQSSESVMTALHSGSSQDNDDGSDVSLKLGLPCVAWK

SEQ ID NO: 13064 - protein, 247 aa, Zea mays subsp. mays
  misc_feature: Ceres CLONE ID no. 297380
  misc_feature: Useful for making plants with modulated nitrogen use efficiency
MAAAISLEAGGALAHDLGSAVVTGGVALALLKFFEELAKRGVFEQKLSRKLVHISVGLVFMLFWPLFSSGWYTPFLAALAPGVNIIRMLLLGLGLMKNEAMVKSMSRSGDYRELLKGPLYYAATITFATSLLWRTSPVAIALICNLCAGDGIADVVGRRLGKEKLPYNPNKSYAGSIAMAVAGFLASVGYMHYFHTFGFIEETWYMALSFLVVSVAAALVESHPISTELDDNLTVLLTSFLVGSLIF

SEQ ID NO: 13065 - protein, 286 aa, Arabidopsis thaliana
  misc_feature: Ceres CLONE ID no. 3000
  misc_feature: Abnormal phyllotaxy, leaf number higher than wild-type
  misc_feature: No seed is being produced by the plant
  misc_feature: The plant is abnormally small.
  misc_feature: The plant produces a reduced number of seeds.
  misc_feature: There is no branching.
  misc_feature: Useful for biocontainment applications
  misc_feature: Useful for making plants with modulated biomass
MEIHHNEIVAGGINPCSSSSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLGNPFPMDHISSTML

SEQ ID NO: 13066 - protein, 391 aa, Arabidopsis thaliana
  misc_feature: Ceres CLONE ID no. 3036
  misc_feature: The plant flowers significantly late compared to wild-type.
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: Useful for making plants with modulated flowering time
MAEVEEIAHEEQNIEKREKKKGKHEKPKPWDDDPNIDRWTIEKFDPAWNPTGMTETSTFSTLFPQYREKYLQECWPRVESALKEYGVACKLNLVEGSMTVSTTRKTRDPYIIVKARDLIKLLSRSVPAPQAIKILEDEVQCDIIKIGNLVRNKERFVKRRQRLVGPNSSTLKALEILTNCYILVQGSTVAAMGPFKGLKQLRRIVEDCVQNIMHPVYHIKTLMMKKELEKDPALANESWDRFLPTFRKKNVKQKKPKSKEKKPYTPFPPPQPPSKIDMQLESGEYFMRDKKKSEKKWQEKQEKQSEKSTENKRKRDASFLPPEEPMNNNSNANKSEDGKNDITELTNSLKSKTKELKKQKKTHERVNAEEYIAGPSSSADKSSKKSKKIRD

SEQ ID NO: 13067 - protein, 298 aa, Zea mays
  misc_feature: Ceres CLONE ID no. 304523
  misc_feature: Useful for making plants with altered terpenoid content
MASSKRRFGAAGGADKKDLFHVVHKVPAGDSPYVVAKHLQLVEKQPDVAIVWFWKAINSGDRVDSALKDMAMVMKQQDRSEEAIEAIRSFRHLCSKQAQESLDNLLIDLYKKCGKVEEQIELLKQKLKSIYLGEAFNGKATKKARSHGKKFQVSIQQETSRILGNLGWAYMQQNNFEAAELVYRKAQAIEPDANRACNLGLCLIKQGRHEEARQALEDVRLRRIYGSEDAKVVARAEQLLRELNPLQCVSSPFQVGLSVHEGIMGEPDLVVMNEWTPFRSRRLPVFEEIATFRDQMAC

SEQ ID NO: 13068 - protein, 84 aa, Zea mays
  misc_feature: Ceres CLONE ID no. 304947
  misc_feature: Useful for making plants with altered alkaloid content
MLPAEFEITDCCHPCDSDKENVLAIQVMRWSDGSYLEDQDHWRLSGSLSDNFFAIIVPTEYDCLTASTRKKEIVDVIVKAFKST

SEQ ID NO: 13069 - protein, 334 aa, Zea mays
  misc_feature: Ceres CLONE ID no. 306139
  misc_feature: Useful for making plants with altered Lignin content
MEYPATAAGSGSHKYYYPQQHSHSQPQALRRPPRPAARWVKQWIPQDLASSGGKCSLFKWVREDGYRNSKDNPRVLDVEAPKPEPTTEILFLCSYENCGKTFVDVSALRKHASVHNEKQYICNEPNCGKKFVDSSKLKRHYLTHTGQKDFVCPHPGCGKAFSLDFNLRSHLKTHALENYHICPFPACGKRFTSDFKLGAHVKSHEKTGTPIAVQHAPAPPAEKPRVAPKPPTPATTSYADRPYVCPYEGCDKAYIHSYKLNLHLKTQHPEHGQEENGKVGASGGQHAANEHTYQYNYAEVGEIAPNPKKEQDESWAQGPLIQSLQCQGFESNAF

SEQ ID NO: 13070 - protein, 267 aa, Zea mays
  misc_feature: Ceres CLONE ID no. 306497
  misc_feature: Useful for making plants with altered alkaloid content
  misc_feature: Useful for making plants with altered terpenoid content
MFPSLIHHASHGRPDVAVAEDAPRSGCGLGLPGHGGGPSVVLTADPKPRLRWTADLHDRFVDAVAQLGGPDKATPKAIMRTMGVKGLTLFHLKSHLQKYRLGRQSGKELTEQSKDASYLMEAQSGTTLSPRGSTPDVKESQEVKEALRAQMEVQRRLHEQVEVQKHMQIRMEANQKYIDTILDKAFKIVSEQLSGFSISDQDLPILTSARAMLSPADHLSSSVFPQLSVSSVSLHNPGPGGGKGLPHVADSHVFSQRPPEQFKRKSR

SEQ ID NO: 13071 - protein, 206 aa, Arabidopsis thaliana
  misc_feature: Ceres CLONE ID no. 30737
  misc_feature: Useful for making plants with modulated nitrogen use efficiency
MPRSSRWVNQRATSKIKKFILFLGVAFVFYLYRYPSSPSTVEQSSTSIYNISVKDIEGKDVSLSKFTGKVLLIVNVASKCGLTHGNYKEMNILYAKYKTQGFEILAFPCNQFGSQEPGSNMEIKETVCNIFKAEFPIFDKIEVNGKNTCPLYNFLKEQKGGLFGDAIKWNFAKFLVDRQGNVVDRYAPTTSPLEIEKDIVKLLASA

SEQ ID NO: 13072 - protein, 162 aa, Arabidopsis thaliana
  misc_feature: Ceres CLONE ID no. 30753
  misc_feature: Useful for making plants with modulated cold sensitivity
MGQVFNKLRGKEWRHKQVQAICDRVFDRFKMQTGRANLTFEELYIAVLLVYNDINKRLPGPHFDPPSKDLVNSIMTDCDINLDGELDREEFVKFIEQITAETFNVVSQGLIIALIVAPTVAIATKKATEGVPGVGKVVQKLPTSIYASLVTLAVMWVNSDSS

SEQ ID NO: 13073 - protein, 162 aa, Arabidopsis thaliana
  misc_feature: Ceres CLONE ID no. 31044
  misc_feature: The plant is abnormally small.
  misc_feature: Useful for making plants with altered Lignin content
  misc_feature: Useful for making plants with modulated biomass
MAARAHDVAALAIKGTTAYLNFPKLAGELPRPVTNSPKDIQAAASLAAVNWQDSVNDVSNSEVAEIVEAEPSRTVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 13074 - protein, 216 aa, Arabidopsis thaliana
  misc_feature: Ceres CLONE ID no. 3115
  misc_feature: Useful for making plants with modulated oxidative stress sensitivity
MAVAPARARSDYDYLIKLLLIGDSGVGKSCLLLRFSDDTFTTSFITTIGIDFKIRTVELDGKRIKLQIWDTAGQERFRTITTAYYRGAMGILLVYDVTDESSFNNIRNWMKNIEQHASDNFNKILVGNKADMDESKRAVPTAKGQALADEYGIKFFETSAKTNLNVENVFMSIAKDIKQRLTETDTKAEPQGIKITKQDTAASSSTAEKSACCSYV

SEQ ID NO: 13075 - protein, 188 aa, Zea mays
  misc_feature: Ceres CLONE ID no. 311714
  misc_feature: Useful for making plants with modulated oxidative stress sensitivity
MSRQRTESFSPSPSLDVCKQILPVLDKFGAAMAIVKSDIGGNITRLENKYTSEPSKYEHLYSMIQEEVQNKTAKGSSSCTNGLLWLTRAMDFLVELFRNLLEHPDWAMSQSCTDSYTKTLKKFHGWLASSSFTVAMKLAPNREKFMEVISGTGDINADIEKFCTTFSPFLKENHNFLASVGLDDLKAS

SEQ ID NO: 13076 - protein, 223 aa, Zea mays
  misc_feature: Ceres CLONE ID no. 312833
  misc_feature: Useful for making plants with altered Lignin content
MARRPASWEQGGDEYDYLFKVVLIGDSGVGKSNLLSRFTKNTFALDSKSTIGVEFATRTLQVENKIIKAQIWDTAGQERYRAITSAYYRGAVGALLVYDVTKVMTFENVKRWLKELRDHADSNIVVMLIGNKTDLRHLRSVAVEDAASFAESEGLFFIETSALDATNVEKAFHTVLAEIYRIISKKPLSSEESGLGSGNLREGQSIQVSATNSGALTSRCCSS

SEQ ID NO: 13077 - protein, 125 aa, Arabidopsis thaliana
  misc_feature: Ceres CLONE ID no. 31322
  misc_feature: Useful for making plants with altered Lignin content
  misc_feature: Useful for making plants with altered alkaloid content
  misc_feature: Useful for making plants with altered terpenoid content
MKDNQTEVESRSTDDRLKVRGNKVGKKTKDPNRPKKPPSPFFVFLDDFRKEFNLANPDNKSVGNVGRAAGKKWKTMTEEERAPFVAKSQSKKTEYAVTMQQYNMELANGNKTTGDDEKQEKAADD

SEQ ID NO: 13078 - protein, 270 aa, Arabidopsis thaliana
  misc_feature: Ceres CLONE ID no. 31361
  misc_feature: Useful for making plants with modulated nitrogen use efficiency
  misc_feature (77)..(77): Xaa is any aa, unknown, or other
MESAKSIIGGHQNVILMRHGDRLDNFEPLWTSTAARPWDPPLAQDGKDRAFRTGQRIRSQLGVPIHRVFVSPFLRCXQTASEVVAALSAVDFDPIAMSSKDVLSIDNTKIKVAIEFGLSEIPHPIFIKSEVAPKDGKFDFKISDLEAMFPEGTVDSNVDMVYKEVPEWGESAQAFEDRYYKTVKILAEKYPSENLLLVTHWGAVSVAFYNYFKDATKYVVDYCGSVEMRRQILNGDGFGKFEVVTSHGVSYKYTKIPVHDHVVVSRQSPL

SEQ ID NO: 13079 - protein, 169 aa, Arabidopsis thaliana
  misc_feature: Ceres CLONE ID no. 3137
  misc_feature: Useful for making plants with modulated nitrogen use efficiency
MTFFIEDTSLIISHVLYKTALIITVLRWIFAWILRYRSRSSSSSSSSSQSSSSPSISSQTIKESLAVFAFRDAVERSPAAINDMCAVCLGDLEDEDEIRELRNCTHVFHRDCIDRWLDYECCGGDDDNHRTCPLCRTPLLPSFTDYSTVTQTSWAVERLLYLFGDDLLP

SEQ ID NO: 13080 - protein, 73 aa, Arabidopsis thaliana
  misc_feature: Ceres CLONE ID no. 314
  misc_feature: The plant flowers significantly late compared to wild-type.
  misc_feature: Useful for making plants with modulated flowering time
MAKPLGTTGEFFRRRDEWRKHPMLSNQMRHALPGLGIGVAAFCVYLVGEQIYNKALAPSKSSHHHQEQTAPSH

SEQ ID NO: 13081 - protein, 94 aa, Zea mays
  misc_feature: Ceres CLONE ID no. 316638
  misc_feature: Useful for making plants with altered terpenoid content
MGQAFRKLFDSFFGTSEMRVVMLGLDAAGKTTILYKLHIGEVLSTVPTIGFNVEKVQYKNVMFTVWDVGGQEKLRVTTSAKEMSLGISPLEGVQ

SEQ ID NO: 13082 - protein, 221 aa, Arabidopsis thaliana
  misc_feature: Ceres CLONE ID no. 31969
  misc_feature: Useful for making plants with modulated drought sensitivity
MAGFLSVVRRVYLTLYNWIVFAGWAQVLYLAITTLKETGYENVYDAIEKPLQLAQTAAVLEILHGLVGLVRSPVSATLPQIGSRLFLTWGILYSFPEVRSHFLVTSLVISWSITEIIRYSFFGFKEALGFAPSWHLWLRYSSFLLLYPTGITSEVGLIYLALPHIKTSEMYSVRMPNILNFSFDFFYATILVLAIYVPGSPHMYRYMLGQRKRALSKSKRE

SEQ ID NO: 13083 - protein, 134 aa, Zea mays
  misc_feature: Ceres CLONE ID no. 319760
  misc_feature: Useful for making plants with altered terpenoid content
  misc_feature (21)..(21): Xaa is any aa, unknown, or other
  misc_feature (36)..(36): Xaa is any aa, unknown, or other
  misc_feature (40)..(40): Xaa is any aa, unknown, or other
  misc_feature (41)..(41): Xaa is any aa, unknown, or other
  misc_feature (44)..(44): Xaa is any aa, unknown, or other
  misc_feature (45)..(45): Xaa is any aa, unknown, or other
  misc_feature (48)..(48): Xaa is any aa, unknown, or other
  misc_feature (49)..(49): Xaa is any aa, unknown, or other
  misc_feature (50)..(50): Xaa is any aa, unknown, or other
  misc_feature (58)..(58): Xaa is any aa, unknown, or other
  misc_feature (60)..(60): Xaa is any aa, unknown, or other
  misc_feature (63)..(63): Xaa is any aa, unknown, or other
  misc_feature (64)..(64): Xaa is any aa, unknown, or other
MEVVEGAVAGGSTLTVVLPTXGAAVEGTEAVVALVXTSAXXGNXXAAXXXAGLWGFPXWXPDXXSEYVKLFVGSVPRTATEEDVRPLFEEHGDVLEVALIKDRKTGEQQGMLCLCFSCIITIEYLFCFQVSERL

SEQ ID NO: 13084 - protein, 348 aa, Arabidopsis thaliana
  misc_feature: Ceres CLONE ID no. 32143
  misc_feature: Useful for making plants with modulated nitrogen use efficiency
MKATLAAPSSLTSLPYRTNSSFGSKSSLLFRSPSSSSSVSMTTTRGNVAVAAAATSTEALRKGIAEFYNETSGLWEEIWGDHMHHGFYDPDSSVQLSDSGHKEAQIRMIEESLRFAGVTDEEEEKKIKKVVDVGCGIGGSSRYLASKFGAECIGITLSPVQAKRANDLAAAQSLSHKASFQVADALDKPFEDGKFDLVWSMESGEHMPDKAKFVKELVRVAAPGGRIIIVTWCHRNLSAGEEALQPWEQNILDKICKTFYLPAWCSTDDYVNLLQSHSLQDIKCADWSENVAPFWPAVIRTALTWKGLVSLLRSGMKSIKGALTMPLMIEGYKKGVIKFGIITCQKPL

SEQ ID NO: 13085 - protein, 454 aa, Arabidopsis thaliana
  misc_feature: Ceres CLONE ID no. 32361
  misc_feature: Useful for making plants with modulated oxidative stress sensitivity
MASVVLRNPSSKRLVPFSSQIYSRCGASVTSSYSISHSIGGDDLSSSTFGTSSFWRSMATFTRNKPHVNVGTIGHVDHGKTTLTAAITKVLAEEGKAKAIAFDEIDKAPEEKKRGITIATAHVEYETAKRHYAHVDCPGHADYVKNMITGAAQMDGGILVVSGPDGPMPQTKEHILLARQVGVPSLVCFLNKVDVVDDPELLELVEMELRELLSFYKFPGDDIPIIRGSALSALQGTNDEIGRQAILKLMDAVDEYIPDPVRVLDKPFLMPIEDVFSIQGRGTVATGRIEQGVIKVGEEVEILGLREGGVPLKSTVTGVEMFKKILDNGQAGDNVGLLLRGLKREDIQRGMVIAKPGSCKTYKKFEAEIYVLTKDEGGRHTAFFSNYRPQFYLRTADITGKVELPENVKMVMPGDNVTAVFELIMPVPLETGQRFALREGGRTVGAGVVSKVMT

SEQ ID NO: 13086 - protein, 128 aa, Arabidopsis thaliana
  misc_feature: Ceres CLONE ID no. 32470
  misc_feature: Useful for making plants with modulated oxidative stress sensitivity
MGISKALRSLLILLLLNITFFFGHVTPGATVKPCPPPPAKQATTKCPRDTLKFGVCGSWLGLVSEVIGTPPSQECCSLIKGLADFEAAVCLCTALKTSILGVAPVKIPVALTLLLNSCGKNVPQGFVC

SEQ ID NO: 13087 - protein, 159 aa, Arabidopsis thaliana
  misc_feature: Ceres CLONE ID no. 32567
  misc_feature: Useful for making plants with modulated nitrogen use efficiency
MSPNYSFFFFIFFLTSHSSVFSRILPETSTTTTSILNVADSIHRTKYTSSFRLNQQEEQTHSASSSFSLQLHSRVSVRGTEHSDYKSLTLARLNRDTARVKSLITRLDLAINNISKADLKPISTMYTTEEQGYRSSFNLRHDSRKWRVLHTRRYRKTGA

SEQ ID NO: 13088 - protein, 271 aa, Zea mays
  misc_feature: Ceres CLONE ID no. 325679
  misc_feature: Useful for making plants with altered Lignin content
MDHEEIKDIVRKFPAFAYYSVDRKIKPLVELLLELGVKNSSIPGIIKKRPQLCGISMSDNLKPMMAYLESIGVDKAQWSKVITRFPALLTYSRNKVQTTVSFLAELGVSEKSIGKILTRCPHIMSYSVDDNLRPTAAYFRSIGADAASLIQKSPQAFGLNVEAKLRPTTEFFLARGFSVEEVGVMANRFGIVHTLSLEENLLPKYEFFLAMEYPRCELVKFPQYFGYSLDRRIKPRYARMTGCGVRLILNQMLSVSDARFEKILEKKTARL

SEQ ID NO: 13089 - protein, 344 aa, Zea mays
  misc_feature: Ceres CLONE ID no. 325800
  misc_feature: Useful for making plants with altered Lignin content
  misc_feature: Useful for making plants with altered alkaloid content
MFPSSKKQASTGAANPNDRPMCGQGGDSGGLVLTTDPKPRLRWTPELHDRFVDAVAQLGGPDKATPKTIMRVMGVKGLTLYHLKSHLQKFRLGKQHKELGDHTAMEMQRSVASSSGMIARSMNDRSVNVNEALRIQMEVQRRLHGELEVQKHLQMRVEAQGKYMQSIVEKAYQALGSSDCATWPAGYRTLGSQGVLDIGTSSTSFSSVQDLQCFYGGSSHMDQLLHQMERPMDGFLTLGESCFIGSADNKKDPNNHCSSSGKSSMMWASEEQQAKSGNDQLQMGSSTRMEGAGIDVMDPVVTGLYEGAVSGDSMDSKGFEGSNSRLEMKPPAQQAPVGSQRIRI

SEQ ID NO: 13090 - protein, 73 aa, Arabidopsis thaliana
  misc_feature: Ceres CLONE ID no. 32612
  misc_feature: The plant is abnormally small.
  misc_feature: Useful for making plants with modulated biomass
MAAEFDGKIESKGLNPGLIVLLVIGGLLLTFLVGNFILYTYAQKNLPPRKKKPVSKKKMKKEKMKQGVQVPGE

SEQ ID NO: 13091 - protein, 117 aa, Arabidopsis thaliana
  misc_feature: Ceres CLONE ID no. 32647
  misc_feature: Useful for making plants with modulated heat sensitivity
MDSSKLSSLSLCLFLICIIYLPQHSLACGSCNPRKGGKHSPKAPKLPVPPVTVPKLPVPPVTVPKLPVPPVTVPKLPVPPVTIPKLPVPPVTVPKLPVPPVTVPKLPVPPVTVPKLP

SEQ ID NO: 13092 - protein, 239 aa, Arabidopsis thaliana
  misc_feature: Ceres CLONE ID no. 32754
  misc_feature: Useful for making plants with altered Lignin content
MADSPQRRRDSRSPSPRKERARSRSRSRSRSRSRPRLRSRSRSLPRPVSPSRSRGRSRSRSRGRSEVENPGTTLYVTGLSTRVTDKDLEAHFAKEGKVASCFLVMEPRTRVSRGFAFVTMSSLKDAERCIKYLNQSVLEGRYITVERSRRKRPRTPTPGHYLGLKSSRDSDREGRSSRGRHYDRDDYRDRRSPRRDYSPRDERRSRRDRSYSPHGRSPERRSERRSERSERRYEPRGSR

SEQ ID NO: 13093 - protein, 384 aa, Arabidopsis thaliana
  misc_feature: Ceres CLONE ID no. 33016
  misc_feature: Useful for making plants with altered Lignin content
MEMMSSSSSTTQVVSFRDMGMYEPFQQLSGWESPFKSDINNITSNQNNNQSSSTTLEFDARPEADDNNRVNYTSVYNNSLEAEPSSNNDQDEDRINDKMKRRLAQNREAARKSRLRKKAHVQQLEESRLKLSQLEQELVRARQQGLCVRNSSDTSYLGPAGNMNSGIAAFEMEYTHWLEEQNRRVSEIRTALQAHIGDIELKMLVDSCLNHYANLFRMKADAAKADVFFLMSGMWRTSTERFFQWIGGFRPSELLNVVMPYVEPLTDQQLLEVRNLQQSSQQAEEALSQGLDKLQQGLVESIAIQIKVVESVNHGAPMASAMENLQALESFVNQADHLRQQTLQQMSKILTTRQAARGLLALGEYFHRLRALSSLWAARPREHT

SEQ ID NO: 13094 - protein, 228 aa, Zea mays
  misc_feature: Ceres CLONE ID no. 331626
  misc_feature: Useful for making plants with altered terpenoid content
MARGKVQLRRVENPVHRQVTFCKRRAGLLKKARELSVLCDASVGIIVFSAHGKLYDLATTGTMEELIERYKAASAGEATTDGCGRHNRMDPKHETTVLQQEINLLQKGLRYIYGNRANEHMNVDELNALERYLEIWMYNTRSAKMQIMAQEIQALKSKEGMLKAANEILQEKIVEQSSLLDVGMVVADQQNGRFSTVPLVEEVISSNPLTILSGYSSCRGSEMGYSFC

SEQ ID NO: 13095 - protein, 93 aa, Zea mays
  misc_feature: Ceres CLONE ID no. 331755
  misc_feature: Useful for making plants with altered Lignin content
MASMSLSSSRAQWTAKQNKLFEQALAVYDRDTPDRWHNIARAVGGKSADEVRRYYELLVKDLEHIEAGKVAFPAYRCPGGYDDADSDRLKHLT

SEQ ID NO: 13096 - protein, 127 aa, Zea mays
  misc_feature: Ceres CLONE ID no. 333753
  misc_feature: Useful for making plants with altered Lignin content
  misc_feature: Useful for making plants with altered terpenoid content
MKSRARSGGGDSRLSVRKTKVEKDPNKPKRPPTTFFVFMEEFRKDYKEKHPNVKQVSVIGKAGGDMWKSLSDAEKAPYVSKAEKLKVEYTKKMDAYNNKQSGGGPTLSGDSDKSKSEVNDGDEEGDE

SEQ ID NO: 13097 - protein, 310 aa, Arabidopsis thaliana
  misc_feature: Ceres CLONE ID no. 33498
  misc_feature: Useful for making plants with altered alkaloid content
MAAKEGSRIFVGGLSPEVTDRDLERAFSRFGDILDCQIMLERDTGRSRGFAFITFADRRAMDESIREMHGRDFGDRVISVNRAEPKLGRDDGESHGSRGGRDSGYSIAGKGSFGGGGGGGGRVGEDECFKCGRVGHWARDCPSAGGGRGGPVGGFSSRASAYGGSDGRVDRYADRDRYVDRERYIDDRYDGAARYGARDRFDSREAYIPRDRYASDRYAAPADRFAGGDRYSRGSDRYPPGSYDKARSFERDIAPSAGSDRYGGGRAGGPIRGGGEEGRGFRSRAGAPYERPSRSGGGGAYPSSSTFDRY

SEQ ID NO: 13098 - protein, 475 aa, Zea mays
  misc_feature: Ceres CLONE ID no. 335011
  misc_feature: Useful for making plants with altered terpenoid content
METSSAPAAATEAGWYVLGPNQEGVGPYALAELREHFANGYFNESTMLWAEGRKEWMPLSSISELHSAVAAKDQSEQDAPDVDDDFEKFQKEVIEAETEVKALKGNDVDQQDDERPATPPDGEEEFTDDDGTIYKWDRTLRAWVPQNDASGSKEDYAVEEMTFAVEEEIFQAPDILGPALEEINNLPESKNKGSDKAEMRGDKKRKSYENPAEKKEANKPPDSWFDLKVNTHVYVTGLPDDVTVEEIVEVFSKCGIIKEDPETKKPRVKIYTDRETGRKKGDALVTYFKEPSVALAVQLLDGTPFRPGGKTHMSVSPAKFEQKGDVFVSKKTDKQKKRKIKKVEDKMLGWGGHDDKKLMIPATVILRHMFTPAELRADEELLPELEADVREECIKFGPVDNVKVCENHPQGVILVRFKDRKDGAKCIEKMNGRWFAGRQIHASEDDGSVNHALIRDYDAEVSRLDRFGQELEEST

SEQ ID NO: 13099 - protein, 300 aa, Arabidopsis thaliana
  misc_feature: Ceres CLONE ID no. 33511
  misc_feature: Useful for making plants with modulated heat sensitivity
  misc_feature (288)..(288): Xaa is any aa, unknown, or other
  misc_feature (289)..(289): Xaa is any aa, unknown, or other
MVLLLRYRSLTINLTPLIPKSQKFHTLQSFRNPNFISIPKISASTNNPTTTTNRSISDATKFAKSVLFIPPGVEIEELTDDMVLPGSNIVIGPFAGHSQIKEVEFVKSSARARDCPKDDRPEIAILGRSNVGKSSLINCLVRKKEVALTSKKPGKTQLINHFLVNKSWYIVDLPGYGFAKVSDAAKTDWSAFTKGYFLNRDSLVCVLLLIDASVPPQKIDLDCANWLGRNNVPMTFVFTKCDKMKATKGKRPDENIKAFQQIIRENFKVHPPWILTSSVSGLGRDELXXHMSQLRNYWDQ

SEQ ID NO: 13100 - protein, 217 aa, Zea mays subsp. mays
  misc_feature: Ceres CLONE ID no. 335348
  misc_feature: Useful for making plants with modulated salt sensitivity
MGKKGKWFGAVKKVFSPESKEKKEESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 13101 - protein, 390 aa, Zea mays
  misc_feature: Ceres CLONE ID no. 335797
  misc_feature: The plant flowers significantly late compared to wild-type.
  misc_feature: Useful for making plants with modulated flowering time
MAEQWWGSASHRSHGTSACSAAAPPPLTVTGRVACGSTFPTAAVESTSSVTFQDPYRSSTHQPLSDAASSLGDPHLDWTQTFLSGRSDASFQAVLQEPSATNDPLIRDHMDMGAGFLADQAQLAPSPYGDTEPSQAQALFDATAAVHNILMYGDSESSVSYDAGAASMQFSQLLRTSVPASTPTPTQGDGVSVGVGAPMQYLSGSSYLPFGGPLPSHLLLQALQAAKPNSRSSNANSPSAKDDCSPPPAATRKSVSEPPAAAKRPRIEAPSPLPTFKVRKEKLGDRITALQQLVSPFGKTDTASVLHEAIEYIKFLHDQVASLSSPYLKNGIPMKQFQHKGSEDSKDNGDTKQADLRSRGLCLVPVASTYTVAAETPEFWHPTFGGTFRW

SEQ ID NO: 13102 - protein, 145 aa, Arabidopsis thaliana
  misc_feature: Ceres CLONE ID no. 3363
  misc_feature: No seed is being produced by the plant
  misc_feature: The plant flowers significantly late compared to wild-type.
  misc_feature: Useful for biocontainment applications
  misc_feature: Useful for making plants with modulated flowering time
MAKADKKPAEKKPAEKTPAAEPAAAAEKKPKAGKKLPKEPAVAGDKKKKRSKKNVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 13103 - protein, 315 aa, Zea mays
  misc_feature: Ceres CLONE ID no. 336323
  misc_feature: Useful for making plants with altered terpenoid content
  misc_feature (109)..(109): Xaa is any aa, unknown, or other
MQGGGGDQAGGSLGMGMGVGYAGGGGAECSSSSVAAAAAAAAAAAEAEERQLLKGEIAVHPLCEQLVAAHVGCLRVATPIDHLPLIDAQLAQSSGLLHSYAAHHSPFLXPHDKHDLDSFLAQYLMLLCSFREQLQQHVRVHAVEAVMACREIEQSLQDLTGVTLEEGTGATMSEEDEDEAPMLEVGLVDMGSDGHDMMGFGPLLPTDSERSLMDRVRQELKIELKQGFKSRIEDVREEILRKRRAGKLPGDTTSILKQWWQQHSKWPYPTEDDKARLVEETGLQLKQINNWFINQRKRNWHNNSQTSTLKSKRKR

SEQ ID NO: 13104 - protein, 271 aa, Zea mays
  misc_feature: Ceres CLONE ID no. 336888
  misc_feature: Useful for making plants with altered terpenoid content
MGDHLALIVDRLLTESTLEAAIGGGKHMVDLRQETVDVEYCHRGLGGGSATKVVECRICQEEDWDTCMEAPCACCGSLKYAHRKCIQRWCNEKGDTMCEICLQQFRPGYTSPQQLFHYGSIPMNFRGNWEIARQDLNDSQIITMMPTERDFMDNYDDYFPIRTRSSTLCCRTIAIIFMSLLVLRHTLPLVIGDNGEYSLALFSLLVLRTAGILFPILVMVRALASFHHRRRQQESQEAYISSSESEEEEEEYTVANSAQTNYSQPRFIPVY

SEQ ID NO: 13105 - protein, 241 aa, Zea mays
  misc_feature: Ceres CLONE ID no. 337432
  misc_feature: Useful for making plants with altered Lignin content
MGANGHPPASTVAQNGSHSGGGGGGGGGVNPSNGGTGAALRHDPGLAREWSTEEQTILDELLVKYASDLPVVRYAKVAMKLPEKTVRDVALRCRWMNKKESAKRKKEDHNSSKKSKDKKEKVSDSSSKPPVHMVGRPNVPPYPLPVLPMDDDEISSKAIGGPTGEILETNAHVLGQISSNLSNMQIQDNISLLCQTRDNILRVLKEINDAPDIMKQMPPLPVKINEELVNSLLPRPTVPMQ

SEQ ID NO: 13106 - protein, 282 aa, Arabidopsis thaliana
  misc_feature: Ceres CLONE ID no. 33802
  misc_feature: The plant produces a reduced number of seeds.
  misc_feature: Useful for biocontainment applications
  misc_feature (187)..(187): Xaa is any aa, unknown, or other
  misc_feature (193)..(193): Xaa is any aa, unknown, or other
  misc_feature (264)..(264): Xaa is any aa, unknown, or other
MAEKNASAVDGAIRVSGMQFSYDVQDPIFFDFNLDLPAGSRCLLVGANGSGKTTLLKILAGKHMVGGKNVVQVLDRSAFHDTELVCSGDLSYLGGSWSKTAGSAGDIPLQGDFSAEHMIFGVEGIDPFRREKLIDLLDINLQWRMHKVSDGQRRRVQICMGLLHPFKVLLLDEVTVDLDVVARMDLXEFFKEXCEQRGATIVYATHIFDGLETWASHLAYINGGELKLSAKLDEIKDLKTSPNLLSVVEAWLRSETKVEKKTKXKPVVTSPFMSSRQMAYYR

SEQ ID NO: 13107 - protein, 224 aa, Arabidopsis thaliana
  misc_feature: Ceres CLONE ID no. 33877
  misc_feature: Useful for making plants with modulated flowering time
MRQSHAKNDWQTIATSSLFLACKAEDEPCQLSSVVVASYEIIYEWDPSASIRIHQTECYHEFKEIILSGESLLLSTSAFHLDIELPYKPLAAALNRLNAWPDLATAAWNFVHDWIRTTLCLQYKPHVIATATVHLAATFQNAKVGSRRDWWLEFGVTTKLLKEVIQEMCTLIEVDRRRNMPPPPPPPRRELSWAIPAAVKPVHMARAYPFHGYPLQSYRQAGIW

SEQ ID NO: 13108 - protein, 345 aa, Zea mays
  misc_feature: Ceres CLONE ID no. 339439
  misc_feature: Useful for making plants with modulated nitrogen use efficiency
MGYLWRVRLSSFAAGAATASAAGFFLLYKDHLLARAADAESNSASYSPPLATADTAFSAPPRAVAPADLQLSGSYASDIYTYLRSLEVDPQRRSRSDYIEAVQADVTAHMRSILVDWLVEVAEEYKLVADTLYLTISYVDRFLSVNALGRDKLQLLGVASMLIAAKFEEISPPHPEDFCYITDNTYTKEELLKMESDILKLLKFELGNPTIKTFLRRFIRSAHEDKKGSILLMEFLGSYLAELSLLDYGCLRFLPSVVAASVMFVARLTIDPNTNPWNTKLQKMTGYKVSELKDCIVAIHDLQLNRKCPSLTAIRDKYKQHKFKCVSLILVPVVIPTSYFEDLAE

SEQ ID NO: 13109 - protein, 282 aa, Arabidopsis thaliana
  misc_feature: Ceres CLONE ID no. 34167
  misc_feature: Useful for making plants with altered alkaloid content
MMMGKEDLGLSLSLGFAQNHPLQLNLKPTSSPMSNLQMFPWNQTLVSSSDQQKQQFLRKIDVNSLPTTVDLEEEIGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 13110 - protein, 215 aa, Zea mays
  misc_feature: Ceres CLONE ID no. 341857
  misc_feature: Useful for making plants with modulated nitrogen use efficiency
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENVMKKWLPELQHYAPGVPIVLAGTKLDLREDKHYLVDHPGAVPVTTAQGEELRKHIGATCYIECSSKTQQNVKAVFDAAIKVVIRPPTKQRERKKKKERRGCSIFCSRIMHARRLGCFK

SEQ ID NO: 13111 - protein, 227 aa, Arabidopsis thaliana
  misc_feature: Ceres CLONE ID no. 34210
  misc_feature: The plant produces a reduced number of seeds.
  misc_feature: Useful for biocontainment applications
MAKKERPRPEKLSVYLYIPNIVGYMRVLLNCVAFAVCFSNKPLFSVLYFFSFCCDAVDGWVARRFNQVSTFGAVLDMVTDRVSTACLLVILSQIYRPSLVFLSLLALDIASHWLQMYSTFLAGKSSHKDVKDSTSWLFRLYYGNRIFMCYCCVSCEVLYIILLLIAKNQSENLLNVVVATLTQISPLSFLLALTLFGWSMKQTINVIQMKTAADVCVLYDLEKQQKP

SEQ ID NO: 13112 - protein, 223 aa, Arabidopsis thaliana
  misc_feature: Ceres CLONE ID no. 34363
  misc_feature: Useful for making plants with altered alkaloid content
MDTTLSPAVEAEQIADSTIDTVSRLIAGVFSGALTGIFAMAGAFTGAVTGAVAGRAAQYGVLRGAALGAVAGAILSVEVLEASRAYWYLELSGSRGPSSMADFVEQLFRGRLVDEQLMSTIINSHHWQLRISDVSYEEREDVYGELEARGLSGDSLRKLPCYIMSSEMVRRQVTHCTICLQDIKTGEITRSLPKCDHTFHLVCVDKWLIRHGSCPICRQAVKD

SEQ ID NO: 13113 - protein, 261 aa, Arabidopsis thaliana
  misc_feature: Ceres CLONE ID no. 34406
  misc_feature: Useful for making plants with altered terpenoid content
MRGRSYTPSPPRGYGRRGRSPSPRGRFGGSRDSDLPTSLLVRNLRHDCRQEDLRRPFEQFGPVKDIYLPRDYYTGDPRGFGFIQFMDPADAAEAKHQMDGYLLLGRELTVVFAEENRKKPTEMRTRDRGGRSNRFQDRRRSPPRYSRSPPRRGRRSRSRSCGYNSPPAKRHQSRSVSPQDRRYEKERSYSRSPPHNGSRVRSGSPGRVKSHSRSPRRSVSPRKNRSYTPEQARSQSPVPRQSRSPTPVPRGAQNGDRSPSQ

SEQ ID NO: 13114 - protein, 309 aa, Arabidopsis thaliana
  misc_feature: Ceres CLONE ID no. 34480
  misc_feature: The plant is abnormally small.
  misc_feature: Useful for making plants with modulated biomass
MEMSLRLASSSTSNPICLLNPGKNLNFPIRNHRIPKTSKPFCVRSSMSLSKPPRQTLSSNWDVSSFSIDSVAQSPSRLPSFEELDTTNMLLRQRIVFLGSQVDDMTADLVISQLLLLDAEDSERDITLFINSPGGSITAGMGIYDAMKQCKADVSTVCLGLAASMGAFLLASGSKGKRYCMPNSKVMIHQPLGTAGGKATEMSIRIREMMYHKIKLNKIFSRITGKPESEIESDTDRDNFLNPWEAKEYGLIDAVIDDGKPGLIAPIGDGTPPPKTKVWDLWKVEGTKKDNTNLPSERSMTQNGYAAIE

SEQ ID NO: 13115 - protein, 232 aa, Arabidopsis thaliana
  misc_feature: Ceres CLONE ID no. 34635
  misc_feature: Useful for making plants with altered Lignin content
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLNKLDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 13116 - protein, 259 aa, Arabidopsis thaliana
  misc_feature: Ceres CLONE ID no. 34944
  misc_feature: Useful for making plants with altered alkaloid content
MASQVRSVKVGNLSSGATEHDIKEFFSFSGEVESIDIQSNEHSAYVTFKETQGAETAVLLSGASIADQSVIIELAPNYSPPAAPHAETQSSGAESVVQKAEDVVSSMLAKGFILGKDAVGKAKAFDEKHGFTSTATAGVASLDQKIGLSQKLTAGTSLVNEKIKAVDQNFQVTERTKSVYAAAEQTVSSAGSAVMKNRYVLTGVSWAAGAFNRVAQAAGEVGQKTKEKVEAEQPSQPAQSQQQLPEGYSPIHTSEYSKN

SEQ ID NO: 13117 - protein, 46 aa, Arabidopsis thaliana
  misc_feature: Ceres CLONE ID no. 3510
  misc_feature: The plant is abnormally small.
  misc_feature: Useful for making plants with modulated biomass
MIYDVNSGLFRSFLSQKGSSSDKRKMEDKPREQKPKASDNKPVMNE

SEQ ID NO: 13118 - protein, 319 aa, Arabidopsis thaliana
  misc_feature: Ceres CLONE ID no. 35206
  misc_feature: Useful for making plants with modulated cold sensitivity
  misc_feature: Useful for making plants with modulated nitrogen use efficiency
MEKEADNKFRWVIKNFSSLGSERVFSDIFVVGSCKWRLMAYPIGVRDNRCFSLFLVVTDFKTLPCDWKRHTRLRLNVVNQLSEELSILKETQMWFDQKTPAWGFLAMLPLTELKAENGGFLVNEEVKIVVEVDVVEALGKLEESEEATQPLKKVKLEAFVESKGLLKGTSSVKEEIIDVNGFHVLPSQVEFVSRVFERYPEIASIFQAKKQHLRTACMYVLLSLIETLCKSLEELSNDDLVGGDNALQYLKFSGFKVDWLEKKLEEVKEKKKEEQIGETRMQEMKVFKQKCSDIEALMEREKSKLLVTRGSPLTLDDVL

SEQ ID NO: 13119 - protein, 281 aa, Arabidopsis thaliana
  misc_feature: Ceres CLONE ID no. 35228
  misc_feature: Useful for making plants with altered alkaloid content
  misc_feature (67)..(67): Xaa is any aa, unknown, or other
MSGALNMTLDEIVKRGKTARSGGRGISRGRGRGRGGGGRGAGPARRGPLAVNARPSSFTINKPVRRXRSLPWQSGLFEDGLRAAGASGVEVGTRLHVTNLDQGVTNEDIRELFSEIGEVERYAIHYDKNGRPSGTAEVVYPRRSDAFQALKKYNNVLLDGRPMRLEILGGNNSSEAPLSGRVNVNVTGLNGRLKRTVVIQQGGGGRGGRGPAPTVSRRLPIHNQQGGGMRGGRGGFRARGRGNGGRGRGGGRGNGKKPVEKSAADLDKDLESYHADAMNTS

SEQ ID NO: 13120 - protein, 135 aa, Arabidopsis thaliana
  misc_feature: Ceres CLONE ID no. 35429
  misc_feature: Useful for making plants with altered alkaloid content
  misc_feature: Useful for making plants with altered terpenoid content
MSLQRPNGNSSSSSSHKKHKTAAGSTCVLSSSADDGVNNPELDQTQNGVSTAKRRRGRNPVDKEYRSLKRLLRNRVSAQQARERKKVYVSDLESRANELQNNNDQLEEKISTLTNENTMLRKMLINTRPKTDDNH

SEQ ID NO: 13121 - protein, 222 aa, Zea mays
  misc_feature: Ceres CLONE ID no. 355209
  misc_feature: Useful for making plants with altered alkaloid content
MVSLRRRRLLGLCSGKDSLPVDLPKPIENEKTVEVAHSNVKPFSVHPLPLAKTSDVLIKSSNGSDDSKEEKTQYYPGKEIKCRKRHRRKQYVDQEPCIMRGVYFKNMKWQAAIKIDKKQIHLGTVGTQDEAARLYDRAAFMCGREPNFVLSEEEKQELRRYTWEDFLAVTRNTITSKKQRKVGSLRRSKADLFMGQSDGDTEMANGGGSSNSDNGDAGTSAS

SEQ ID NO: 13122 - protein, 300 aa, Arabidopsis thaliana
  misc_feature: Ceres CLONE ID no. 35594
  misc_feature: Useful for making plants with altered alkaloid content
  misc_feature (135)..(135): Xaa is any aa, unknown, or other
MGAPKQKWTQEEESALKSGVIKHGPGKWRTILKDPEFSGVLYLRSNVDLKDKWRNMSVMANGWGSREKSRLAVKRTFSLPKQEENSLALTNSLQSDEENVGATSGLQVSSNPPPRRPNVRLDSLIMEAIATLKEXGGCNKTTIGAYIEDQYHAPPDFKRLLSTKLKYLTSCGKLVKVKRKYRIPNSTSLSSHRRKGLGVFGGKQRTSSLPSPKTDIDEVNFQTRSQIDTEIARMKSMNVHEAAAVAAQAVAEAEAAMAEAEEAAKEAEAAEAEAEVAQAFAEEASKTLKGRNICKMMIRA

SEQ ID NO: 13123 - protein, 441 aa, Arabidopsis thaliana
  misc_feature: Ceres CLONE ID no. 35786
  misc_feature: Useful for making plants with altered terpenoid content
MDSTKLSELKVFIDQCKSDPSLLTTPSLSFFRDYLESLGAKIPTGVHEEDKDTKPRSFVVEESDDDMDETEEVKPKVEEEEEEDEIVESDVELEGDTVEPDNDPPQKMGDSSVEVTDENREAAQEAKGKAMEALSEGNFDEAIEHLTRAITLNPTSAIMYGNRASVYIKLKKPNAAIRDANAALEINPDSAKGYKSRGMARAMLGEWAEAAKDLHLASTIDYDEEISAVLKKVEPNAHKLEEHRRKYDRLRKEREDKKAERDRLRRRAEAQAAYDKAKKEEQSSSSRPSGGGFPGGMPGGFPGGMPGGFPGGMGGMPGGFPGGMGGMGGMPGGFPGGMGGGMPAGMGGGMPGMGGGMPAGMGGGGMPGAGGGMPGGGGMPGGMDFSKILNDPELMTAFSDPEVMAALQDVMKNPANLAKHQANPKVAPVIAKMMGKFAGPQ

SEQ ID NO: 13124 - protein, 171 aa, Zea mays
  misc_feature: Ceres CLONE ID no. 362309
  misc_feature: Useful for making plants with altered terpenoid content
  misc_feature (81)..(81): Xaa is any aa, unknown, or other
MEPVRRSGRLANLPDKPVYREKVPDFGMKIRRTYGSVRRDLTNRVYATDDARSYAISKAEDLEQELDSSFPIFIKPMTQSXVTGGFWLGLPIHFCRKYLPKRDEMITLVDEDDDESDTLYLAMKRGLSAGWRGFAVQQKLVDGDCLVFQLIEQTKFKVYITRASSYYESED

SEQ ID NO: 13125 - protein, 217 aa, Arabidopsis thaliana
  misc_feature: Ceres CLONE ID no. 36272
  misc_feature: Useful for making plants with altered Lignin content
  misc_feature: Useful for making plants with altered terpenoid content
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPNPYMGQPMWQQPGPEQQDPDN

SEQ ID NO: 13126 - protein, 873 aa, Zea mays
  misc_feature: Ceres CLONE ID no. 362993
  misc_feature: Useful for making plants with altered Lignin content
  misc_feature (432)..(432): Xaa is any aa, unknown, or other
MFGNIGKIPIIGDLTGSNKNAHLKGNVVLVRKTVLGLDVTSIAGSLLDGVGEFLGRGVTCQLISSTVVDPNNGNRGKLGAEASLEQWLLNPPPLLSSENQFRVTFDWEVEKQGIPGAIIVKNNHASEFFLKTITLNDVPGHGTIVFVANSWIYPQSKYRYNRVFFSNDTYLPSQMPAALKPYRDDELRNLRGDDQQGPYQEHDRVYRYDVYNDLGLPDSGNPRPVLGGTKELPYPRRCRTGRKPTKSDPNSESRLTLVDGDVYVPRDERFGHIKKSDFYGYAIKALVNAVIPAIRTYVDLSPGEFDSFKDIMKLYEGGIQLPKIPALEDLRKQFPLELVKDVLPVGGDYLLKLPMPQIIKEDKTGWMTDEEFGREILAGVNPLLVKRLTEFPPRSSLDPSKYGDHTSTIREADLENKLEGLTVQQALHGNRXYILDHHDNFMPFLVRVNSLEGNFIYATRTVLFLRGDGTLVPVAIELSLPELRDGLITAKSSVYTPKSTTGAEAWVWHLAKAYANVNDYCWHQLISHWLNTHAVMEPFVIATNRQLSVTHPVHKLLLPHYRDTMNINSNARQMLVNAGGIFETTVFPRQYAFEMSSVIYKDWNFTEQALPDDLIKRGMAVADPSSPYKVRLLVEDYPYASDGLAIWHAIEQWVTEYLAVYYPNDGVLRADVELQAWWKEAHEVGHADLKDAPWWPKMQTVAELVKACTTIIWIASALHAAVNFGQYPYAGYLPNRPSVSRKPMPAPGSDEYAELERKPEKVFVRTITSQFQALVGISLLEILSSHSSDEVYLGQRDTKEWTSDAKAQEAFKRFGARLTEIEKRVVTMNADPRLKNRNGPAEFPYTLLYPNTSDTKGDAAGITAKGIPNSISI

SEQ ID NO: 13127 - protein, 115 aa, Arabidopsis thaliana
  misc_feature: Ceres CLONE ID no. 3630
  misc_feature: Useful for making plants with modulated nitrogen use efficiency
MWCACYHQPLPASSVVLNQQAKQEESLRRKQVFFFLSSSSPSSLSTKHQWQISNYPKNGFRLKPKASVLPPSESGDITTFLFVSGAMISMYLVTNFLVPSLLFKSLQGEEEEDSD

SEQ ID NO: 13128 - protein, 354 aa, Arabidopsis thaliana
  misc_feature: Ceres CLONE ID no. 36358
  misc_feature: Useful for making plants with modulated oxidative stress sensitivity
MAASLVRSCCSRASRAITTVRFMSNVPEDTVYGGPKPQNSNQRVTLTQLRQKHRKGEPITMVTAYDYPSAVHIDTAGIDVCLVGDSAAMVVHGYDTTLPISLEEMLVHCRAVARGAKRPLLVGDLPFGTYESSTNQAVDTAVRVLKEGGMDAIKLEGGSPSRITAAKSIVEAGIAVMGHVGLTPQAISVLGGFRPQGKNIASAVKVVETAMALQEAGCFSVVLECVPPPVAAAATSALNIPTIGIGAGPFCSGQVLVYHDLLGMMQHPHHAKVTPKFCKQYAQVGEVINKALLEYKEEVSKHLFPGPSHSPYKISSSDLDGFLSELQKLGLDKAASDAAASAEKMDHSDSPSSQ

SEQ ID NO: 13129 - protein, 408 aa, Arabidopsis thaliana
  misc_feature: Ceres CLONE ID no. 36681
  misc_feature: Useful for making plants with altered cell wall content and/or composition
  misc_feature: Useful for making plants with modulated phosphate use efficiency
MKMQTKKLFITIVSFLLYAPLFLSSPVPDPESVVEEVHKSINASVAGRRKLGYLSCTTGNPIDDCWRCDPHWEQHRQRLADCAIGFGKNAIGGRDGRIYVVTDSGNDNPVSPKPGTLRHAVVQDEPLWIIFQRDMTIQLKEELIMNSFKTIDGRGASVHISGGPCITIQYVTNIIIHGIHIHDCKQGGNAMVRSSPRHFGWRTISDGDGVSIFGGSHVWVDHCSFSNCEDGLIDAIMGSTAITLSNNHMTHHDKVMLLGHSDTYSRDKNMQVTIAFNHFGEGLVQRMPRCRHGYFHVVNNDYTHWEMYAIGGSANPTINSQGNRFLAPNIRFSKEVTKHEDAPESEWKRWNWRSSGDLLLNGAFFTPSGGAASSSYAKASSLGAKPSSLVGPLTSTSGALNCRKGSRC

SEQ ID NO: 13130 - protein, 146 aa, Arabidopsis thaliana
  misc_feature: Ceres CLONE ID no. 36764
  misc_feature: Useful for making plants with modulated cold sensitivity
MAALARIGGRHLKSVCLINSSASCFFTQRRGVASKLFIGGLSFCTTEQGLSEAFSKCGQVVEAQIVMDRVSDRSKGFGFVTFASADEAQKALMEFNGQQLNGRTIFVDYAKAKQSLGGGGGYPIARGPPDPAVIAATRTTETSKSD

SEQ ID NO: 13131 - protein, 413 aa, Arabidopsis thaliana
  misc_feature: Ceres CLONE ID no. 37100
  misc_feature: Useful for making plants with modulated nitrogen use efficiency
  misc_feature: Useful for making plants with modulated nitrogen use efficiency
MERAAILPSVNQNYLLCPSRAFSTRLHSSTRNLSPPSFASIKLQHSSSSVSSNGGISLTRCNAVSSNSSSTLVPELADIDWDTVGFGLKPADYMYVMKCNIDGEFSKGELQRFGNIEISPSAGVLNYGQGLFEGLKAYRKKDGNNILLFRPEENAKRMRNGAERMCMPAPTVEQFVEAVTETVLANKRWVPPPGKGSLYVRPLLMGTGAVLGLAPAPEYTFIIYVSPVGNYFKEGVAPINLIVENEFHRATPGGTGGVKTIGNYAAVLKAQSIAKAKGYSDVLYLDCIYKRYLEEVSSCNIFIVKDNVISTPEIKGTILPGITRKSMIDVARTQGFQVEERNVTVDELLEADEVFCTGTAVVVSPVGSVTYKGKRVSYGEGTFGTVSKQLYTVLTSLQMGLIEDNMKWTVNLS

SEQ ID NO: 13132 - protein, 369 aa, Arabidopsis thaliana
  misc_feature: Ceres CLONE ID no. 37206
  misc_feature: Useful for making plants with modulated nitrogen use efficiency
MAENQNCARMTRAAAKRKASSMALDENPVSKKRVVLGELPNMSNVVAVPNQERETLKAKTSVNTSKRQMKKALMIPEASVLIESRSVDPQMCEPFASDICAYLREMEGKPKHRPLPDYIEKVQSDLTPHMRAVLVDWLVEVAEEYKLVSDTLYLTISYVDRFLSVKPINRQKLQLVGVSAMLIASKYEEIGPPKVEDFCYITDNTFTKQEVVSMEADILLALQFELGSPTIKTFLRRFTRVAQEDFKDSQLQIEFLCCYLSELSMLDYTCVKYLPSLLSASAVFLARFIIRPKQHPWNQMLEEYTKYKAADLQVCVGIIHDLYLSRRGNTLEAVRNKYKQHKYKCVATMPVSPELPLAFFEDITIRGMA

SEQ ID NO: 13133 - protein, 256 aa, Arabidopsis thaliana
  misc_feature: Ceres CLONE ID no. 37288
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
MGRGRIEIKKIENINSRQVTFSKRRNGLIKKAKELSILCDAEVALIIFSSTGKIYDFSSVCMEQILSRYGYTTASTEHKQQREHQLLICASHGNEAVLRNDDSMKVELERLQLAIERLKGKELEGMSFPDLISFENQLNESLHSVKDQKTQILLNQIERSRIQEKKALEENQILRKQVEMLGRGSGPKVLNERPQDSSPEADPESSSSEEDENDNEEHHSDTSLQLGLSSTGYCTKRKKPKIELVCDNSGSQVASD

SEQ ID NO: 13134 - protein, 326 aa, Arabidopsis thaliana
  misc_feature: Ceres CLONE ID no. 37412
  misc_feature: Useful for making plants with altered cell wall content and/or composition
  misc_feature: Useful for making plants with modulated phosphate use efficiency
MTRFGLALLMILVIQGLVTFSEAQLKMGFYDQTCPYAEKIVQDVVNQHINNAPSLAAGLIRMHFHDCFVRGCDGSILINATSSNQQVEKLAPPNLTVRGFDFIDKVKSALESKCPGIVSCADIITLATRDSIVAIGGPTWNVPTGRRDGRISNFAEAMNNIPPPFGNFTTLITLFGNQGLDVKDLVLLSGAHTIGVSHCSSFSNRLFNFTGVGDQDPSLDSEYADNLKSRRCLSIADNTTKVEMDPGSRNTFDLSYYRLVLKRRGLFESDAALTMNPAALAQVKRFAGGSEQEFFAEFSNSMEKMGRIGVKTGSDGEIRRTCAFVN

SEQ ID NO: 13135 - protein, 455 aa, Arabidopsis thaliana
  misc_feature: Ceres CLONE ID no. 37425
  misc_feature: The plant flowers significantly late compared to wild-type.
  misc_feature: Useful for making plants with modulated flowering time
  misc_feature (126)..(126): Xaa is any aa, unknown, or other
  misc_feature (248)..(248): Xaa is any aa, unknown, or other
  misc_feature (271)..(271): Xaa is any aa, unknown, or other
MAAAAMAVHLPKHSSFLPKPKLPLDKKTNFLGGSFNLGRPMSVNREFNSPVMVSASSTSKTVLTDDVDGDQSKRFYINFTGFPFPLGPFLNRRTIRTEAVKGCIWMFEQEQALGFSSVSTNIRMTXIKLKSGGLWVHAPIAPTKECVQLIKELGAPVEYIVLPTFAYEHKIFVGPFSRKFPKAQVWVAPRQWSWPLNLPLEFFGIFRAKIIKDRDLSTPWAEEIEQKVLSSPEVGIGPYVEVAFYHKXSRTLLVTDAVIFVPRKPPSSISXESLLASAKNGLAVKILSKGKDIPNDPVVDNPNTRQKGWERMVLQILFLGPSNLLEPNASFARMSQKLIVSPIVKTLVFSKVPEKVRDWIDEIARDWRFKRIIPAHFEAPINAGRSDFLAAFGFLEDLLGERYVTRPSLSLLFTSLMGKAASYFPPDDMRTLSSLDQFLVSVGAVKKTVSGRKRR

SEQ ID NO: 13136 - protein, 70 aa, Zea mays
  misc_feature: Ceres CLONE ID no. 374489
  misc_feature: Useful for making plants with modulated nitrogen use efficiency
MAPTSKLSTGIKRASRSHTYHRRGLWAIKAKNGGAFPKADKAAAAVEPKFYPADDGGERQESVSPPSDGS

SEQ ID NO: 13137 - protein, 427 aa, Zea mays
  misc_feature: Ceres CLONE ID no. 374674
  misc_feature: Useful for making plants with altered terpenoid content
MDIEADGRFGNKRVHNRLGPGSGGAPPSTNGKVCNYWRAGRCNRFPCPFLHSELPEAAPPKRPTGPGGNVWRNPNTGGRGGGHHNRWGKGPGGGSGIASHKPPERPCKYFLAGTECSYGERCRYPHSYCISDSIAMLTLLKGHEQGVTGIALPAGSDKLYSGSKDGTVRMWDCQTGQCAGVITMGREVGCMIIEGPWLFVGIPDAVKVWNMQTAAEMSLTGPTGQVYALAVASELLFAATQAGRILAWRFSAATNCFEPAASLDGHKLAVVSLIVGGMRLYSASMDKTIRVWDLATLQCIQTLSDHTDVVMSVLCWDQFLLSCSLDQTIKVWAATESGNLEVTYTHKEDQGALALSGMPDAQSKPVLLCSLNDNTVRLYDLPSFSDRGRLFSKKEIRAIQMGPGGLFFTGDGTGELKVWQWVDLAQT

SEQ ID NO: 13138 - protein, 315 aa, Zea mays
  misc_feature: Ceres CLONE ID no. 375181
  misc_feature: The plant is abnormally small.
  misc_feature: Useful for making plants with modulated biomass
MNSSSATAMDQIGKYWGMWGARRSSSSSSTIPISAWAAAYGGSSEPSWEEQAFARDAAEHLGGCVWPPRSYSCTFCQREFRSAQALGGHMNVHRRDRALLRLGGSSSPEDVHATTNDQPHPQQGALLYRAAASNPSTTTPSTTAAAGTTAAGPAAAITIAGAGDGDANTTTTTTYLSRIIKESKNKRFMPMPDHSVAGMREDQAAAIDDHRHNEDGDSWRSASAAKKRRRLDHPLATAAALLIFVQPAPKAATNVAACESQGGADHETKVPHTTTLTSPSSSSPLLLDQRHELDLELRLGTTPKVTYIHGNDTRS

SEQ ID NO: 13139 - protein, 424 aa, Arabidopsis thaliana
  misc_feature: Ceres CLONE ID no. 37739
  misc_feature: Useful for making plants with altered Lignin content
MRTLLPSHTPATVTTAARRRHVIHCAGKRSDSFSINSSSSDWQSSCAILSSKVNSQEQSESLSSNSNGSSSYHVSAVNGHNNGAGVSDLNLVPFNNNQSIQSKKPLSISDLSPAPMHGSNLRVAYQGVPGAYSEAAAGKAYPNCQAIPCDQFEVAFQAVELWIADRAVLPVENSLGGSIHRNYDLLLRHRLHIVGEVQLPVHHCLMALPGVRKEFLTRVISHPQGLAQCEHTLTKLGLNVAREAVDDTAGAAEFIAANNIRDTAAIASARAAEIYGLEILEDGIQDDASNVTRFVMLAREPIIPRTDRPFKTSIVFAHEKGTCVLFKVLSAFAFRNISLTKIESRPNHNVPIRLVDEANVGTAKHFEYMFYIDFEASMAESRAQNALSEVQEFTSFLRVLGSYPMDMTSWSPSSSSSSSSTFSL

SEQ ID NO: 13140 - protein, 315 aa, Arabidopsis thaliana
  misc_feature: Ceres CLONE ID no. 37792
  misc_feature: Useful for making plants with altered terpenoid content
MDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 13141 - protein, 374 aa, Arabidopsis thaliana
  misc_feature: Ceres CLONE ID no. 37980
  misc_feature: Useful for making plants with altered Lignin content
MQKVFLAMDTCALVIHQSLSRIKLSPPKSSSSSSSSAFSPESLPIRRIELCFRGAICAAVQRNYEETTSSVEEAEEDDESSSSYGEVNKIIGSRTAGEGAMEYLIEWKDGHSPSWVPSSYIAADVVSEYETPWWTAARKADEQALSQLLEDRDVDAVDESGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPINE

SEQ ID NO: 13142 - protein, 377 aa, Arabidopsis thaliana
  misc_feature: Ceres CLONE ID no. 38101
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDVKEKLAYIALDYEQEMETANTSSSVEKSYELPDGQVITIGGERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 13143 - protein, 377 aa, Arabidopsis thaliana
  misc_feature: Ceres CLONE ID no. 3819
  misc_feature: The plant is abnormally small.
  misc_feature: Useful for making plants with modulated biomass
MAEADDIQPIVCDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 13144 - protein, 103 aa, Arabidopsis thaliana
  misc_feature: Ceres CLONE ID no. 38257
  misc_feature: Useful for making plants with modulated nitrogen use efficiency
MASMTMTATFFPAVAKVPSATGGRKLSVVRASTSDNTPSLEVKEQSSTTMRRDLMFTAAAAAVCSLAKVAMAEEEEPKRGTEAAKKKYAQVCVTMPTAKICRY

SEQ ID NO: 13145 - protein, 436 aa, Arabidopsis thaliana
  misc_feature: Ceres CLONE ID no. 38432
  misc_feature: Useful for making plants with modulated nitrogen use efficiency
  misc_feature: Useful for making plants with modulated nitrogen use efficiency
MGFQNEASSSSYTLKIPPPAREDTPLLGKGPPLSSQFKTFANVFIAVVGAGVLGLPYAFKRTGWLMGVLLLVSVSVLTHHCMMLLVYTRRKLDSFNAGISKIGSFGDLGFAVCGSLGRIVVDLFIILSQAGFCVGYLIFIGTTLANLSDPESPTSLRHQFTRLGSEFLGVSSKSLYIWGCFPFQLGLNSIKTLTHLAPLSIFADIVDLGAMAVVIVEDSMIILKQRPDVVAFGGMSLFLYGMGVAVYSFEGVGMVLPLESEMKDKDKFGKVLALGMGFISLIYIAFGILGYLAFGEDTMDIITANLGAGLVSTVVQLGLCINLFFTFPLMMNPVFEIVERRFSRGMYSAWLRWVLVLAVTLVALFVPNFADFLSLVGSSTCCVLGFVLPALFHLLVFKEEMGWLQWSSDTAIVVLGVVLAVSGTWSSLSEIFSVKV

SEQ ID NO: 13146 - protein, 102 aa, Arabidopsis thaliana
  misc_feature: Ceres CLONE ID no. 38470
  misc_feature: The plant is abnormally small.
  misc_feature: Useful for making plants with modulated biomass
MKIVTLVLVVFVILSTSFPAAIKAEDTGDTGNVGVTCDARQLQPCLAAITGGGQPSGACCAKLTEQQSCLCGFAKNPAFAQYISSPNARKVLLACNVAYPTC

SEQ ID NO: 13147 - protein, 549 aa, Arabidopsis thaliana
  misc_feature: Ceres CLONE ID no. 38529
  misc_feature: Useful for making plants with altered alkaloid content
MGRGSVTSLAPGFRFHPTDEELVRYYLKRKICNKPFKFDAISVTDVYKSEPWDLPDKSRLKSRDLEWYFFSMLNKKYRNGSKTNRATEMGYWKTTGKDREILNGSKVVGMKKTLVYHKGRAPRGERTNWVMHEYRLVDQDLDKTGVHQDAFVLCRIFQKSGSGPKNGEQYGAPFVEEEWEEEDDMTFVPDQEDLGSEDHVYVHMDDIDQKSENFVVYDAIPIPLNFIHGESSNNVETNYSDSINYIQQTGNYMDSGGYFEQPAESYEKDQKPIIRHRDGSLQNEGIGCGVQDKHSEILQSSDNIFGTDTSCYNDFPVESNYLIGEAFLDPNSNLLENDGLYLETNDLSSTQQDGFDFEDYLTFFDETFDPSQLMGNEDVFFDQEELFQEVETKELEKEETSRSKHVVEEKEKDEASCSKQVDADATEFEPDYKYPLLKKASHMLGAIPAPLANASEFPTKDAAIRLHAAQSSGSVHVTAGMITISDSNMGWSYGKNENLDLILSLGLVQGNTAPEKSGNSSAWAMLIFMCFWVLLLSVSFKVSILVSSR

SEQ ID NO: 13148 - protein, 153 aa, Arabidopsis thaliana
  misc_feature: Ceres CLONE ID no. 3858
  misc_feature: Abnormal phyllotaxy, leaf number higher than wild-type
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MAMSGTYVTDVPLKGSAEKHYKRWRSENHLVPEAIGHLIQGVTVHDGDWDSHGTIKIWNYTRDGKEEVLKERIEMDDENMAVTINGLDGHVMEVLKVYVTTLHFIPESKDGCVCKITMVWEKRTEDSPEPIEFMKFVEQMIAHMDDHILQNQE

SEQ ID NO: 13149 - protein, 376 aa, Arabidopsis thaliana
  misc_feature: Ceres CLONE ID no. 38584
  misc_feature: Useful for making plants with modulated nitrogen use efficiency
MATLFTVARPSSLLYVSSINPSKTFSPSISLKLNSLSFSFGYRPKPLRFSKIRSSLPSESESESDLDASAVTDEWGEKPGDANEPDSQPDNVTVNVITDEWGEKSGPELEESGTRFMESDPPRNEDEWGGEIGGETEADAGNGSAVSDPTWELKRCLADSVYGTELGFKAGSEVRAEVLELVNQLEALNPTPAPLENPELLDGNWVLLYTAFSELIPLLAAGSTPLLKVKSISQSIDTNNLIIDNSTTLSSPFADFSFSATASFEVRSPSRIEVSFKEGTLKPPVIKSSVDLPESVGVFGQQISLSLLKQSLNPLQDVAANISRALSGQPPLKLPFPGNRGSSWLLTTYLDKDLRISRGDGGLFVLAREGSSLLEL

SEQ ID NO: 13150 - protein, 384 aa, Zea mays
  misc_feature: Ceres CLONE ID no. 386908
  misc_feature: Useful for making plants with altered terpenoid content
MFASICRRRLFRLCQIPFGTGAIPSDALPHCHSLATIADAPVSEPCAALVSCGLSPAAAVAHKLPIRSTAKADAVRALLRSYGFTDAEVADLVRRLSQILSVDPDRIRPKLDLFASLGVKPRRLARYPALLTRSLDKHLVPCIQFLRNILSTDEDVCLAISRTPRALSAGLEKIMRPAVDTLRRLGLPDESISKLVVIEMGVLMMSPDRICQIFEALKEFGLGVTEKRFPYGIRALCCISREKWLHRVALYRSFGVSEGELQRAFKKQPNIVNFSDEIIKKKIRFFLDVLKLELSEVMEQPAIIGYSLERNIIPRCAVLSLLMREGKIGPNVKLISALLGSANMFSTRYVLRYANELPDVVKAYEGKITFDVFREQDLLVPLKL

SEQ ID NO: 13151 - protein, 388 aa, Arabidopsis thaliana
  misc_feature: Ceres CLONE ID no. 38757
  misc_feature: The plant produces a reduced number of seeds.
  misc_feature: Useful for biocontainment applications
MGNISSSGGEGRRRRRRNHTAAPPPPPPPPSSSLPPPPLPTEIQANPIVFAAVTPYPNPNPNPVYQYPASYYHHPPPGAMPLPPYDHHLQHHPPHPYHNHSWAPVAMARYPYAGHMMAQPTPYVEHQKAVTIRNDVNLKKESLRLEPDPDNPGRFLVSFTFDATVSGRISVIFFAKESEDCKLTATKEDILPPITLDFEKGLGQKFKQSSGSGIDFSVFEDVELFKAAADTEIYPLAVKAEAAPSGGENEEEERSGSKNAQITQAVYEKDKGEIKIRVVKQILWVNGTRYELQEIYGIGNTVEGDDDSADDANDPGKECVICLSEPRDTTVLPCRHMCMCSGCAKVLRFQTNRCPICRQPVERLLEIKVHGNNGSGNNTGQGETVEQE

SEQ ID NO: 13152 - protein, 364 aa, Zea mays
  misc_feature: Ceres CLONE ID no. 389585
  misc_feature: Useful for making plants with altered Lignin content
  misc_feature: Useful for making plants with altered terpenoid content
MEDEENIEGELLLVESQLHDIQGQIKTLLDRQEELYERQAQLKALLEASKLTRNTTINTSSVAPEDWSGSFPWDLEADDTRFNIFGISSYRSNQREIINAVMSGRDVLVIMAAGGGKSLCYQLPAVLRDGIALVVSPLLSLIQDQVIGLSALGIPAYMLTSTTNKEVEKFIYKTLDKGEGELKILYVTPEKISKSKRFMSKLEKCHHAGRLSLIAIDEAHCCSQWGHDFRPDYKNLGILKIQFPSVPMIALTATATSKVQMDLMEMLHIPRCIKFVSTVNRPNLFYKVSEKSPVGKVVIDEITKFISESYPNNESGIIYCFSRKECEQVAKELRERGISADYYHADMDIVNREKIHMRIDTQGM

SEQ ID NO: 13153 - protein, 397 aa, Zea mays
  misc_feature: Ceres CLONE ID no. 389639
  misc_feature: The plant flowers significantly late compared to wild-type.
  misc_feature: Useful for making plants with modulated flowering time
MSSSSASLQPPPAGATGGSSPYSASSSFLPSFMIIAALLAFVFLASVSIHLLLRFLSARSSSSSSTTSSSPPLSGHPRPRTYRDDAGSADASVARRPAATAAPADAGKNEEEEDAGDEKQRLIDSLPLFTMASALAALPKSSPDCAVCLSPFTPDADLRLLPACRHAFHAACVDAWLRTTPSCPLCRAAVALPHPSLSGMLAAAQAQRPARPGPGPGPSFLVEMGTVSSRGSPAAAGGGRDRNRNRNSRTYSLGSAFDYQIDEEVEAVVSRVARIAAARESSAVKEEKPSAEQGSAPAPAPAPSPSSQPPPPGETVAEAAGSSRGWLREYVDRLASSAYTLSERWSSRWSQGQSQQQRQEEPWLWDAEAAEMSAAPGSDDDEEETAFMAMYRWIAGV

SEQ ID NO: 13154 - protein, 149 aa, Arabidopsis thaliana
  misc_feature: Ceres CLONE ID no. 3900
  misc_feature: Useful for making plants with altered Lignin content
  misc_feature: Useful for making plants with modulated nitrogen use efficiency
MEFSGDAGMMMENKRNVCSLGESSIKRHKSDLSFNSKERKDKVGERISALQQIVSPYGKTDTASVLLDAMHYIEFLHEQVKVLSAPYLQTIPDATQEELEQYSLRNRGLCLVPMENTVGVAQSNGADIWAPVKTPLSPAFSVTSQSPFR

SEQ ID NO: 13155 - protein, 283 aa, Arabidopsis thaliana
  misc_feature: Ceres CLONE ID no. 39107
  misc_feature: Useful for making plants with modulated nitrogen use efficiency
MAEASDLLEWPKKDNRRFLHVVYRVGDLDRTIEFYTEVFGMKLLRKRDIPEEKYSNAFLGFGPETSNFVVELTYNYGVSSYDIGTGFGHFAISTQDVSKLVENVRAKGGNVTREPGPVKGGGSVIAFVKDPDGYTFELIQRGPTPEPFCQVMLRVGDLDRAIKFYEKALGMRLLRKIERPEYKYTIGMMGYAEEYESIVLELTYNYDVTEYTKGNAYAQIAIGTDDVYKSGEVIKIVNQELGGKITREAGPLPGLGTKIVSFLDPDGWKTVLVDNKDFLKELE

SEQ ID NO: 13156 - protein, 152 aa, Arabidopsis thaliana
  misc_feature: Ceres CLONE ID no. 39127
  misc_feature: The plant produces a reduced number of seeds.
  misc_feature: Useful for biocontainment applications
MGALDSLSEYISDYFRVTRKRRKRKVMQTVNIKVKMDCDGCERRVKNAVSSMKGVKSVEVNRKIHKVTVSGYVEPKKVLKRIERTGKKAEIWPYVPYNMVAYPYAVGTYDKKAPAGYVRKSEQSQLQLLPGAPENHYISLFSDENPNACTVM

SEQ ID NO: 13157 - protein, 214 aa, Arabidopsis thaliana
  misc_feature: Ceres CLONE ID no. 39279
  misc_feature: Useful for making plants with altered terpenoid content
MSDDDERGEEYLFKIVIIGDSAVGKSNLLTRYACNEFNPNSKATIGVEFQTQSMLIDGKEVKAQIWDTAGQERFRAVTSAYYRGAVGALVVYDITRSSTFENVGRWLDELNTHSDTTVAKMLIGNKCDLESIRAVSVEEGKSLAESEGLFFMETSALDSTNVKTAFEMVIREIYSNISRKQLNSDSYKEELTLNRVSLVKNENEGTKTFSCCSR

SEQ ID NO: 13158 - protein, 202 aa, Arabidopsis thaliana
  misc_feature: Ceres CLONE ID no. 39286
  misc_feature: The plant produces a reduced number of seeds.
  misc_feature: Useful for biocontainment applications
MACKTILRSVFVSESRRTSGARRCFFLPPSPASVPVHGLFPAPKSLCFNGFASVPERATRLNCSHNDQSDQGPPQEAVLKAISEVSKTDGRVGKTTNMIIGGTVADDSAKDWLELDQKVNTYPTERGFTAIGTGGNDFVHAMVVAVESVIDRQIPEDCVKQTLSSKGKYVSVNIGPIQVVSSEQVQAVYNAMRRDERMKYFL

SEQ ID NO: 13159 - protein, 295 aa, Zea mays
  misc_feature: Ceres CLONE ID no. 393033
  misc_feature: Useful for making plants with altered terpenoid content
MAKYYWGMLGAATTTTRAGTGSSLIRSTWPPPAAHGGGRSGEPSWEELAFAQDAAGQLGGCVWPPRSYTCTFCRREFRSAQALGGHMNVHRRDRARLRQCAPPDHDQEPIAAPLPAPELADHQQQLLQLHGSPMTKAAVLFSGRPAAACCTHQQTYCNNNREGEGEDSPARYISTTTTIIKESKSKVLISIPAATTAAGSKKAATTIAIIGEEEEEEEEEEEIMVTGRRTKRRRLVHQPFYDLRRLPPASSSPNKGGVEDDDAKVPKLSSPISLSHHLAGRQEEVDLELRLGTSC

SEQ ID NO: 13160 - protein, 113 aa, Arabidopsis thaliana
  misc_feature: Ceres CLONE ID no. 39319
  misc_feature: The plant flowers significantly earllier than wild-type.
  misc_feature: The plant is abnormally small.
  misc_feature: Useful for making plants with modulated biomass
  misc_feature: Useful for making plants with modulated flowering time
MSELDSQVPTAFDPFADANVEDSGAGTKEYVHIRVQQRNGRKSLTTVQGLKKEYSYTKILKDLKKEFCCNGTVVQDSELGQVIQLQGDQRKNVSTFLVQAGLVKKDNIKIHGF

SEQ ID NO: 13161 - protein, 196 aa, Arabidopsis thaliana
  misc_feature: Ceres CLONE ID no. 39347
  misc_feature: The plant is abnormally large.
  misc_feature: Useful for making plants with altered alkaloid content
  misc_feature: Useful for making plants with modulated biomass
MGRKKLEIKRIENKSSRQVTFSKRRNGLIEKARQLSVLCDASVALLVVSASGKLYSFSSGDNLVKILDRYGKQHADDLKALDHQSKALNYGSHYELLELVDSKLVGSNVKNVSIDALVQLEEHLETALSVTRAKKTELMLKLVENLKEKEKMLKEENQVLASQMENNHHVGAEAEMEMSPAGQISDNLPVTLPLLN

SEQ ID NO: 13162 - protein, 488 aa, Arabidopsis thaliana
  misc_feature: Ceres CLONE ID no. 39358
  misc_feature: Useful for making plants with modulated nitrogen use efficiency
MAMLGAQQVPAAACTPDMVGNAFVPQYYHILHQSPEHVHRFYQEISKLGRPEENGLMSITSTLQAIDKKIMALGYGVISAEIATVDTQESHGGGYIVLVTGYLTGKDSVRRTFSQTFFLAPQETGYFVLNDMFRFIDEGTVVHGNQIPVNNVQAPVNTYQDTAAAKEIPDDFVQEKYVQENHAVKQTEVLSKSINEPEKVFTPSEDEQVSAAEEVLVTETVNEAPIEVQKVGESDSRTGEIPKRSYASIVKVMKENAAPMSASRTPTKVEPKKQEDQAIHIPLPTPLSEKSDSGANVAVNENNQENERALGPSIYLKGLPLDATPALLENEFQKFGLIRTNGIQVRSQKGFCFGFVEFESASSMQSAIEASPVMLNGHKVVVEEKRSTARGNYRGRSTFGVNTGYRNEGGRGRGSFGGGRGGYGRTDFNGYGNNRGNNRGGYANRANGDGGGFPRANGNNGRVRRGGGIDANRATKPVDDAPHVSVTA

SEQ ID NO: 13163 - protein, 138 aa, Zea mays
  misc_feature: Ceres CLONE ID no. 397320
  misc_feature: Useful for making plants with altered Lignin content
  misc_feature (81)..(81): Xaa is any aa, unknown, or other
MEGGETTLSGFGGAGAPGVDTKVLHAFQTSFVQVQTLLDQNRLLINEINHNHESKVPGDLSRKRGPHQGAQQQHPPRRRPXRRPLLALRRGRRRRRPRRVRGRVRGHRPPPGGRRPQEDQVRPRLICCQAFLLRREKE

SEQ ID NO: 13164 - protein, 296 aa, Arabidopsis thaliana
  misc_feature: Ceres CLONE ID no. 39757
  misc_feature: Useful for making plants with modulated nitrogen use efficiency
MALRNIENALPISQERPKKLAKLSKQPEIGLNDENNPVAVAESTVEYVASENLKPFSDPESSVQRLLEELASKDWIKVCESLNNTRRFAIHHSSLLLPILEKLIVVMVKAMKNPRSALCKTSIMTCSDIFTAYGEKLLEGPHLKSMDDLLLQLLMKASQDKKFVCEEAEKALNTMVNSVARLPLLRKLQSYVRHSNPRVRAKAAVSTSNCVSKMEVNEMEEFGMVLLAQMAADQLSDKLPEAREAARSMVNSLFEKFTWNEEEDEEGSKQEAWKKFCEKNVTGLNAQAMIKIVASQ

SEQ ID NO: 13165 - protein, 231 aa, Zea mays
  misc_feature: Ceres CLONE ID no. 398139
  misc_feature: Useful for making plants with altered alkaloid content
MAPALSFPIIDMGLLAGEERPAAMERLQDACENWGFFEILNHGISTELMDEVEKLTKEHYKRVREQRFLEFASKTLGDGRVKIPIQKDGEIPIPYKPDVDVEKIKFHHFSFEETTATLHLKLENKNDFDLGLNLLEYEMWLGDDSIASAELTQTAKIEKQGITRMQVPFSFRPKDFGSAVWDMIRGRGTGYTIKGKIDVDTPFGNMKLPISKEGGTTHLKKEDDDDDDDDN

SEQ ID NO: 13166 - protein, 256 aa, Arabidopsis thaliana
  misc_feature: Ceres CLONE ID no. 39890
  misc_feature: Useful for making plants with modulated biomass
  misc_feature: Useful for making plants with modulated flowering time
  misc_feature: Useful for making plants with modulated phosphate use efficiency
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQHNQGHNMPPPLPPQQHQIQHPYMLSHQPSPFLNMGGLYQEDDPMAMRRNDLELTLEPVYNCNLGCFAA

SEQ ID NO: 13167 - protein, 313 aa, Arabidopsis thaliana
  misc_feature: Ceres CLONE ID no. 39922
  misc_feature: Useful for making plants with altered alkaloid content
MTMTTVKVSNVSLGATDRDLKEFFSFSGDILYLETQSETERTKLAYVTFKDLQGAETAVLLSGATIVDSSVIVSMAPDYQLSPEALASLEPKDSNKSPKAGDSVLRKAEDVVSSMLAKGFILGKDAIAKAKSVDEKHQLTSTASAKVASFDKKIGFTDKINTGTVVVGEKVREVDQKYQVSEKTKSAIAAAEQTVSNAGSAIMKNRYVLTGATWVTGAFNKVAKAAEEVGQKAKEKVGMAEEEDKRKVVDEFARVHLSESPKAASSTQEAERESKLSESPEAKKDSEHLEPQSKPLQQQSPPPMASAPAPAQP

SEQ ID NO: 13168 - protein, 370 aa, Arabidopsis thaliana
  misc_feature: Ceres CLONE ID no. 39958
  misc_feature: Useful for making plants with modulated nitrogen use efficiency
MGKLVLELSKENQLETTDCGVSDHGSPPIKNEEHEAPRYSSDKDTGLPTCRVCQCAESDRRGDAALGFLGITPPVSEPRRSNAGEETVDQRSSVVKSSGFIELISPDGEVFVCANDDIEMGAWQHRDKLLELGCSCKNDLALVHYACALKWFVNHGSTVCEICGKTTENIRTVDFNKVVIALKDYAALRERTADGDPNPVVVNNNTSSSGIDPDAVAAIRRQRLSEISLWFGPHCSTNNNNSSNSAAAGTASSQVTSEQPVGIVNFDILPMESRATKWAVEGTGILLATGLLTVTLAWLIAPRVGKRTAKSGLHILLGGLCALTVVIFFRFVVLTRIRYGPARYWAILFAFWFLVFGIWASRSHASHSST

SEQ ID NO: 13169 - protein, 276 aa, Arabidopsis thaliana
  misc_feature: Ceres CLONE ID no. 40102
  misc_feature: Useful for making plants with modulated drought sensitivity
MVKGPGLYTEIGKKARDLLYKDHNSDQKFSITTFSPAGVAITSTGTKKGDLLLGDVAFQSRRKNITTDLKVCTDSTFLITATVDEAAPGLRSIFSFKVPDQNSGKVELQYLHEYAGISTSMGLTQNPTVNFSGVIGSNVLAVGTDVSFDTKSGNFTKINAGLSFTKEDLIASLTVNDKGDLLNASYYHIVNPLFNTAVGAEVSHKLSSKDSTITVGTQHSLDPLTSVKARVNSAGIASALIQHEWKPKSFFTISGEIDTKSIDKSAKVGLALALKP

SEQ ID NO: 13170 - protein, 208 aa, Arabidopsis thaliana
  misc_feature: Ceres CLONE ID no. 40334
  misc_feature: Useful for making plants with altered Lignin content
MGRGKIEIKRIENANNRVVTFSKRRNGLVKKAKEITVLCDAKVALIIFASNGKMIDYCCPSMDLGAMLDQYQKLSGKKLWDAKHENLSNEIDRIKKENDSLQLELRHLKGEDIQSLNLKNLMAVEHAIEHGLDKVRDHQMEILISKRRNEKMMAEEQRQLTFQLQQQEMAIASNARGMMMRDHDGQFGYRVQPIQPNLQEKIMSLVID

SEQ ID NO: 13171 - protein, 147 aa, Arabidopsis thaliana
  misc_feature: Ceres CLONE ID no. 4043
  misc_feature: The plant is abnormally small.
  misc_feature: Useful for making plants with modulated biomass
  misc_feature (102)..(102): Xaa is any aa, unknown, or other
MEINKFLAVVVVVVVLYSVEATAQGGSPQLTACLHKLLPCQPYIHSLNPPPPPSCCGPMKEIVEKDAPCLCTAFNNPEVLKALNLTKENALLLPNACGVNPXVSLCSKIATPSPIASPGSTNGTSSASTISFNRFSFLSAFVAMIFF

SEQ ID NO: 13172 - protein, 272 aa, Arabidopsis thaliana
  misc_feature: Ceres CLONE ID no. 40501
  misc_feature: Useful for making plants with altered alkaloid content
MSMSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPSKKKKTSTLSIFGSNDELADR

SEQ ID NO: 13173 - protein, 286 aa, Arabidopsis thaliana
  misc_feature: Ceres CLONE ID no. 40508
  misc_feature: The plant is abnormally small.
  misc_feature: Useful for making plants with altered cell wall content and/or composition
  misc_feature: Useful for making plants with modulated biomass
MASGLSEIGSTKMFDGYNKRYKHFSETLGCSMTFSIYFPPSASASSSHKSPVLYWLSGLTCTDENFIIKSGAQRAASTHGIALVAPDTSPRGLNVEGEADSYDFGVGAGFYLNATQEKWKNWRMYDYVVKELPKLLSENFSQLDTTKASISGHSMGGHGALTIYLRNLDKYKSVSAFAPITNPINCAWGQKAFTNYLGDNKAAWEEYDATCLISKYNNLSATILIDQGENDQFYPDQLLPSKFEEACKKVNAPLLLRLHPGYDHSYYFIATFIEDHISHHAQALEL

SEQ ID NO: 13174 - protein, 316 aa, Arabidopsis thaliana
  misc_feature: Ceres CLONE ID no. 40729
  misc_feature: The plant is abnormally small.
  misc_feature: The plant produces a reduced number of seeds.
  misc_feature: Useful for biocontainment applications
  misc_feature: Useful for making plants with altered Lignin content
  misc_feature: Useful for making plants with altered alkaloid content
  misc_feature: Useful for making plants with modulated biomass
MAALIRCCSSFSHTSGGQPPPRDKSRAPEIGKFATSIGYSVVRKPGDHPPFSKIIHSSSQPKERQGKGILQTPFASVGSLDKFSAFEGIGRLKLPVMAVLLTNSLQMATPLEALAAEICEPESSMFSMPILLLVALIGATVGGLLARQRKGELQRLNEQLRQINAALRRQAKIESYAPSLSYAPVGARIPDSEIIVEPKKQELISKLKTGKTFLRNQEPEKAYTEFKIALELAQSLKDPTEEKKAARGLGASLQRQGKYREAIQYHSMVLAISKRESEDSGITEAYGAIADCYTELGDLEKAGKFYDTYIARLETD

SEQ ID NO: 13175 - protein, 40 aa, Arabidopsis thaliana
  misc_feature: Ceres CLONE ID no. 41072
  misc_feature: Useful for making plants with modulated nitrogen use efficiency
MIISETNRREISKYLFKEGVLFAKKDFNLPQHPLIESVPN

SEQ ID NO: 13176 - protein, 252 aa, Arabidopsis thaliana
  misc_feature: Ceres CLONE ID no. 41104
  misc_feature: Useful for making plants with altered alkaloid content
MEGIQHPIPRTVEEVFSDFRGRRAGLIKALSTDVQKFYHQCDPEKENLCLYGLPNETWEVNLPVEEVPPELPEPALGINFARDGMQEKDWISLVAVHSDSWLISVAFYFGARFGFGKNERKRLFQMINDLPTIFEVVTGNAKQSKDQSANHNSSRSKSSGGKPRHSESHTKASKMSPPPRKEDESGDEDEDDEQGAVCGACGDNYGGDEFWICCDACEKWFHGKCVKITPAKAEHIKHYKCPSCTTSKKMKA

SEQ ID NO: 13177 - protein, 425 aa, Arabidopsis thaliana
  misc_feature: Ceres CLONE ID no. 41105
  misc_feature: Useful for making plants with altered alkaloid content
MECNAKPPFQWELENLISFGTSTAEVPRKLKPMEWEIDGFDCTSLYSSSFDAVAYGGSSGSDIAHAFSKSSKSTSISSSSAEVRTHNFTSETGESLPGEFAKGIDTSPTLELSFGSGDPVLGLKLGKRTYFEDFWEVENAKGLGLPVSLASSSVSPVKKSKSIPQRLQTPHCQVEGCNLDLSSAKDYHRKHRICENHSKFPKVVVSGVERRFCQQCSRFHCLSEFDEKKRSCRRRLSDHNARRRKPNPGRTYDGKPQVDFVWNRFALIHPRSEEKFLWPSSKPVPSRVLMPQPAKTEISNKLFTEHSRFGLLDPKTKSARAELFSKEKVTISSHMGASQDLDGALSLLSNSTTWVSSSDQPRRFTLDHHPSSNLQPVANRSAAQLSSVSGYWQPDPPAVEGPTALHRNGAGQFNENYFSLNQFYN

SEQ ID NO: 13178 - protein, 307 aa, Arabidopsis thaliana
  misc_feature: Ceres CLONE ID no. 41320
  misc_feature: The plant is abnormally small.
  misc_feature: The plant produces a reduced number of seeds.
  misc_feature: Useful for biocontainment applications
  misc_feature: Useful for making plants with modulated biomass
MVGGGVIQQILRRKLHSQSLATPVLSWFSSKKAHEDAGSSGVRALALLGAGVSGLLSFSTVASADEAEHGLESPEYPWPHDGILSSYDHASIRRGHQVYQQVCASCHSMSLISYRDLVGVAYTEEEAKAMAAEIEVVDGPNDEGEMFTRPGKLSDRFPQPYANESAARFANGGAYPPDLSLITKARHNGPNYVFALLTGYRDPPAGISIREGLHYNPYFPGGAIAMPKMLNDEAVEYEDGVPATEAQMGKDIVSFLAWAAEPEMEERKLMGFKWIFLLSLALLQAAYYRRLKWSVLKSRKLVLDVVN

SEQ ID NO: 13179 - protein, 273 aa, Arabidopsis thaliana
  misc_feature: Ceres CLONE ID no. 41439
  misc_feature: The plant flowers significantly late compared to wild-type.
  misc_feature: The plant is abnormally small.
  misc_feature: Useful for making plants with altered Lignin content
  misc_feature: Useful for making plants with modulated biomass
  misc_feature: Useful for making plants with modulated flowering time
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 13180 - protein, 219 aa, Arabidopsis thaliana
  misc_feature: Ceres CLONE ID no. 41543
  misc_feature: Useful for making plants with modulated heat sensitivity
  misc_feature: Useful for making plants with modulated heat sensitivity
MAILYALVARGTVVLSEFTATSTNASTIAKQILEKVPGDNDSNVSYSQDRYVFHVKRTDGLTVLCMAEETAGRRIPFAFLEDIHQRFVRTYGRAVHTALAYAMNEEFSRVLSQQIDYYSNDPNADRINRIKGEMNQVRGVMIENIDKVLDRGERLELLVDKTANMQGNTFRFRKQARRFRSNVWWRNCKLTVLLILLLLVIIYIAVAFLCHGPTLPSCI

SEQ ID NO: 13181 - protein, 365 aa, Arabidopsis thaliana
  misc_feature: Ceres CLONE ID no. 41717
  misc_feature: Useful for making plants with modulated drought sensitivity
  misc_feature: Useful for making plants with modulated water use efficiency
MKKPVGAEKKRVKRSSGSASTSVRDSGSDSQPRKQAVKKDSFQLFAEKVRDHKGLESRWAVMEQARVEYFRGKDFVSFMKNNPDFKDILEEDKDLDTDDIANVLLGKNLLVRCDRVTKTLRPRKKKLSTWPAHLEIFRDDQSFSENDAFFAWTFEKRHPLWQTLLSFFWPVLTLAICLFPVYPHRCKLIVLYSCAGILLMILSLLFVRAVAFGAMWILLGKRVWFFPNILAEEATLKELFRFWPKKDEEEPPKWTSRLFYTVVAIVVVMLLRRHAPDEAARARYQRRMSNIIDDVLEWSPKLALSGLMENQQPVNITDAANNSSDSAGGPDQTEEVDLDETQGEDLDETQGKEEAEGWTDSDLKT

SEQ ID NO: 13182 - protein, 382 aa, Arabidopsis thaliana
  misc_feature: Ceres CLONE ID no. 41875
  misc_feature: Useful for making plants with altered Lignin content
MPINDQFPSGLRILVVDDDTSCLFILEKMLLRLMYQVTICSQADVALTILRERKDSFDLVLSDVHMPGMNGYNLLQQVGLLEMDLPVIMMSVDGRTTTVMTGINHGACDYLIKPIRPEELKNIWQHVVRRKCVMKKELRSSQALEDNKNSGSLETVVVSVSECSEESLMKCRNKKKKKKRSVDRDDNEDDLLLDPGNSKKSRVVWSIELHQQFVNAVNKLGIDKAVPKRILELMNVPGLSRENVASHLQKFRLYLKRLSGEASQSNDSESTKRYENIQALVSSGQLHPQTLAALFGQPIDNHHSASFGVWIPNDNLGRSQNEHFSVDVSSASNRPVSVAVHGLSSSANFRQRGNVNNNRIRQGYGSNVNEESWILERSSRQR

SEQ ID NO: 13183 - protein, 418 aa, Zea mays subsp. mays
  misc_feature: Ceres CLONE ID no. 419844
  misc_feature: Useful for making plants with modulated heat sensitivity
  misc_feature (402)..(402): Xaa is any aa, unknown, or other
MAVSFANLNSEAGLKKLDEYLLTRSYITGYQASKDEEEMGDKEEEAELDGRGGNGVEDEFLKIDELTEFLEKGEEEEYGDGAKRREKSVKNWMVESDNEDEDEDQLDLEDFEDDDEDGEAGGGDILYKDFFESGHNKQAKKRDGSTKKVQFKDEAHEVELHDSENDDGNDEQEHGLSTHEKERLKMRTKIEQMEKANLEPSTWTMQGEVTASRRPKNSALEVDLDFEHNVRPAPVITEEVTASLEEMIKKRIAESHFDDVEKPSLLPSKAPKEHKELDETKSKKGLAELYEDDYAQKAGIAPAPLSISDELKEEANTLFKRICLKLDALSHFHFAPKPVIEDMSVQANVPALAMEEIAPVAVSDAAMLAPEEIFEGKGDVKEEGELTQAERKRRRANKKRRXAASHKERTAPAKLQKD

SEQ ID NO: 13184 - protein, 158 aa, Arabidopsis thaliana
  misc_feature: Ceres CLONE ID no. 4228
  misc_feature: Useful for making plants with altered alkaloid content
MQVEIALQRDRHNMGRRYVEVFRCSKQDYYNAVAAEEGAYEYEVRASPPPTGPSRAKRFSEKEKLEYTEVLKMRGLPYSVNKPQIIEFFSGYKVIQGRVQVVCRPDGKATGEAFVEFETGEEARRAMAKDKMSIGSRYVELFPTTREEARRAEARSRQ

SEQ ID NO: 13185 - protein, 217 aa, Arabidopsis thaliana
  misc_feature: Ceres CLONE ID no. 42533
  misc_feature: The plant is abnormally small.
  misc_feature: Useful for making plants with modulated biomass
  misc_feature: Useful for making plants with modulated light quality response
  misc_feature: Useful for making plants with modulated light quality sensitivity
  misc_feature (193)..(193): Xaa is any aa, unknown, or other
  misc_feature (195)..(195): Xaa is any aa, unknown, or other
  misc_feature (197)..(197): Xaa is any aa, unknown, or other
  misc_feature (200)..(200): Xaa is any aa, unknown, or other
  misc_feature (201)..(201): Xaa is any aa, unknown, or other
MMLEKDDLGLSLGLNFPKKQINLKSNPSVSVTPSSSSFGLFRRSSWNESFTSSVPNSDSSQKETRTFIRGIDVNRPPSTAEYGDEDAGVSSPNSTISSSTGKRSEREEDTDPQGSRGISDDEDGDNSRKKLRLSKDQSAILEETFKDHSTLNPKQKQALAKQLGLRARQVEVWFQNRRARTKLKQTEVDCEFXRXCXGEXXGRKPSATKRSNGVEST

SEQ ID NO: 13186 - protein, 357 aa, Arabidopsis thaliana
  misc_feature: Ceres CLONE ID no. 42713
  misc_feature: Useful for making plants with altered terpenoid content
  misc_feature: Useful for making plants with modulated low light sensitivity
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLRNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 13187 - protein, 156 aa, Arabidopsis thaliana
  misc_feature: Ceres CLONE ID no. 42925
  misc_feature: Abnormal phyllotaxy, leaf number higher than wild-type
  misc_feature: The plant is abnormally small.
  misc_feature: Useful for making plants with modulated biomass
MDSASSNTKAIDPPLHMLGFEFDELSPTRITGRLPVSPVCCQPFKVLHGGVSALIAESLASMGAHMASGFKRVAGIQLSINHLKSADLGDLVFAEATPVSTGKTIQVWEVKLWKTTQKDKANKILISSSRVTLICNLPIPDNAKDAANMLKMVAKL

SEQ ID NO: 13188 - protein, 358 aa, Arabidopsis thaliana
  misc_feature: Ceres CLONE ID no. 42960
  misc_feature: Useful for making plants with altered terpenoid content
MCGGAIISDFIPPPRSRRVTSEFIWPDLKKNLKGSKKSSKNRSNFFDFDAEFEADFQGFKDDSSIDCDDDFDVGDVFADVKPFVFTSTPKPAVSAAAEGSVFGKKVTGLDGEAEKSANRKRKNQYRGIRQRPWGKWAAEIRDPREGARIWLGTFKTAEEAARAYDAAARRIRGSKAKVNFPEENLKANSQKRSVKANLQKPVAKPNPNPSPALVQNSNISFENMCFMEEKHQVSNNNNNQFGMTNSVDAGCNGYQYFSSDQGSNSFDCSEFGWSDQAPITPDISSAVINNNNSALFFEEANPAKKLKSMDFETPYNNTEWDASLDFLNEDAVTTQDNGANPMDLWSIDEIHSMIGGVF

SEQ ID NO: 13189 - protein, 325 aa, Arabidopsis thaliana
  misc_feature: Ceres CLONE ID no. 42965
  misc_feature: The plant flowers significantly late compared to wild-type.
  misc_feature: The plant produces a reduced number of seeds.
  misc_feature: Useful for biocontainment applications
  misc_feature: Useful for making plants with modulated flowering time
MASSSCFLRSILFSSPTNLRSNHHLPTFFPKNHLICSHSTSSRFESLSVSSIGTGSTKKSSDTRRKVKSMATTNIGKEEKKRVEIYDLEENLAIDLAKFTADLSDKFCKERGAFTVVVSGGSLIKSLRKLVESPYVDSIDWARWHFFWVDERVVPKNHDDSNYKLAYDSFLSKVPIPPGNVYAINEALSAEAAADDYETCLKHLVNTNILRVSESTGFPKFDLMLLGMGPDGHVASLFPGHGLCNESKKWVVSISDSPKPPSERITFTFPVINSSAHVALVVCGSGKAEAVEAALKKTGNVPPAGSVSAEDELVWFLDKPASSKL

SEQ ID NO: 13190 - protein, 104 aa, Arabidopsis thaliana
  misc_feature: Ceres CLONE ID no. 4309
  misc_feature: The plant is abnormally small.
  misc_feature: Useful for making plants with modulated biomass
  misc_feature (59)..(59): Xaa is any aa, unknown, or other
  misc_feature (60)..(60): Xaa is any aa, unknown, or other
MGKDNTRILMQFSALAMVLTAAIMVKEATSIPVCNIDTNDLAKCRPAVTGNNPPPPGPXXCAVARVANLQCLCPYKPYLPTVGIDPSRVRPLLANCGVNSPSCF

SEQ ID NO: 13191 - protein, 197 aa, Zea mays subsp. mays
  misc_feature: Ceres CLONE ID no. 465896
  misc_feature: Useful for making plants with modulated nitrogen use efficiency
MGRGRSEIKRIENPTQRQSTFYKRRDGLFKKARELSVLCDVDLLLLLFSTSGKLYHYLSPTVPSVKDLVERYEATTHTKVWTDIRQERRAELEKAEQMCELMEKELRVMTVDDGEQYTVPSLELLEHSLEAAVRKVRSEKDRKIGGEINYLENIIRGRHEERYGLCNKLAHSQASNNEGGGGSTPPSSGLELKLGLN

SEQ ID NO: 13192 - protein, 268 aa, Glycine max
  misc_feature: Ceres CLONE ID no. 471089
  misc_feature: Useful for making plants with altered alkaloid content
  misc_feature: Useful for making plants with altered terpenoid content
MVLIEHEESKQRNANPSNAANDDSDGFETASDTDLAGEGDDSGAGIPEEQNRTEQSHTEKQTEQEPEHDAPRSSKSSENNALISEEESRQKALNQANEAKVEGNKLFVEGKYEEALLQYELALQAAPDMPSSVEIRSICHSNRGVCFLKLGKYDNTIKECTKALELNPVYIKALVRRGEAHEKLEHFEEAIADMKKILEIDLSNDQARKTIRQLEPLAAEKREKMKEEMIAKLKDMGNSVLGRFGMSVDNFKAVKDPNTGSYSISFQR

SEQ ID NO: 13193 - protein, 210 aa, Glycine max
  misc_feature: Ceres CLONE ID no. 473206
  misc_feature: Useful for making plants with modulated nitrogen use efficiency
MDISEDADVIYFTDSTTIFQRRQFMLVLLGGDKTGRLMKYHKSTKEVTILLRDLAFPNGVALSKDGSFVLVAETATCRILQLWLGGPKAGQVDTFAVLPGFPDNIRRNSEGHFWVALHAKRSPFAKWVSSNPWVGKALLKIGFNFKQLHTSFAGWKPHAAAVKLSDKGEILEVLEDCDGKTLKFISEVEEKDGKLWIASVLMPFIGIYGL

SEQ ID NO: 13194 - protein, 259 aa, Glycine max
  misc_feature: Ceres CLONE ID no. 478453
  misc_feature: Useful for making plants with altered Lignin content
  misc_feature (204)..(204): Xaa is any aa, unknown, or other
MHKLGRGHRDKLQQFITITGASEKLALQALKASDWHLEGAFDFFYSQPQLKTFTDSRHLEELYNRYKDAYVDMILADGITLLCNDIQVDPQDIVMLVLSWHMKAGTMCEFSKKEFIEGLQSLGIDSLEKFREKIPYMRSELKDEQKFREIYNFAFGWAKEKGQKSLALDTAIGMWQLLFAEKQWPLVDHWCQFLQARHNKAISXDTWSQLLEFAKTVGSNLSDYDAEGAWPYLIDEFVEYLNENGIIQNDLINDSSLKR

SEQ ID NO: 13195 - protein, 234 aa, Glycine max
  misc_feature: Ceres CLONE ID no. 481710
  misc_feature: The plant flowers significantly late compared to wild-type.
  misc_feature: Useful for making plants with altered terpenoid content
  misc_feature: Useful for making plants with modulated flowering time
  misc_feature (44)..(44): Xaa is any aa, unknown, or other
MFTLNHSSDLYHVSPELSSSLDTSSPASEGSRGVAFSDEEVRLXVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 13196 - protein, 255 aa, Glycine max
  misc_feature: Ceres CLONE ID no. 482122
  misc_feature: The plant flowers significantly late compared to wild-type.
  misc_feature: Useful for making plants with modulated flowering time
MNILGQSLHQSNNGSYSCSSPETANSSNLPTTPKAVHSDEEVNTLASAHPKKRAGRRIFKETRHPVYRGVRRRNNNKWVCEVRVPNDKSTRIWLGTYPTPEMAARAHDVAALSLRGKSACLNFADSAWRLPLPASTNAKEIRRVAAAAAVAIAAEDSRGKQLRTNAIDAVADCEVSSSDIGVDENCNNNKASQRFCDLDEITMPDAPVFEDMHEWLQTMAAEPLRSPTFVTYVNVRDVWNFVEDDAEVSLWSFTV

SEQ ID NO: 13197 - protein, 108 aa, Arabidopsis thaliana
  misc_feature: Ceres CLONE ID no. 5132
  misc_feature: The plant flowers significantly late compared to wild-type.
  misc_feature: Useful for making plants with modulated flowering time
  misc_feature: Useful for making plants with modulated biomass
MATSKLQAIWNHPAGPKTIHFWAPTFKWGISIANIADFAKPPEKLSYPQQIAVTCTGVIWSRYSMVINPKNWNLFSVNVAMAGTGIYQLARKIKHDYATEAEPAVASE

SEQ ID NO: 13198 - protein, 315 aa, Glycine max
  misc_feature: Ceres CLONE ID no. 520515
  misc_feature: Useful for making plants with altered Lignin content
MAAGCISFTATRDRCFRFSFSNAGLKSVTTDLGDGTIMHCWAPKAHKDSKLNLLLIHGFGANAMWQWNDFLSPLTRRFNVYVPDLLFFGDSHTTRPDRSEAFQAQCVAALLQAHGLQRTSVVGISYGGFVAYSLAAQFPERVEKVVLCCAGVCLEDKDLDEGMFQVKTVDEAADILLPQTPEKLRQLVQLAFAKPVKTMPTCFLNDYINVMCTDNRQERKELIETLHKDRKLSNLPKITQPTLIIWGEKDLVFPMELAHRLQRHLGENAQLVVIKNAGHALNVEKPKEMYKNLKSFLIDPATPTPTAQKNHSNGS

SEQ ID NO: 13199 - protein, 279 aa, Arabidopsis thaliana
  misc_feature: Ceres CLONE ID no. 5220
  misc_feature: The leaves start out wild-type green and gradually turn yellow-greenin color, while the cotyledons stay wild-type green.
  misc_feature: Useful for biocontainment applications
MAVSFNTTLHQPSLSPSCSIKLYSGLKPQSASFLASGYQNLNKEFYGRVHKSLQSGTGKASRSRVKMMPIGTPRVPYRNREEGTWQWVDIWNALYRERVIFIGQNIDEEFSNQILATMLYLDTLDDSRRIYMYLNGPGGDLTPSLAIYDTMKSLKSPVGTHCVGLAYNLAGFLLAAGEKGHRFAMPLSRIALQSPAGAARGQADDIQNEAKELSRIRDYLFNELAKNTGQPAERVFKDLSRVKRFNAEEAIEYGLIDKIVRPPRIKEDAPRQDESAGLG

SEQ ID NO: 13200 - protein, 640 aa, Glycine max
  misc_feature: Ceres CLONE ID no. 531768
  misc_feature: Useful for making plants with altered alkaloid content
MSKELGDVEESNKPSTSGGYWDTVETENEVGNTTIPSQGHLDTYVLDPSVSHDQLFSIIDYSPSWAFEGSEIKVIISGEFLRSQHEAEQCKWSCMFGEVEVPAVIIAKGVLCCHTPPHKAGRVPFYVTCSNRLACSEVREFDFQVHYTPEDTTGENRGSTFDTFSIRFGELLSLGHAFPQNSDSISVSEKSQLRSKINSLLREDDDDWDKLLKLTQEKDFSPENLREQLLQNLLKDKLHAWLLQKITEEGKGPNVLDEGGQGVLHFAAALGYDWALEPTIVAGVNVNFRDVNGWTSLHWAAFCGRERTVAFLISLGAAPGALTDPCPEHPSGRTPADLASANGHKGIAGYLAESSLSAHLTTLDLNRDAGENSGAKVVQRLQNIAQVNDLDGLSYELSLKDSLAAVCNATQAAARIHQVFRMQSFQRKQLKEYDDDKLGLSDERALSLIKMNVKSHKSGPRDEPVHAAAIRIQNKFRSWKGRREFLMIRQRIVKIQAHVRGHQVRKSCGKIIWSVGILEKVILRWRRKGSGLRGFKPEANSEGTMIQDVSSTDDDYDVLKEGRKQTEQRLQKALARVKSMVQYPEARDQYHRLLNVVTEIQENQVKHESSSNNSEEPREFGDLNDLEALLDEDIFMPTAT

SEQ ID NO: 13201 - protein, 340 aa, Glycine max
  misc_feature: Ceres CLONE ID no. 533314
  misc_feature: Useful for making plants with altered alkaloid content
  misc_feature: Useful for making plants with altered terpenoid content
MGNISSGGNPRRRHSGASRRSHPPPPPPVTPQPEIAANPFVYHGAAAPYPNPPLHYPQYHYPGYYPPVPPMPYHPHQHQHHHRHMDPAWIQGHFPSGPMMPNPAPFVEHQKAVTIKNDVNIRKETLKLEPDVENSGHFLVSFSFDATVSGSITIYFFAKEGEGCILTPMKENQLAPVSVHFEQGLGQKFRQAAGTGIDFSVFEESELLKVGEKDVYPLAVKADASPGNHDESDRSPTSSNTNSQITQTMFEKEKGEFRVKVVKQILWVNGMRYELQEIYGIRNSTENDQGKCVICLSEPRDTIVLPCRHMCMCSGCAKDSRFQTDRCSICRQPVERLLEI

SEQ ID NO: 13202 - protein, 497 aa, Glycine max
  misc_feature: Ceres CLONE ID no. 534281
  misc_feature: Useful for making plants with altered Lignin content
  misc_feature (99)..(99): Xaa is any aa, unknown, or other
MNHNNSNNSNNNRARYPPGMGLGRGGFNPNLSQNPNQNQNHHAFQARPPYHQQQQAQYVQRHLLQQQQQQQWLRRDANAVDEVEKTVQSEAVDSSSQDXKARLKIPPADTRYKTEDVTATKGNEFEDYFLKRELLMGIYEKGFERPSPIQEESIPIALTGSDILARAKNGTGKTAAFCIPALEKIDQDNNVIQVVILVPTRELALQTSQVCKELGKHLKIQVMVTTGGTSLKDDILRLYQPVHLLVGTPGRILDLTKKGVCILKDCAMLVMDEADKLLSPEFQPSIEQLIHFLPTTRQILMFSATFPVTVKDFKDRYLQKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNAETYLHRVGRSGRFGHLGLAVNLITYEDRFNLYRIEQELGTEIKQIPPQIDQAIYCR

SEQ ID NO: 13203 - protein, 494 aa, Glycine max
  misc_feature: Ceres CLONE ID no. 534311
  misc_feature: Useful for making plants with altered alkaloid content
  misc_feature: Useful for making plants with altered terpenoid content
MTRLTRDFGDTMQRDAVPAVSSDVVFASSRFPNYRIGANNQIIETKDDPKVLSMKEVVARETAQLLEQHNRLSVRDLASKFEKGLAAAAKLSEEARLREAASLEKHVLLKKLRDALESLKGRVAGRNKDDVEEAIAMVEALAVQLTQREGELIQEKAEVKKLANFLKQASEDAKKLVDEERAFARAEIEDARAAVQRVEEALQEHERMSQASGKQDLEQLMREVQEARRIKMLHQPSKVMDMEHELRALRSQLAEKTRQYLRLQKELTRTKKGGENVPHLYELEGNETLGSYLQIQPCSDNAPEVSKCSIQWYRVSSDGAKKELISGATKSVYAPEPFDVGRILQVDIISESEHVTLSTAGPIDPAAGLGTYVEALVRKHDTEFNVVVTQMNGSHHPTESIHVLHVGKMRIKLCKGKTTIAKEYYSSSMQLCGVRGGGNAAAQALFWQPKQGHSFVLAFESERERNAAIMLARRFAFDCNIMLAGPDDRAPLGT

SEQ ID NO: 13204 - protein, 38 aa, Glycine max
  misc_feature: Ceres CLONE ID no. 535374
  misc_feature: Useful for making plants with modulated heat sensitivity
MNEKEKELNRALKVDVERKDRSIEEMALEADEYRKFVF

SEQ ID NO: 13205 - protein, 316 aa, Glycine max
  misc_feature: Ceres CLONE ID no. 537272
  misc_feature: The plant is abnormally small.
  misc_feature: Useful for making plants with modulated biomass
MIGFGGNSCSELSEMDMTNMETNRKFLSLPLSNNNNSGDNRRVPVTSNSIAQEHHYSHHHNPTDTCSVRDKIMAHPLFPRLLSSYLNCLKVGAPPEVVASLEESYAKYESFNASSGRIGGGSIGEDPALDQFMEAYCEMLIKYEQELTKPFKEAMLFFSRIECQLKALAVSSDFGQSETSSKNEVDVHENNLDSQAEDRELKVQLLRKYSGYLGSLKKEFLKKKKNGKLPKEARQQLLDWWNRHYKWPYPSESQKQALAESTGLDMKQINNWFINQRKRHWKPSEDMQFAVMDATNYYMENVMCKPFPMDSMPMLL

SEQ ID NO: 13206 - protein, 155 aa, Arabidopsis thaliana
  misc_feature: Ceres CLONE ID no. 5398
  misc_feature: Useful for making plants with altered Lignin content
  misc_feature: Useful for making plants with altered cell wall content and/or composition
MGLQGQLSDVSSDSIPLMLLSLLAVFINHLRSFLLRLTSKSNPNLPVDDVSIASGLANIIVLADQLSLNRLFSYRCGDGGGGGSDCVVCLSKLKEGEEVRKLECRHVFHKKCLEGWLHQFNFTCPLCRSALVSDDCVSKTQRSVGRDLISCFSLH

SEQ ID NO: 13207 - protein, 757 aa, Glycine max
  misc_feature: Ceres CLONE ID no. 539801
  misc_feature: Useful for making plants with altered Lignin content
MEAILVDCAQKSLRHFMHSNAIFISQRLCAQFPSETNLQLLAGCYLQSNQAYCAYHILKGTQMAQSRYLFAISCFHMDLLSEAEAALRPADEPGAEVPNGAAGHYLLGLIYRCTDRRKNAIQHFKQALSMDPLMWAAYEELCILGAAEEATVVFGEAAAFCLQKQYLNCSTSPNSHMSPEHSNEVAARPCMSEEASPRQLKQMQSLKDIATYHHGASILGGAAGQPINSSSSNMSYYNTPSPMVAQLSSVAPPPLCRNVLPNGQNLTTLSTDSSPKSTVNSPIQAPRRKFVGEGKLRKISGRLFSDSGPRRSSRLSSDSSVNTNANSTVVSGNGTNNSYKGGSKLNHMAFRTMAIRKGQSWANENIDEGICNDVPDDSSLNRTSINSCSSPVIEAKSYEQEAATFHIGGQVTSGSKVITGTSEILTLLRVLGEGYRLACLYRCQDALDTYLKLPQKHYNTGWVLSQVGKAYFELVDYLEADCAFSRARQITPYSLEGMDIHSTVLYHLKEDMKLSYLAQELISTDRLAPQSWCAMGNCYSLQKDHETALKNFQRAVQLNPRFAYAHTLCGHEYVALEDFENGIKCYHSALRVDSRHYNAWYGLGMLYLRQEKYEFSEHHFHMAYQINPRSSVILSYLGTALHALKRSGEALAIMEKAILEDKKNPLPMYQKASILVSLERIDEALDVLEELKEAQPRESSVYALMGNIYRRRHMHERAMFHYGVALDLKPSITDAAMIKAAVEKLIIPDEFQDEDDS

SEQ ID NO: 13208 - protein, 236 aa, Glycine max
  misc_feature: Ceres CLONE ID no. 540582
  misc_feature: Useful for making plants with modulated nitrogen use efficiency
MSSGATYWCYTCRQPICLARRDHICPYCDEGFLQELDELQGGMEQRGSEPRMGGRYINFGVRRPGSTPLPESWTRGVFIFPNQEVAADREGFFEQHITNDPLGASQSSIDAMPTIKITHEHLYSNPKCSVCIERFEVGSEARKMPCDHIYHSDCIVPWLVHHNSCPVCRGKLPPEGHVSSRGSQIWRGRNVNGNSENDIYRGRENRQFNDGWRNLLSFLNFCGQSFLLIQILNRWS

SEQ ID NO: 13209 - protein, 375 aa, Glycine max
  misc_feature: Ceres CLONE ID no. 541719
  misc_feature: Useful for making plants with altered Lignin content
MEGSSCSNDTSYLLAFGENSGGLCPMTMMPLVTSHHATNPSNPSNNTNNNENTNCLFIPNCSNSSGTPSIMLHNNNNTDDDNNKTSTNTGLGYYFMESDHHHRNNNNNGSSSSSSSSAVKAKIMAHPHYHRLLAAYVNCQKVGAPPEVVARLEEACASAATMAGDAAAAAGSSCIGEDPALDQFMEAYCEMLTKYEQELSKPLKEAMLFLQRIECQFKNLTISSTDFACNEGAERNGSSEEDVDLHNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVLGNPFPMDLSHPML

SEQ ID NO: 13210 - protein, 221 aa, Glycine max
  misc_feature: Ceres CLONE ID no. 542773
  misc_feature: Useful for making plants with altered Lignin content
MGRGKIVIRRIDNSTSRQVTFSKRRNGLVKKARELSILCDAEVGLIVFSSTGKLYDYASTSMKSVIERYNKVKEDHQQLINPASEVKLWQREVASLRQQVQYMQECHRQMMGQELSGLGIEELGNLEKRLEMSLKGVRMKKDQILIDEVKELHQKGSLAHQENVELNRKINLIRKENEELQKVIEAKCRKGVAASNPPFTINYGCNMLAPISLQLSLPEST

SEQ ID NO: 13211 - protein, 216 aa, Glycine max
  misc_feature: Ceres CLONE ID no. 543118
  misc_feature: Useful for making plants with altered Lignin content
  misc_feature (123)..(123): Xaa is any aa, unknown, or other
MAAAPARARADYDYLIKLLLIGDSGVGKSCLLLRFSDGSFTTSFITTIGIDFKIRTIELDSKRIKLQIWDTAGQERFRTITTAYYRGAMGILLVYDVTDEASFNNIRNWIRNIEQHASDNVNXILVGNKADMDESKRAVPTSKGQALADEYGIKFFETSAKTNMNVEEVFFSIARDIKQRLADTDSRAEPQTIKINQPDQATSGGQPAQKSACCGS

SEQ ID NO: 13212 - protein, 310 aa, Glycine max
  misc_feature: Ceres CLONE ID no. 543840
  misc_feature: Useful for making plants with modulated nitrogen use efficiency
MDPSSGQHQQMSSQSLENMLACSKAHQERKPTPQPEQALKCPRCDSTNTKFCYYNNYSLSQPRYFCKSCRRYWTKGGTLRNVPVGGGCRKNKRSSSSSSTSKRVQDQAFTPNVNPLTGLPSLMSYDSNDLTLALARLQKQSCGQLGYDDHDLSMLGNHHTNTPCGDNILGMHHHSSSSSTNPGFLDALRSGFLGTQSNNNMHQNMYYGYGNGDMGEVDNGGGVGVSSSGEMMMMMMPYNNDQEMSIASTQAVTVTTMKQEICNGREQKVLWGFPWQLNGDTNMGELDSGRASNWNGINSSWHGLLNSPLM

SEQ ID NO: 13213 - protein, 191 aa, Glycine max
  misc_feature: Ceres CLONE ID no. 545208
  misc_feature: The plant produces a reduced number of seeds.
  misc_feature: Useful for biocontainment applications
MSHIAVERNRRRQMNEHLKVLRSLTPCFYIKRGDQASIIGGVIEFIKELHQVLQALESQKRRKSLSPSPGPSPRTLQPMFHQLDSPSMIGTNSFKELGASCNSPVADVEVKISGSYVILKVICHRIPGQVAKIITVLESLSFEVLHLNISSMEETVLYQFVVKIELGCQLSLEELAMEVQQSFCLDAIIAL

SEQ ID NO: 13214 - protein, 399 aa, Glycine max
  misc_feature: Ceres CLONE ID no. 553603
  misc_feature: Useful for making plants with altered terpenoid content
MVPNFLIARLAVSLTHHRSTHIQLGSLLQHKRNAFLLLFNSFTSGTSSDSESDGNHQKGGTFTVSYLINSCGVSPTLARKLSNKVNLKTPHGPNAVLDLLNNYGFDKIQVAKLVEKHPLVLLADAENTLLPKLKFLRSIGVSNTDMPKILIANHSLKRSLKKFFIPRYEILRRVLGDDQEVVRAITSSRFGINYGDAMNLVPNIEVLRQSGVPQASISFMMIHCGTVAYWKHSRFVEAVNTAKEIGFNPLRTNFIVAIEMLLISSKAVWESRFKVYERWGWNREMALQAFRKFPNVMRLSEEAFSKKMNFLVNDMGWPSEEIAEYPQVVAYNLEKRIIPRFSVIKILKSKGLLENNVSFSSIICITEEKFLENFVISLQKDLPVLPDLYRGKIKPSDVM

SEQ ID NO: 13215 - protein, 282 aa, Glycine max
  misc_feature: Ceres CLONE ID no. 557009
  misc_feature: Useful for making plants with altered Lignin content
MDTCKKSPLKPWKKGPTRGKGGPQNASCEYRGVRQRTWGKWVAEIREPKKRTRLWLGSFATAEEAAMAYDEAARRLYGPDAYLNLPHLQPRSTSTITSGKFKWFPSKNFISMFPSCGLLNVNAQPSVHLIHQRLQELKRNSVVSQSSSSSSNDPKAEIQNVDSKNHGEDENPPKDVQTSSEEVLGDLQEKPQIDLHEFLQQMGILKEERQSERTDSSGSSTVREAVLTDDCDHLGVFSDKSVNWEALIEMHGLAGIQESEVTQLEAYEPNDDLTFSTSIWNF

SEQ ID NO: 13216 - protein, 272 aa, Glycine max
  misc_feature: Ceres CLONE ID no. 558003
  misc_feature: Useful for making plants with altered Lignin content
MSSSTQDEISFVLRQFLLRSSVTTHESNDDARNSMSKTALPDGISAYKGSSAANVSSLSVAASENETDDFDCESEEEEVPTPPKSIRSRSSSKRNRVAEVHNLSEKRRRSRINEKLKALQNLIPNSNKTDKASMLDEAIEYLKQLHLKVQMLSMRNGLSLHTMFFQEGLQPLQLSQVPRMDSGEESRLIPSNPTASLPMHQENPMHYLSNLPNKLAMADQQSVPTPSYIINSETSFRLESPIPENIRSFQLRRFPEMCREDILQHQHLNANH

SEQ ID NO: 13217 - protein, 114 aa, Glycine max
  misc_feature: Ceres CLONE ID no. 560692
  misc_feature: Useful for making plants with modulated salt sensitivity
MKQKCLVVLVFVVLLACAFGWDEGIPGGWNPIKNINDPHVTEIANFAVTEYDKQSGEKLKLVKVIKGDLQVVAGLNYRLSLTASDSNNYQAIVYEKAWAREHYRNLTSFTPLHA

SEQ ID NO: 13218 - protein, 111 aa, Arabidopsis thaliana
  misc_feature: Ceres CLONE ID no. 5609
  misc_feature: The plant produces a reduced number of seeds.
  misc_feature: Useful for biocontainment applications
  misc_feature: Useful for making plants with modulated nitrogen use efficiency
MEEQNAGTGAGESSLLDGSGHWWWALGSGAQIMWGIRLIRRGYAGDVRLMPLKAFGVASLFVGSLATSSVALVRATGIHTVQDAIDLGANIRTNLGVTPQIPDKQITERDG

SEQ ID NO: 13219 - protein, 110 aa, Glycine max
  misc_feature: Ceres CLONE ID no. 560961
  misc_feature: Useful for making plants with altered Lignin content
MRRGRATAAVVDPTAEQAKETRFRGVRKRPWGRFAAEIRDPWKKQRVWLGTFDSAEDAARAYDKAARSFRGPKAKTNFPSFPGPTDHHSSQQIPPLYRPTGFPPSSSPPR

SEQ ID NO: 13220 - protein, 226 aa, Glycine max
  misc_feature: Ceres CLONE ID no. 563878
  misc_feature: Useful for making plants with altered alkaloid content
MAFYNEEEKTEDYLFKIVLIGDSAVGKSNLLARFARDEFYPNSKSTIGVEFQTQKMDINGKEVKAQIWDTAGQERFRAVTSAYYRGAVGALLVYDISRHQTFDSIGRWLNELHTHSDMNVVTILVGNKSDLKDAREVATAEGKALAEAQGLFFMETSALDSSNVAAAFETVVKEIYNILSRKVMMSQELNKQDVTRIENGKTVVLQGEGEGDGEADAQSKKRCCSS

SEQ ID NO: 13221 - protein, 135 aa, Glycine max
  misc_feature: Ceres CLONE ID no. 567053
  misc_feature: Useful for making plants with modulated nitrogen use efficiency
MGAILSALTGGAATAATSSPESSASRVQSFHSSARWQLHFNELKETNKLVVIDFSASWCGPCKFIEPAIHAMSEKFTDVDFVKIDVDELPDVAKEFNVEAMPTFVLCKKGKEVDKVVGAKKDELEKKIEKHRSQS

SEQ ID NO: 13222 - protein, 461 aa, Glycine max
  misc_feature: Ceres CLONE ID no. 597609
  misc_feature: Useful for making plants with altered alkaloid content
MLDLNLTAESTQNDELLVLLDKFPEASSGTSNSSIVNAEGSSNEDSCSTRAGDVFTFNFGILKVEAANDVVAAATKELFPVSSENWQGQSSTSLFQARKSLMDLSLDQQHGEVKVVQVQPQPKVKKSRRGPRSRSSQYRGVTFYRRTGRWESHIWDCGKQVYLGGFDTAHAAARAYDRAAIKFRGLDADINFNLVDYEEDLKQMKNLSKEEFVHILRRHSSGFSRGSSKYRGVTLHKCGRWEARMGQFLGKKAYDKAAIKCNGREAVTNFEPSTYESEMKPEAINEGGSHDLDLSLGIATPGHGPKENRGHLQFQSIPYNMHPGRSSMMETNINSVIGDPSLKRLVVTEERPSVWNAAYSTFFPNLERAERMGTDPSKGVPNPNWAWQTHGQVTDTPVPPFSTAASSGFSISATFPSTAIFPTKSINSVPHSLCFTSPSTPGSNAPQFYNYYEVKSPQPPS

SEQ ID NO: 13223 - protein, 150 aa, Glycine max
  misc_feature: Ceres CLONE ID no. 599633
  misc_feature: Useful for making plants with altered alkaloid content
MAKKAKGSHSASSASASSSSDKLVLRIKSNEGTKRSVRQTNSRKKLKAKQKKNKQKFDAMKPRKPPTAFFYFLEDFRKEFQEQNPDVKSMRDIGKACGEKWKTMTYEEKVQYYDIATKKREEFDSAMAEFNKKMENGEFDETDDESEFDE

SEQ ID NO: 13224 - protein, 211 aa, Glycine max
  misc_feature: Ceres CLONE ID no. 603410
  misc_feature: Useful for making plants with altered Lignin content
  misc_feature: Useful for making plants with altered alkaloid content
MSSTTTDSDCSYLEQIQQYLLHNDSTILTPPQAFPSPSHDSSSDASVHFEHPSEAHDVNAPPKWRRYRGVRRRPWGKFAAEIRDPKKNGSRVWLGTYVNEEEAALAYDKAAFNMRGQKAKLNFPHLIGSAVQPEPPCLAVSKRSLPESSPPTSPYDSCESKGSKRRKSLVDLLNNLAKNKSQAKVVEMALEANEVEQWVNELNDCTLFWCS

SEQ ID NO: 13225 - protein, 268 aa, Arabidopsis thaliana
  misc_feature: Ceres CLONE ID no. 6042
  misc_feature: Useful for making plants with altered Lignin content
  misc_feature: Useful for making plants with altered cell wall content and/or composition
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDCLLVL

SEQ ID NO: 13226 - protein, 202 aa, Glycine max
  misc_feature: Ceres CLONE ID no. 605218
  misc_feature: Useful for making plants with altered Lignin content
  misc_feature: Useful for making plants with altered alkaloid content
MVSATVDSDFAFLESVQQYLLGHDSINLMSETHQAASHDPFSDPNKCDGDSGNIAFRSEDATAVVARDHAPPTWKHYRGVRRRPWGKFAAEIRDPKKNGARVWLGTYDTEEKAALAYDKAAFKMRGQKAKLNFPHLIDSDNSDELSEPVMMTTSKRSLLEISSPSSSCSDDSSESQGTKRRKSLAELLNKLAKNRSQVKVEC

SEQ ID NO: 13227 - protein, 332 aa, Arabidopsis thaliana
  misc_feature: Ceres CLONE ID no. 6066
  misc_feature: Useful for making plants with altered terpenoid content
MGNALTFLYGKCCKPTTTDDSLGPHGVSAATVGVSALAHDLFNFEITSQVPEGLGRYVQSSRKAQANWYRKILEAWKQAKPPPQTAEEASRLVTDILKRNQKADVEGLLSFYGLPLSHTLVEVTVEAPVSLPEGILFEFQTLPVDPKAVADGDTITVYVSTSEPVVSSSVPREVNLAAVQRAKAREKRNYPKADELHQKIIDSGYRVLNIENEEVLARKFRIRLRGIDAPESQMPFGKEAQEGLLKIVGRKSLKVLVYGEDQYGRCVGDLYCNGIFVQEAMLKKGLAWHYLAYDKRPVLAKWEKEARQKRIGLWASSNPEKPWDWRKNNRRE

SEQ ID NO: 13228 - protein, 171 aa, Glycine max
  misc_feature: Ceres CLONE ID no. 608818
  misc_feature: The plant is abnormally small.
  misc_feature: Useful for making plants with modulated biomass
MADGPASPGGGSHESGEHSPRSNVREQDRYLPIANISRIMKKALPANGKIAKDAKETVQECVSEFISFITSEASDKCQREKRKTINGDDLLWAMATLGFEDYIDPLKIYLTRYREMEGDTKGSAKGGDSSSKKDVQPSPNAQLAHQGSFSQGVSYTISQGQHMMVPMQGPE

SEQ ID NO: 13229 - protein, 277 aa, Glycine max
  misc_feature: Ceres CLONE ID no. 638403
  misc_feature: The plant flowers significantly late compared to wild-type.
  misc_feature: Useful for making plants with modulated flowering time
  misc_feature: Useful for making plants with modulated low light sensitivity
  misc_feature: Useful for making plants with modulated light quality response
MKGEYVEQQQQHPKSETPPSMFSKLQPQHHPFPHHPFQLSAEDATTITPSTAQKANSSGGDGATIEVVRRPRGRPPGSKNKPKPPVIITRDPEPAMSPYILEVSGGNDVVEAIAQFSHRKNMGICVLTGSGTVANVTLRQPSTTPGTTVTFHGRFDILSVSATFLPQQSGASPAVPNGFAISLAGPQGQIVGGLVAGGLMAAGTVFVIAASFNNPAYHRLPPEEEGASAGDGHSPPVSGGGDSGHGQAESCGMSMYSCHLPSDVIWAPTARPPPPPY

SEQ ID NO: 13230 - protein, 226 aa, Arabidopsis thaliana
  misc_feature: Ceres CLONE ID no. 6397
  misc_feature: Useful for making plants with altered Lignin content
  misc_feature: Useful for making plants with altered alkaloid content
MSSSDSVNNGVNSRMYFRNPSFSNVILNDNWSDLPLSVDDSQDMAIYNTLRDAVSSAWTPSVPPVTSPAEEDKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGKSSLVVPELDFTVDQFYFDGSLLMDQSECSYSDNRI

SEQ ID NO: 13231 - protein, 379 aa, Arabidopsis thaliana
  misc_feature: Ceres CLONE ID no. 6399
  misc_feature: Useful for making plants with modulated oxidative stress sensitivity
MPASFKVIHDPIKETDSINADFGESAIGRVAPVDSGFWWIILLRAYTKSTGDTSLAETSECQKGMRLILSLCLSEGFDTFPTLLCADGCSMIDRRMGVYGYPIEIQALFFMALRSAMSMLKHDAEGKEFMERIVKRLHALSFHMRSYFWLDFQQLNDIYRYKTEEYSHTAVNKFNVIPDSIPEWVFDFMPLRGGYFIGNVSPARMDFRWFALGNCVAILASLATPEQSASIMDLIEERWEELVGAMPVKICHPAIESHEWRIVTGCDPKNTRWSYHNGGSWPVLLWLLTAACIKTGRPQIARRAIDLAEARLLKDGWPEYYDGKSGRFIGKQARKFQTWSIAGYLVAKMLLEDPSHLGMISLEEDKQTKPVIKRSYSWT

SEQ ID NO: 13232 - protein, 267 aa, Arabidopsis thaliana
  misc_feature: Ceres CLONE ID no. 6493
  misc_feature: Useful for making plants with altered alkaloid content
MEGYSRNGEISPKLLDLMIPQERRNSFHDEKNSVFKTEEKKLELKLGPPGEEDDDESIIRHMKKEPKDKSILSLAGKHFSPSSTKTTSHKRTAPGPVVGWPPVRSFRKNLASGSSSKLGNDSTTSNGVTLKNQKCDDAAKTTEPKRQGGMFVKINMYGVPIGRKVDLSAHNSYEQLSFTVDKLFRGLLAAQRDFPSSIEDEKPITGLLDGNGEYTLTYEDNEGDKMLVGDVPWQMFVSSVKRLRVIKTSEISSALTYGNGKQEKMRR

SEQ ID NO: 13233 - protein, 299 aa, Glycine max
  misc_feature: Ceres CLONE ID no. 660003
  misc_feature: The plant flowers significantly late compared to wild-type.
  misc_feature: Useful for making plants with altered Lignin content
  misc_feature: Useful for making plants with altered terpenoid content
  misc_feature: Useful for making plants with modulated flowering time
  misc_feature (239)..(239): Xaa is any aa, unknown, or other
MSSIHHYSPETTLYWTSDHQQQQQQQQQQQQQAATWLSNSHTPRFNLNEDDDEEDDVVVSDKATNNLAQEQEKEAMFEKPLTPSDVGKLNRLVIPKQHAEKYFPLDSSGGDSAAAKGLLLSFEDESGKCWRFRYSYWNSSQSYVLTKGWSRYVKDKRLHAGDVVLFHRHRAHPQRFFISCTRHQPNPNPPAHVSIRSSSYSALPAYPTHHHHHLPFPYQPHSLHAPGGGSQGQNETTPXGNSSSGRVLRLFGVNMECQPDNDNDSQNSTHECSYTHLYHHQTSSYPSSNPHHHMLPQQP

SEQ ID NO: 13234 - protein, 271 aa, Glycine max
  misc_feature: Ceres CLONE ID no. 664026
  misc_feature: Useful for making plants with modulated cold sensitivity
MASLIESGWQYLITHFSDFQLACLGSFFLHEGVFFLSGLPFIWLERAGWMSKYKIQAKNNTPAAQEKCIVRLLLYHFGVNLPVMIFSYPVFTYMGMRSSLPLPSWKVVLIQIIFYFILEDFIFYWGHRILHTKWLYKHVHSVHHEYATPFGLTSEYAHPAEILFLGFATIFGPAITGPHLITLWLWMVLRVLETVEAHCGYHFPWSLSNFLPLYGGADFHDYHHRLLYTKSGNYSSTFTYMDRIFGTDIGYRKLKALKSIGVEDSGEQKKQ

SEQ ID NO: 13235 - protein, 358 aa, Arabidopsis thaliana
  misc_feature: Ceres CLONE ID no. 6674
  misc_feature: Useful for making plants with modulated drought sensitivity
MGKASGLLLFLLGFGFFVVTYNLLTLIVHNRSGVSNSDGSPLLDPVVQMPLNIRKAKSSPAPFHVALTATDAPYNKWQCRIMYYWYKQKKALPGSDMGGFTRILHSGNSDNLMDEIPTFVVDPLPPGLDRGYVVLNRPWAFVQWLERATIKEDYVLMAEPDHVFVNPLPNLAVGGFPAAFPFFYITPEKYENIVRKYYPAEMGPVTNIDPIGNSPVIISKESLEKIAPTWMNVSLTMKNDPETDKAFGWVLEMYGYAIASAIHGVRHILRKDFMLQPPWDLSTKGKFIIHYTYGCDYNMKGELTYGKIGEWRFDKRSHLRGPPPRNMSLPPPGVPESVVTLVKMVNEATATIPNWDTL

SEQ ID NO: 13236 - protein, 172 aa, Arabidopsis thaliana
  misc_feature: Ceres CLONE ID no. 6685
  misc_feature: The plant is abnormally small.
  misc_feature: Useful for making plants with modulated biomass
  misc_feature (8)..(8): Xaa is any aa, unknown, or other
MLHSYLGXAEMVPEFAKLGAYFSFSGFLMSMSEKKAKKMLKAVPSDRILLETDSPDALPKAESGCLYFVDGDPSLPEEGNSAQDLDSASYDKPNVSSDSMKLTKETLNHPANIHIVLGYVAQLLDMKNEELAELSYQNAVRLFSYEGSKILLDRGTGDVSGHTQNQSTTHVS

SEQ ID NO: 13237 - protein, 417 aa, Glycine max
  misc_feature: Ceres CLONE ID no. 674157
  misc_feature: Useful for making plants with altered alkaloid content
  misc_feature: Useful for making plants with altered terpenoid content
MDRVFSVDNISDHFWPPPPIPVSGANTSSQMSRSASEWAFQRFIQEASASAPSPPSSSSPADVVFVEIDDQPKPTPPPPSHGGVLPSDPGPVALDSEEYQAFLKSKLNLACAAVAMTRGSLAKSQDPSPFSDGGSQPTNPSLVGSQTTSKGSIPSGNDQSKLQDKDINAPVGIPSIPAIQKKPAVAIRPSTSGSSREQSDDEDIEGETSMNDNTDPADVKRVRRMLSNRESARRSRRRKQAHLTDLETQVSQLRGENSTLLKRLTDVSQKYSDSAVDNRVLKADVETLRAKVKMAEETVKRITGLNPMPHAMSDISSLGLPSFDGRSPSDTSADASVPVQDDPHHHFYQPTLNNPIPSHDPIVNNGLGGISSIENVQQQNAAAVVGGNKIGQTASLQRVASLEHLQKRIRGGPPSEQ

SEQ ID NO: 13238 - protein, 221 aa, Arabidopsis thaliana
  misc_feature: Ceres CLONE ID no. 6827
  misc_feature: Useful for making plants with altered Lignin content
MAFYSEDDKSEDYLFKIVLIGDSAVGKSNLLARFARDEFYPNSKSTIGVEFQTQKMDINGKEIKAQIWDTAGQERFRAVTSAYYRGAVGALLVYDISRRQTFHSIGRWLNELHTHSDMNVVTILVGNKSDLKDLREVSTAEGKALAEAQGLFFMETSALDSSNVAAAFETVVKEIYNILSRKVMSSQELNKQDPASLSNGKKVVIPSDGQGESKKGGCCSS

SEQ ID NO: 13239 - protein, 162 aa, Triticum aestivum
  misc_feature: Ceres CLONE ID no. 684584
  misc_feature: The plant is abnormally small.
  misc_feature: Useful for making plants with modulated biomass
MAAQAPPPPPPEQKMMVAIDESECSHYALEWALRNLAPRRLILFTVQPFSPLSYLPVGSPLGPSVASPELIRSVTEHQRQLAQALVDKAKAICAEHGVDAETVIEVGDPKETICEAAEKLNVDLLILGSHSRGPVQRFFLGSVSNYCSHHAKCPVLVVKKKE

SEQ ID NO: 13240 - protein, 453 aa, Glycine max
  misc_feature: Ceres CLONE ID no. 691319
  misc_feature: Abnormal phyllotaxy, leaf number higher than wild-type
  misc_feature: The plant is abnormally small.
  misc_feature: Useful for making plants with altered Lignin content
  misc_feature: Useful for making plants with altered cell wall content and/or composition
  misc_feature: Useful for making plants with altered terpenoid content
  misc_feature: Useful for making plants with modulated biomass
MSLLTVAHQRGSGEFIRFTESHGGGGDDVSGDGEHGCGHDDGSGAGGSLGLNFNQVMQQGEVTMQGGSLVSGYNRGDPELREIVSALTHVVSSGSGQRSTELTQQSGFPMMSASSLSRLSAFSSSSPSPSSGASWVGHKRGREEEENSTSHNLMQQQQQSAPRLFRNIGDFMVPSQGDSSSVTEEAPTSTTTTVTAVTENPPGGGERRRKYRGVRQRPWGKWAAEIRDPHKAARVWLGTFDTEEAAARAYDEAALRFRGNRAKLNFPENVRAVPPIQPFQATTRLTVSDSTTSQFRPLSAVAPPFIQQPQIQGSSDLIRDYLQYSQLLQSDFQQQQIQQQQQQQRQQQQRQRQQRQQQQQQQQQPSSLLQQLYYNAQFASLQSPSMLSSSPSFSSSVSPAPFPLFTTSASFPLFSSQQMGYFQPPESRNPAGGVPEFPTSTWSDTSSQPPPSG

SEQ ID NO: 13241 - protein, 196 aa, Arabidopsis thaliana
  misc_feature: Ceres CLONE ID no. 7201
  misc_feature: Useful for making plants with altered terpenoid content
MAGMLPGVECARRRRFHGGAPPIESSNTASVAAAAGHVWTRRPSFSLYTTNHESHQAHVSFSERSVRNKSYGEDNDEKLDGAAKEAKQRLNKRLRIPPRTRQNGKDKGNKLEQGKGKPLGDLPTEVVGLKKSRGRLMEWFKRRVREQQDCAICLDRFKKGETLVHLPCAHKFHSICLLPWLDTNVYCPYCRTDIWN

SEQ ID NO: 13242 - protein, 142 aa, Arabidopsis thaliana
  misc_feature: Ceres CLONE ID no. 727
  misc_feature: Useful for making plants with modulated nitrogen use efficiency
MEKFCCVVAYKITKEEDKRDALLHLEVREKQYDQKEYLDFFTDYNASEPAVAGVMVYIASPDKKSNNNYLGPAPLEDIAKQIVKAKGPSGPNRDYLFNLEEALAQLGFKDKHVTDLANQVRHILSESEELDIDATAATANNV

SEQ ID NO: 13243 - protein, 105 aa, Arabidopsis thaliana
  misc_feature: Ceres CLONE ID no. 74
  misc_feature: The plant produces a reduced number of seeds.
  misc_feature: Useful for biocontainment applications
MAGVMQKFLIASMFMWILPIAILYGFNNDLLPGSTTLSPHSLTLLSGFLAVVSVNVVIVFYICLALKEPADKHKPDASFVAEAKDSVKKLTSGVTNTDPALKKQE

SEQ ID NO: 13244 - protein, 281 aa, Arabidopsis thaliana
  misc_feature: Ceres CLONE ID no. 75
  misc_feature: The plant produces a reduced number of seeds.
  misc_feature: Useful for biocontainment applications
MEFVVEEGKLVNEDCSTLVLPALSIGNVGQLAVDLLVSSTGAERVGYLDDPNLLPCVGNDAYGPLPCGEIALPLEVYESSSIATTLAQQRSPVAKGMMIKFAENIANFAASSGKKHVIVLSSLDFQRLHNLDMSRGPQVYYLSNAESDGRDDHCERLGFGRLHEYDSEGRCWKYLSSVFEKNSVEELALPSEDELEDIDYYPSLPFAALFSAFKARGLKMTCLLCYCSEGDNIPEAFLLAEASSKLMGLTPDKFHGEEGGKWQIPYSWKSMYGAPPDMSMF

SEQ ID NO: 13245 - protein, 268 aa, Arabidopsis thaliana
  misc_feature: Ceres CLONE ID no. 7559
  misc_feature: Useful for making plants with altered Lignin content
  misc_feature: Useful for making plants with altered alkaloid content
MSSRWNRTIYVGNLPGDIRKCEVEDLFYKYGPIVDIDLKIPPRPPGYAFVEFEDPRDADDAIYGRDGYDFDGCRLRVEIAHGGRRFSPSVDRYSSSYSASRAPSRRSDYRVLVTGLPPSASWQDLKDHMRKAGDVCFSEVFPDRKGMSGVVDYSNYDDMKYAIRKLDATEFRNAFSSAYIRVREYESRSVSRSPDDSKSYRSRSRSRGPSCSYSSKSRSVSPARSISPRSRPLSRSRSPYSSVSRSQSRSKSRSRSRSNSPVSPVISG

SEQ ID NO: 13246 - protein, 168 aa, Triticum aestivum
  misc_feature: Ceres CLONE ID no. 772669
  misc_feature: Useful for making plants with modulated nitrogen use efficiency
MKPLLTSDDAIELLSDQSEVNDMSDRLISACAFCSISPRLPRLEKLLKTWFSERNGFNRTMNFFEARVTSMTLVKFRLELERDITEEDDIWDDVPEWKTLPVVQRITLDVIARVEEEGRLKAISVKKVRKSLHIADATSWSSLTSNVSFADFTSLVLPPDPLSLDVKW

SEQ ID NO: 13247 - protein, 141 aa, Arabidopsis thaliana
  misc_feature: Ceres CLONE ID no. 7805
  misc_feature: Useful for making plants with altered alkaloid content
  misc_feature: Useful for making plants with altered terpenoid content
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 13248 - protein, 259 aa, Arabidopsis thaliana
  misc_feature: Ceres CLONE ID no. 8049
  misc_feature: Useful for making plants with altered Lignin content
  misc_feature: Useful for making plants with altered cell wall content and/or composition
MATTTTEATKTSSTNGEDQKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDEIVADEKNHGTYDFIFVDADKDNYINYHKRLIDLVKIGGVIGYDNTLWNGSVVAPPDAPMRKYVRYYRDFVLELNKALAADPRIEICMLPVGDGITICRRIS

SEQ ID NO: 13249 - protein, 347 aa, Arabidopsis thaliana
  misc_feature: Ceres CLONE ID no. 8327
  misc_feature: Useful for making plants with modulated salt sensitivity
MGNKIISMMKKDSKDGGGGSKSKRMNRSQRKLLADEEMLHRRALSMAIHQAQLSQRFDGSMSRRVGSTSTRKRTLSDPFSNGKQVPDFSESLIVKKFVLVHGEGFGAWCWYKMVASLEESGLSPVTVDLTGCGFNMTDTNTVSTLEEYSKPLIDLLENLPEEEKVILVGHSTGGASISYALERFPEKISKAIFVCATMVSDGQRPFDVFSEELGSAERFMKESQFLIYGNGKDKPPTGFMFEKPHMKGLYFNQSPNKDIALAMISMRPVPLGPMMEKVSLTAERYGKGRRFYVQTLDDRALSPDVQEKLVRENSPEGVFKIKGSDHCPFFSKPQSLHKILLEIAQIP

SEQ ID NO: 13250 - protein, 318 aa, Arabidopsis thaliana
  misc_feature: Ceres CLONE ID no. 8334
  misc_feature: Useful for making plants with altered Lignin content
MDYKVSRSGEIVEGEVEDSEKIDLPPGFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRLEGKYGIDNLPKTAKNECVISRVFHKRTDGTKEHMSVGLPPLMDSSPYLKSRGQDSLAGTTLGGLLSHVTYFSDQTTDDKSLVADFKTTMFGSGSTNFLPNIGSLLDFDPLFLQNNSSVLKMLLDNEETQFKKNLHNSGSSESELTASSWQGHNSYGSTGPVNLDCVWKF

SEQ ID NO: 13251 - protein, 77 aa, Triticum aestivum
  misc_feature: Ceres CLONE ID no. 840016
  misc_feature: Useful for making plants with modulated heat sensitivity
MAAVDLSKLVKEKRFWAASFLIAWAAALQGHMMWLKRQDAFKDKFGDPEAPNKVTEQGHQQPPAGEQGELTADAEIR

SEQ ID NO: 13252 - protein, 187 aa, Arabidopsis thaliana
  misc_feature: Ceres CLONE ID no. 8916
  misc_feature: The plant produces a reduced number of seeds.
  misc_feature: The plants are small.
  misc_feature: Useful for biocontainment applications
  misc_feature: Useful for making plants with modulated biomass
MRPLDETETTVVFEKLFKFVGNNLKKIVENPSDEGPESTPGSYCFRLQKNRVYYVSEALVKRATNISRKNLVSFGTCIGKYTHAGSFHLTIMSLNILAANAKHKVWLKPTSEMSFLYGNHVLKGGLGRITDSIVPGDGVVVFSMSDVPLGFGIAAKSTQDCRKLDPNGIVVLHQADIGEYLRGEDDL

SEQ ID NO: 13253 - protein, 85 aa, Zea mays
  misc_feature: Ceres CLONE ID no. 896483
  misc_feature: Useful for making plants with modulated nitrogen use efficiency
  misc_feature: Useful for making plants with modulated nitrogen use efficiency
MSASRSSSPNSISQWSQKENKMFEEALAYYGEGTSNRWDKVSRAMGGIKSAEEVRCHYEDLDYDVKMIESGHVPYPKYKTHGFWT

SEQ ID NO: 13254 - protein, 213 aa, Arabidopsis thaliana
  misc_feature: Ceres CLONE ID no. 907
  misc_feature: The plant flowers significantly late compared to wild-type.
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: Useful for making plants with modulated flowering time
MEIKVDEGHQKGTKEDITRPLLEEDKDFPDIERTTWIQKAIGQTFQTTAHLANLLPTGTVLAFQLLSPIFSNGGQCDLVSKIMTSTLVAICGFSCFILSFTDSYKDKNGTICYGLATIHGFWIIDGSTTLPQELSKRYKLRFIDFVHAFMSLFVFGAVVLFDRNAVNCFFPSPSAEALEVLTALPVGVGVFSSMLFATFPTTRNGIGFPLSSK

SEQ ID NO: 13255 - protein, 119 aa, Arabidopsis thaliana
  misc_feature: Ceres CLONE ID no. 9221
  misc_feature: The plant is abnormally small.
  misc_feature: Useful for making plants with modulated biomass
MTNTRAIYAVIAILAIVISAVESTGDFGDSLDFVRAGSSSLFSGCTGSIAECIAEEEEMEFDSDISRRILAQKKYISYGAMRRNSVPCSRRGASYYNCQRGAQANPYSRGCSTITRCRR

SEQ ID NO: 13256 - protein, 107 aa, Arabidopsis thaliana
  misc_feature: Ceres CLONE ID no. 92448
  misc_feature: Useful for making plants with modulated heat sensitivity
MENKSPSKKNKPPSCGSLVTILSLDGGGVRGIIAGVILAFLEKQLQELDGEEARLADYFDVIAGTSTGGLVTAMLTVPDETGRPHFAAKDIVPFYLEHCPKIFPQPT

SEQ ID NO: 13257 - protein, 196 aa, Arabidopsis thaliana
  misc_feature: Ceres CLONE ID no. 92459
  misc_feature: The plant flowers significantly late compared to wild-type.
  misc_feature: The plant is abnormally large.
  misc_feature: There is no branching.
  misc_feature: Useful for making plants with modulated biomass
  misc_feature: Useful for making plants with modulated flowering time
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 13258 - protein, 181 aa, Arabidopsis thaliana
  misc_feature: Ceres CLONE ID no. 92525
  misc_feature: Useful for making plants with modulated nitrogen use efficiency
MPPTNNYRISGEPPSTTPSPPPPKPKTRILSLFLVGVIMFSIFFLFLVLIGIASVLILPLLLSSLHRHHRRRRRNRRQESSDGLSSRFVKKLPQFKFSEPSTYTRYESDCVVCFDGFRQGQWCRNLPGCGHVFHRKCVDTWLLKASTCPICRARVRLWEEDPQEGELWRCFGHRRSSLLDL

SEQ ID NO: 13259 - protein, 188 aa, Arabidopsis thaliana
  misc_feature: Ceres CLONE ID no. 94201
  misc_feature: Useful for making plants with modulated nitrogen use efficiency
MGFAITVKLPNCGSKFLPKRSFRDKGALSLAICSLCHFLHPAQPLLVRHQRRMSWTTIKSSVGGDRFDPASGSSSNNSSRGLRLIKAIQVLRSKLLVKIQEIKKDLPKKLFFLLVGFYSATAFSTFIGQTGDWDVLSAGLAVLVVECIGALMYRASIPLINKMRSTITMFNYWKTGLALGLFLDSFKF

SEQ ID NO: 13260 - protein, 168 aa, Brassica napus
  misc_feature: Ceres CLONE ID no. 942980
  misc_feature: Useful for making plants with modulated nitrogen use efficiency
MGFPVGYSELLLPRIFLHLLSFLGLLRKLISTIFWLIGLPDFLEPEPVSSSWPEPPPTSSHQDSHLFSAALLAGDILPVVRFSDLNLPESECCAVCLYDFENHDEIRRLTNCRHIFHKGCLDRWMMDYNQITCPLCRTQFIPDDLQVAFNHKLWAESSEVSELLVESF

SEQ ID NO: 13261 - protein, 158 aa, Arabidopsis thaliana
  misc_feature: Ceres CLONE ID no. 94503
  misc_feature: Useful for making plants with modulated nitrogen use efficiency
MELASFLGRALFVSVFLLSAWQEFNDFGEDGGRSAKSLKPKFNAFVNHVTTHTGQQLPPVDMKILVAAAIALKGIGGLLFVFGSSLGAYLLLLHQAVATPILYDFYNYDVDRKEFGQLFSKFTQSLALLGGLLFFIGMKNSRKHGRQLRKKAPKAKAN

SEQ ID NO: 13262 - protein, 307 aa, Arabidopsis thaliana
  misc_feature: Ceres CLONE ID no. 94688
  misc_feature: Useful for making plants with altered alkaloid content
  misc_feature: Useful for making plants with modulated nitrogen use efficiency
MHDPAVPIVTGFLGKGWKTGAVTTLGRGGSDLTATTIGKALGLKEIQVWKDVDGVLTCDPTIYKRATPVPYLTFDEAAELAYFGAQVLHPQSMRPAREGEIPVRVKNSYNPKAPGTIITKTRDMTKSILTSIVLKRNVTMLDIASTRMLGQVGFLAKVFSIFEELGISVDVVATSEVSISLTLDPSKLWSRELIQQELDHVVEELEKIAVVNLLKGRAIISLIGNVQHSSLILERAFHVLYTKGVNVQMISQGASKVNISFIVNEAEAEGCVQALHKSFFESGDLSELLIQPRLGNGSPVRTLQVEN

SEQ ID NO: 13263 - protein, 350 aa, Arabidopsis thaliana
  misc_feature: Ceres CLONE ID no. 94828
  misc_feature: Useful for making plants with modulated nitrogen use efficiency
MSSTAASSTVGGGGSSEISGVKKTSKRPKYSRFTQQELPACKPILTPRWVILTFLVAGVVFIPLGVICLFASQGVVEIVDRYDTDCIPTSSRNNMVAYIQGEGDKICKRTITVTKAMKHPVYVYYQLENFYQNHRRYVKSRNDAQLRSPKEEHDVKTCAPEDNVGGEPIVPCGLVAWSLFNDTYSFSRNSQQLLVNKKGISWKSDRENKFGKNVFPKNFQKGAPIGGGTLNISKPLSEQEDLIVWMRTAALPTFRKLYGKIETDLHAGDTITVLLQNNYNTYSFNGQKKLVLSTTSWLGGRNDFLGIAYLTVGSICLFLAVTFAVLYLVKPRQLGDPSYLSWNRSAGGLQ

SEQ ID NO: 13264 - protein, 301 aa, Brassica napus
  misc_feature: Ceres CLONE ID no. 955048
  misc_feature: Useful for making plants with altered terpenoid content
  misc_feature (32)..(32): Xaa is any aa, unknown, or other
  misc_feature (188)..(188): Xaa is any aa, unknown, or other
  misc_feature (202)..(202): Xaa is any aa, unknown, or other
  misc_feature (244)..(244): Xaa is any aa, unknown, or other
  misc_feature (266)..(266): Xaa is any aa, unknown, or other
  misc_feature (282)..(282): Xaa is any aa, unknown, or other
  misc_feature (296)..(296): Xaa is any aa, unknown, or other
MSAALSSSLYISPKKPSSPQLSQSTKPTTIKXTLHTHPLFSVADQAVTLQMKEKILCLELMGIDSGKALSLNPFLRSASLDSVEAVLNFLQSKGIYPNDLPRILGMCPKILTSDIRTELNPVFTFLSSDLHVPDNAFRRVVKKCPRLLISTVEDQLKPALFYLQRLGFKDLDALAYQDPVLLVSSVEXTLIPKLRFLESIGXSRSEAIGMILRCPALFTFSIENNFKPKLDYFMCEIKGKLENXKEFPQYFAFSLEKRIKPRHLKXMERGLELPLALMLKSXDEEFEQLLLQTEPXPVVNV

SEQ ID NO: 13265 - protein, 246 aa, Arabidopsis thaliana
  misc_feature: Ceres CLONE ID no. 96
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
  misc_feature: Useful for making plants with modulated drought sensitivity
MVGDYRGRFSSRRFSDDSDDSSDDASSVEGETTSSMYSAGKEYMETEWTNEKHSLYLKSMEASFVDQLYNSLGALGKNENVSESTRFGSGRKPSQEQFKVLHDGFWQKINVKQPEHRINGRHGGNSHEFLRSPWIKHYKPLVKTQIPVTDEPENQVVSSSNGKKGICSSGSASSLKQLSSHSRDHDQISVGEAEVSDQNFVNEGIKGENGSSKKMKTVMMSESSSTDQVVPLNKLLQHDVNLKSVS

SEQ ID NO: 13266 - protein, 110 aa, Brassica napus
  misc_feature: Ceres CLONE ID no. 960560
  misc_feature: Useful for making plants with altered alkaloid content
MVRNLPFSTSEDFLQKEFSAFGEIAEVKLVKDESMKRSKGYAFIQYMSQDDAFLAIETMDRRMYNGRMIYIEIAKPGKRDFQQQPRTSGPPEKLQVPEEPASNEVADCWY

SEQ ID NO: 13267 - protein, 243 aa, Brassica napus
  misc_feature: Ceres CLONE ID no. 963031
  misc_feature: Useful for making plants with altered Lignin content
  misc_feature (130)..(130): Xaa is any aa, unknown, or other
  misc_feature (136)..(136): Xaa is any aa, unknown, or other
  misc_feature (187)..(187): Xaa is any aa, unknown, or other
  misc_feature (214)..(214): Xaa is any aa, unknown, or other
MAGGRGSSKSTAPKARKRVEAESKPETTNNNNINTLLRAKDGSAFAKCEGCNKNVAVALISMHDCSLDAKIRVNLEAQVVETQTEAKKKPVERKKSTSDEPKAKRLRKAKDDSKKKSSSSSNKPKRPLTXFFIFMXDFRKTFKEENPDAGVKDVAKQGGEKWKSLDEEEKKVYLDKAAELKAEYNKXLESSNDADEEEADDADEKQSDEAEEKXADDEEAKENEAEKKEAEGKEEEDEILDDY

SEQ ID NO: 13268 - protein, 214 aa, Brassica napus
  misc_feature: Ceres CLONE ID no. 965028
  misc_feature: Useful for making plants with altered alkaloid content
  misc_feature (165)..(165): Xaa is any aa, unknown, or other
MASSQDQSALDLITQHLLTDFPSLETFVSSIHQSTTSTLSQRKPSLATISVPTTAPVVQEDDHRHYRGVRRRPWGKYAAEIRDPNKKGVRVWLGTFDTAVEAARGYDRAAFKLRGSKAILNFPLEAGKHEDNNTVALKSKRKRPETQDENHGRNLISHKAVIREXTEAQGEACPLTPSSWMGFWDGVDGIGTGLFSVPPLSPYPSLGHSQLGVK

SEQ ID NO: 13269 - protein, 166 aa, Brassica napus
  misc_feature: Ceres CLONE ID no. 965175
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MSTFLTQFTIFFRIQNHCSKKKKPKMATTSTGDIEKTKSVEVKKKLNVLIVDDDPVIRKLHEIIIKSIGGISQTAKNGEEAVNIHRDGNASFDLILMDKEMPERDGLSATKKLREMKVTSMIIGVTTLADNEEERKAFMEAGLNHCLAKPLSKAKILPLINNLMDA

SEQ ID NO: 13270 - protein, 209 aa, Brassica napus
  misc_feature: Ceres CLONE ID no. 965405
  misc_feature: Useful for making plants with modulated salt sensitivity
  misc_feature (156)..(156): Xaa is any aa, unknown, or other
  misc_feature (158)..(158): Xaa is any aa, unknown, or other
  misc_feature (168)..(168): Xaa is any aa, unknown, or other
  misc_feature (183)..(183): Xaa is any aa, unknown, or other
  misc_feature (187)..(187): Xaa is any aa, unknown, or other
  misc_feature (196)..(196): Xaa is any aa, unknown, or other
  misc_feature (197)..(197): Xaa is any aa, unknown, or other
MSADDSSNATDVDGKLGSDLNVNSDGEDAADNDSSKTLTIPAPAVCLVRFAGDAAGGAVMGSIFGYGSGLFKKKGFKGSFADAGQSAKTFAVLSGVHSLVVCLLKQLRGKDDAINVGVAGCCTGLALSFPGAPQALLQSCLTFGAFSFILEGLNKXQXALAHSVSLRXQTGNFGDHQQRPLQXSLAXPIHEEIKGXXSFCKSLTKPKKI

SEQ ID NO: 13271 - protein, 159 aa, Brassica napus
  misc_feature: Ceres CLONE ID no. 968180
  misc_feature: Useful for making plants with modulated nitrogen use efficiency
MVAISEINPTVEATAANCLMLLSRVGQKGGDQKRVFTCKTCLKEFHSFQALGGHRASHKKPNNNESLSGLVKKAKAPSSHPCPICGVEFPMGQALGGHMRRHRNEIGGGAALVTRALLPEPTMTTLKKSSSGKRVACLDLSLGMVENLNLKLELGRTVC

SEQ ID NO: 13272 - protein, 136 aa, Brassica napus
  misc_feature: Ceres CLONE ID no. 969626
  misc_feature: Abnormal phyllotaxy, leaf number higher than wild-type
  misc_feature: The plant is abnormally small.
  misc_feature: Useful for making plants with modulated biomass
  misc_feature (122)..(122): Xaa is any aa, unknown, or other
MEETNGRRETHDFMNVNVESFSQLPFIRRTPPKEKGSIIRLFGQELVGDNSSGTTQQEEDILETTKTKINDERSENVKEKDKDSSSNRRFECHYCFRNFPTSQALGGHQNAHKRERQHAKRXSVPSYLHQSGSHHV

SEQ ID NO: 13273 - protein, 144 aa, Brassica napus
  misc_feature: Ceres CLONE ID no. 969750
  misc_feature: The plant flowers significantly late compared to wild-type.
  misc_feature: The plant is abnormally large.
  misc_feature: Useful for making plants with altered alkaloid content
  misc_feature: Useful for making plants with altered terpenoid content
  misc_feature: Useful for making plants with modulated biomass
  misc_feature: Useful for making plants with modulated flowering time
  misc_feature: Useful for making plants with modulated salt sensitivity
MDYIDNTVETQSKYKGIRRRKWGKWVSEIRVPGTRDRLWLGSFSTAEGAAVAHDVAFYCLHQPNSLESLNFPHLLPPSIVSKTSPRSIQQAASNAGMAVDAGIVNSCDHASGNSGNGDTTTAYCENGGALNISVYDYLDGHDHV

SEQ ID NO: 13274 - protein, 177 aa, Brassica napus
  misc_feature: Ceres CLONE ID no. 975540
  misc_feature: Useful for making plants with altered alkaloid content
  misc_feature (120)..(120): Xaa is any aa, unknown, or other
MALPMPQASRNMQGPGGGGGGRFSGRGGESGPGHVSSFGASATAKISVDASLAGAIIGKGGVSSKQICRQTGAKLSIQDHERDPNLKNIELEGTFEQINEASVMVRELIGRLNSAASRRXPGGGGGIGGGVGSEGKPHPGSNFKTKMCERFAKGNCTFGDRCHFAHGEAELRRSGIA

SEQ ID NO: 13275 - protein, 224 aa, Arabidopsis thaliana
  misc_feature: Ceres CLONE ID no. 9804
  misc_feature: Useful for making plants with altered Lignin content
MSSSSYNTSVIPSSSSSAQPFFITSSGTGDNDFNRKDTFMSMIQQPNSSAPPPKKRRNQPGNPNPDAEVVALSPKTLMATNRFICDVCNKGFQREQNLQLHRRGHNLPWKLKQKSTKEVKRKVYLCPEPTCVHHDPSRALGDLTGIKKHYYRKHGEKKWKCEKCSKRYAVQSDWKAHSKTCGTKEYRCDCGTIFSRFPFLRNSSSFVDPLLISFSLYVCLYIRT

SEQ ID NO: 13276 - protein, 178 aa, Arabidopsis thaliana
  misc_feature: Ceres CLONE ID no. 98140
  misc_feature: Useful for making plants with altered terpenoid content
MKTAKGKDKVKTTKEALKPVDDRKVGKRKAPAEKPTKRETRKEKKAKKDPNKPKRAPSAFFVFLEDFRVTFKKENPNVKAVSAVGKAGGQKWKAMSQAEKAPYEEKAAKRKAEYEKQMDAYNKNLEEGSDESEKSRSEINDEDEASGEEELLEKEAAGDDEEEEEEEDDDNDDDEEED

SEQ ID NO: 13277 - protein, 404 aa, Arabidopsis thaliana
  misc_feature: Ceres CLONE ID no. 98267
  misc_feature: Useful for making plants with modulated phosphate use efficiency
MDRTQSPKTALFAVLATLLVLTVNGQSLCKTHRFTNNLAFADCSDLSALGSFLHWTYNEQNGTVSIAYRHPGTSASSWVAWGLNPSSTQMVGTQALVAFTNTTTNQFQAYTSSVSSYGTRLERSSLSFGVSGLSATLVSGEVTIFATLELSPNLITANQLWQVGPVVNGVPASHQTSGDNMRSSGRIDFRTGQASAGGGGSGDRLRKRNTHGVLNAVSWGVLMPMGAMMARYMKVFADPTWFYLHIAFQVSGYVIGVAGWATGIKLGNDSPGTSYSTHRNLGIALFTFATLQVFALLVRPKPDHKYRTYWNVYHHTVGYTTIILSIVNIFKGFDILDPEDKWRWAYIGILIFLGACVLILEPLTWFIVLRRKSRGGNTVAAPTSSKYSNGVNGTTTTGPHHQDA

SEQ ID NO: 13278 - protein, 253 aa, Brassica napus
  misc_feature: Ceres CLONE ID no. 982869
  misc_feature: Useful for making plants with altered alkaloid content
  misc_feature (155)..(155): Xaa is any aa, unknown, or other
  misc_feature (192)..(192): Xaa is any aa, unknown, or other
  misc_feature (193)..(193): Xaa is any aa, unknown, or other
  misc_feature (197)..(197): Xaa is any aa, unknown, or other
METLNPLSHVPISDHRFVGQDMMSLQSPSSIWTKEENKMFERALAIYPEDSPDRWFKIASMIPGKTVFDVMKQYSKLEEDVFDIEEGRVPIPGYPSPLGLAQDTYRKRPNGARGSDHDRKKGVPWTEEEHRRFLLGLLKYGKGDWRNISRNFVVXKTPTQVASHAQKYYQRQLSGAKDKRRPSIHDITTGNXXNANXNRSFSDHRDILPDLVFIEKDNAEGLMCMSPNLFSPSSAPFDDAFNFAGVNAFSAGA

SEQ ID NO: 13279 - protein, 337 aa, Arabidopsis thaliana
  misc_feature: Ceres CLONE ID no. 98672
  misc_feature: Useful for making plants with modulated nitrogen use efficiency
MGNLISLIFCCGRRQRSNIPPAMETAPLELPPNRFVFAAAPPYLNPNPNYVDQYPGNCLPPPVTEPPMLPYNFNHLHHYPPNSYQLPHPLFHGGRYPILPPPTYVHQKAVTIRNDVNLKKKTLTLIPDPENPNRLLVSFTFDASMPGRITVVFFATEDAECNLRATKEDTLPPITFDFGEGLGQKFIQSSGTGIDLTAFKDSELFKEVDTDVFPLAVKAEATPAEEGKSGSTNVQITQVVYTKEKGEIKIEVVKQILWVNKRRYELLEIYGIENTVDGSDEGKECVVCLSEPRDTTVLPCRHMCMCSGCAKALRFQTNLCPVCRQPVEMLLEINKNG

SEQ ID NO: 13280 - protein, 223 aa, Arabidopsis thaliana
  misc_feature: Ceres CLONE ID no. 98716
  misc_feature: Useful for making plants with altered Lignin content
MARFEPYNYNNGHDPFFAHINQNPELINLDLPASTPSSFMLFSNGALVDANHNNSHFFPNLLHGNTRRKGNKEESGSKRRRKRSEEEEAMNGDETQKPKDVVHVRAKRGQATDSHSLAERVRREKINERLKCLQDLVPGCYKAMGMAVMLDVIIDYVRSLQNQIEFLSMKLSAASACYDLNSLDIEPTDIFQGGNIHSAAEMERILRESVGTQPPNFSSTLPF

SEQ ID NO: 13281 - protein, 193 aa, Arabidopsis thaliana
  misc_feature: Ceres CLONE ID no. 9878
  misc_feature: Useful for making plants with modulated nitrogen use efficiency
MALEALNSPRLVEDPLRFNGVEQWTKCKKRSKRSRSDLHHNHRLTEEEYLAFCLMLLARDGGDLDSVTVEEKPSYKCGVCYKTFSSYQALGGHKASHRSLYGGGDNDKSTPSTAVKSHVCSVCGKSFATGQALGGHKRCHYDGGVSNSEGVGSTSHVSSSSHRGFDLNILPVQGFSRDDEVMSPMATKKPRLK

SEQ ID NO: 13282 - protein, 192 aa, Arabidopsis thaliana
  misc_feature: Ceres CLONE ID no. 98850
  misc_feature: Abnormal phyllotaxy, leaf number higher than wild-type
  misc_feature: The plant is abnormally small.
  misc_feature: Useful for making plants with altered alkaloid content
  misc_feature: Useful for making plants with modulated biomass
MGRRKIEIKRIENKSSRQVTFSKRRNGLIDKARQLSILCESSVAVVVVSASGKLYDSSSGDEIEALFKPEKPQCFELDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 13283 - protein, 242 aa, Arabidopsis thaliana
  misc_feature: Ceres CLONE ID no. 99033
  misc_feature: Useful for making plants with altered Lignin content
MAKLSFKDSLKALEADIQHANTLALDYPREKDGARVQMRLSYSPTAQFFLFLVQWTDCKLAGFLGLLRVLIYMTYADGKTTMSVYERKASIREFQAVILPSLSQLQRGVTDIDDSKQKEVCKMRYRKKDESEMSEIEIEREEECGICMEMNSKVVLPNCTHSLCIKCYRDWRGRSQSCPFCRDSLKRVDSGDLWMFLDQNDTVNLTAIARENQKRLFMYIEKLPLVVPDQVYASSPYDFHVR

SEQ ID NO: 13284 - protein, 194 aa, Arabidopsis thaliana
  misc_feature: Ceres CLONE ID no. 99075
  misc_feature: Useful for making plants with altered terpenoid content
  misc_feature (192)..(192): Xaa is any aa, unknown, or other
MDRIDHLFNQYANKSSSLIDPEGIEELCSNLEVSHTDIRILMLAWKMKAEKQGYFTHEEWRRGLKALRADTINKLKKALPELEKEVRRPSNFADFYAYAFCYCLTEEKQKSIDIETICQLLEIVMGSTFRAQVDYFVEYLKIQNDYKVINMDQWMGLYRFCNEISFPDMGNYNPELAWPLILDNFVEWIQEXQA

SEQ ID NO: 13285 - protein, 483 aa, Arabidopsis thaliana
  misc_feature: Ceres CLONE ID no. 99519
  misc_feature: Useful for making plants with altered terpenoid content
  misc_feature: Useful for making plants with modulated nitrogen use efficiency
MNEKANVSKELNARHRKILEGLLKHPENRECADCKTKGPRWASVNLGIFICMQCSGIHRSLGVHISKVRSATLDTWLPEQVAFIQSMGNDKANSYWEAELPPNYDRVGIENFIRAKYEEKRWVSRGEKARSPPRVEQERRKSVETSGPGYEHGHSSSPVNLFEERKTIPASRTRNNVAATRINLPVPPQGPSQVIKPQQKMESAATPVEREKQAVNVAPASDPPKVDFATDLFNMLSMDDSTTNTSEATPGDTPADDNSWAGFQSAGSGQTAEKIVTAKPAESSSPPASSSDFEDLFKDTPNLTTQQAPKDVKGDIMSLFEKTNIVSPFAMHQQQVAMLAQQQALYMAAAKAAGGTPNGVNQQAIANALNVASANWSNPGGYQIPGMTNPVGGQADLQKLMQNMNMNANMNTRPAQPQENTLQYPSSSFYTMGQANQVNGMTPNSTGKPQSSSATQPTSTTPSSQSGKDFDFSSLMDGMFTKH

SEQ ID NO: 13286 - protein, 240 aa, Zea mays
  misc_feature: Ceres CLONE ID no. 996227
  misc_feature: Useful for making plants with modulated nitrogen use efficiency
  misc_feature (127)..(127): Xaa is any aa, unknown, or other
  misc_feature (150)..(150): Xaa is any aa, unknown, or other
  misc_feature (168)..(168): Xaa is any aa, unknown, or other
  misc_feature (189)..(189): Xaa is any aa, unknown, or other
  misc_feature (198)..(198): Xaa is any aa, unknown, or other
  misc_feature (209)..(209): Xaa is any aa, unknown, or other
  misc_feature (239)..(239): Xaa is any aa, unknown, or other
MATKIFSLLMLLALSACVANATIFPQCSQAPIASLLPPYLPSMIASVCENPALQPYRLQQAIAASNIPLSPLLFQQSPALSLVQSLVQTIRAQQLQQLVLPVINQVALANLSPYSQQQQFLPFNQLXTLNPAAYLQQQLLPFSQLATAYXQQQQLLPFNQLAALNPAXYLQQQILLPFSQLAAANRASXLTQQQLLPXYQQFAANPATXLQLQQLLPFVQLALTDRAASYQQHIIGGAXF

SEQ ID NO: 13287 - protein, 93 aa, Arabidopsis thaliana
  misc_feature: Ceres CLONE ID no. 99657
  misc_feature: The plant senesces significantly late compared to wild-type.
  misc_feature: Useful for making plants with modulated time to senescence
MANAASGMAVHDDCKLKFMELKAKRTFRTIVYKIEDKQVIVEKLGEPEQSYDDFAASLPADDCRYCIYDFDFVTAENCQKSKIFLHGLRTLPK

SEQ ID NO: 13288 - protein, 342 aa, Arabidopsis thaliana
  misc_feature: Ceres GEMINI ID no. 5001F11
  misc_feature: Useful for making plants with modulated salt sensitivity
MADLKSTFLDVYSVLKSDLLQDPSFEFTHESRQWLERMLDYNVRGGKLNRGLSVVDSYKLLKQGQDLTEKETFLSCALGWCIEWLQAYFLVLDDIMDNSVTRRGQPCWFRKPKVGMIAINDGILLRNHIHRILKKHFREMPYYVDLVDLFNEVEFQTACGQMIDLITTFDGEKDLSKYSLQIHRRIVEYKTAYYSFYLPVACALLMAGENLENHTDVKTVLVDMGIYFQVQDDYLDCFADPETLGKIGTDIEDFKCSWLVVKALERCSEEQTKILYENYGKAEPSNVAKVKALYKELDLEGAFMEYEKESYEKLTKLIEAHQSKAIQAVLKSFLAKIYKRQK

SEQ ID NO: 13289 - protein, 517 aa, Arabidopsis thaliana
  misc_feature: Ceres GEMINI ID no. 5015H1
  misc_feature: Useful for making plants with modulated salt sensitivity
  misc_feature: Useful for making plants with modulated salt sensitivity
MGAIDLSFSQSLLFSSSRSNLSSSTHRSVSFLPPGSKSRCLPPLRSMSHDDDTASKEVKLWGGRFEESVTEKVEKFTESISFDKVLYKQDIMGSKAHASMLAHQGLITDSDKDSILRGLDDIERQIEANKFEWRTDREDVHMNIEAALTDLIGEPAKKLHTARSRNDQVATDFRLWCRDAIDTIIVKIRNLQRALVELALKNEALIVPGYTHLQRAQPVLLPHVLLTFVEQLERDAGRYVDCRARLNFSPLGACALAGTGLPIDRFMTANALGFTEPMRNSIDAVSDRDFVLEFLYTNANTGIHLSRLGEEWVLWASEEFGFMTPSDSVSTGSSIMPQKKNPDPMELVRGKSARVIGDLVTVLTLCKGLPLAYNRDFQEDKEPMFDSTKTIMGMIDVSAEFAQNVTFNEDRIKKSLPAGHLDATTLADYLVKKGMPFRSSHDIVGKLVGVCVSKGCELQNLSLEEMKKLSPVFEEDVFGFLGVENSVNKFSSYGSTGSNCVAEQLGYWVNKLNITST

SEQ ID NO: 13290 - protein, 186 aa, Arabidopsis thaliana
  misc_feature: Ceres GEMINI ID no. 5026H1
  misc_feature: Useful for making plants with modulated low light sensitivity
MAEVMLPRKMEILNHSSKFGSPDPLHVLAVDDSHVDRKFIERLLRVSSCKVTVVDSATRALQYLGLDVEEKSVGFEDLKVNLIMTDYSMPGMTGYELLKKIKESSAFREVPVVIMSSENILPRIDRCLEEGAEDFLLKPVKLSDVKRLRDSLMKVEDLSFTKSIQKRELETENVYPVHSQLKRAKI

SEQ ID NO: 13291 - protein, 175 aa, Arabidopsis thaliana
  misc_feature: Ceres GEMINI ID no. 5033H9
  misc_feature: The plant produces a reduced number of seeds.
  misc_feature: Useful for biocontainment applications
  misc_feature: Useful for making plants with altered alkaloid content
  misc_feature: Useful for making plants with modulated low light sensitivity
  misc_feature: Useful for making plants with modulated nitrogen use efficiency
MGRGRSSSSSSIESSSKSNPFGASSSTRNLSTDLRLGLSFGTSSGTQYFNGGYGYSVAAPAVEDAEYVAAVEEEEENECNSVGSFYVKVNMEGVPIGRKIDLMSLNGYRDLIRTLDFMFNASILWAEEEDMCNEKSHVLTYADKEGDWMMVGDVPWEMFLSTVRRLKISRANYHY

SEQ ID NO: 13292 - protein, 259 aa, Arabidopsis thaliana
  misc_feature: Ceres GEMINI ID no. 5056F8
  misc_feature: Useful for making plants with modulated low light sensitivity
MARDGGVSCLRRSEMMSVGGIGGIESAPLDLDEVHVLAVDDSLVDRIVIERLLRITSCKVTAVDSGWRALEFLGLDNEKASAEFDRLKVDLIITDYCMPGMTGYELLKKIKESSNFREVPVVIMSSENVLTRIDRCLEEGAQDFLLKPVKLADVKRLRSHLTKDVKLSNGNKRKLPEDSSSVNSSLPPPSPPLTISPESSPPLTVSTESSDSSPPLSPVEIFSTSPLSSPIDDEDDDVLTSSSEESPIRRQKMRSPGLD

SEQ ID NO: 13293 - protein, 447 aa, Arabidopsis thaliana
  misc_feature: Ceres GEMINI ID no. 5069H4
  misc_feature: Useful for making plants with modulated salt sensitivity
MAEPPKLRVLMVSDFFFPNFGGVENHIYYLSQCLLKLGHKVVVMTHAYGNRSGVRYMTGGLKVYYVPWRPFVMQTTFPTVYGTLPIVRTILRREKITVVHGHQAFSTLCHEALMHARTMGYKVVFTDHSLYGFADVGSIHMNKVLQFSLADIDQAICVSHTSKENTVLRSGLSPAKVFMIPNAVDTAMFKPASVRPSTDIITIVVISRLVYRKGADLLVEVIPEVCRLYPNVRFVVGGDGPKHVRLEEMREKHSLQDRVEMLGAVPHSRVRSVLVTGHIFLNSSLTEAFCIAILEAASCGLLTVSTRVGGVPEVLPDDMVVLAEPDPDDMVRAIEKAISILPTINPEEMHNRMKKLYSWQDVAKRTEIVYDRALKCSNRSLLERLMRFLSCGAWAGKLFCMVMILDYLLWRLLQLLQPDEDIEEAPDICLCHHRGVEVSEGLRKKIK

SEQ ID NO: 13294 - protein, 97 aa, Arabidopsis thaliana
  misc_feature: Ceres GEMINI ID no. 5090C3
  misc_feature: Useful for making plants with modulated nitrogen use efficiency
MSPIVITQLATGISVLAGAVFIKSVMDQKPMAGQFPRCPTCNGTGRVTCFCSRWSDGDVGCRRCSGSGRAACSNCGGSGTGRPLPAQITVQPPNRPY

SEQ ID NO: 13295 - protein, 280 aa, Arabidopsis thaliana
  misc_feature: Ceres GEMINI ID no. 5092G10
  misc_feature: Useful for making plants with modulated oxidative stress sensitivity
MTSSSPTQRTHVSIPPEPGGKSLTQEANEPPVPISVSSPCGKRTRDPEDEVYLDNLRSQKRYLSEIMACSLNGLTVGDSLPVNMLESPARSESFLYHRDDLSLQYSPMSEDSDEARFCEDPTATASTSSSQPESRPTSPVSPYRYQRPLTSTNSPQPSPTILHHSHTCPASMISNAATTTTPQSRQRGSDTEGRFPSSPSDICHSGDLRRTALLRSVQMRTQPCGYSSSSGPSNIDGEERMCSKSMEEDRGYNKGEDIPYAEVSSKSKSCKALDMRLCEK

SEQ ID NO: 13296 - protein, 270 aa, Arabidopsis thaliana
  misc_feature: Ceres GEMINI ID no. 5102C7
  misc_feature: Useful for making plants with modulated salt sensitivity
  misc_feature: Useful for making plants with modulated salt sensitivity
MIPSLNVMSANGLALPLGSNDVKLRENIEHRTCPENTEHRTCQVGCEEYSGLSFQKLDWTRQSVEPRTGIEFPMLLKENASRSNSEVLVATGSRTMKIIRIKSLKVYAFGFYVHPSSVCQKLGRKYASVPASKLDKCDDLYKDLLREDIVMSVRLVVNYNGLKINTVRDVFEKSLRARLVKANPKTDFNCLNDFGSFFRQDIPIPAGTIIDFRRTEDGQLITEIGGNLIGAVRSKDLCRAFFGMYIGDVPVSEQTKEEIGRKVVGIIKRC

SEQ ID NO: 13297 - protein, 57 aa, Arabidopsis thaliana
  misc_feature: Ceres GEMINI ID no. 5109A2
  misc_feature: Useful for making plants with altered alkaloid content
  misc_feature: Useful for making plants with altered terpenoid content
MAFDGCCPDCKLPGDDCPLIWGACNHAFHLHCILKWVNSQTSQAHCPMCRREWQFKE

SEQ ID NO: 13298 - protein, 307 aa, Arabidopsis thaliana
  misc_feature: Ceres GEMINI ID no. 5109A5
  misc_feature: Useful for making plants with altered alkaloid content
MSRPAPLPPRCPIPKKLSLSPVADTFYSSSSPIESYIGQYKSSTQDSRLEDQPAWLDELLCDKTDGLLTRGGPLRRSASDSVVLLGDISATFSGFDQSEDEESLSSEACGDLESACVYGPNSPRAKNNSSFSNNPIASAFSDYGSQTPPQNLDDTVKGINRSPVAENACGSMGIPNAKRNPGQRSRVRKLQYIAELERTVGMLQTVEADLSVRVASLLQTRATLSLENSQLKQQMAILKQDKLIREGEYQLLKKEAQRLKSGLGYLGSTNNSNRLVRSYSAGSNVAPRTASSHLDWNLLDLTKLNLN

SEQ ID NO: 13299 - protein, 767 aa, Arabidopsis thaliana
  misc_feature: Ceres GEMINI ID no. 5109B7
  misc_feature: Useful for making plants with altered terpenoid content
MDVLALSSSASAAAPSASLAGKFLSFPSRVRVRRNRENLLAKQKKFLVSASKREEPKLNEWDQMELNFGRLLGEDPKLTLAKIVARKVDPEASFIDIEKSFYKNKGKIPEVEEIPLDWSKDNKKKSTSSLDGLKLVKPVLKDGVKFERPVMKKPSPVLKKPLVEAVAAPKVQRLPNVILRKPSSFYTSNGDDEESKLRLKPNLTLKMRNERENERFSDMTLLRKPEPVSVVAEEEDKPLSDDLTMEEGEQEGGTYSQYTLLEKPEARLQPVNVEEEVGDSGGVESSEIVNNSIQKPEARPELENIEKEVADSGVLESSEIENNSIPTEMQLNSEMSSEEKTINSDPLERIPSKPISQTIVEASLQGKPQRLDPSSAEPSVPNIGKPSVVNHEGRQVSVELKGPPTRSSLEENDWNKAESLVKTELRADVELISSSTRGFAVSYGSLIGFLPYRNLAAKWKFLAFESWLRRKGVDPSPYRQNLGVIGGQDVTSKSPSPDSSLDSEVATTINGEVSSDMKLEDLLMVYDREKQKFLSSFVGQKIKVNVVMANRNSRKLIFSMRPRENEEEVEKKRTLMAKLRVGDVVKCCIKKITYFGIFCELEGVPALVHQSEVSWDATLDPASYFKIGQIVEAKVHQLDFALERIFLSLKEITPDPLTEALESVVGGDNDQLGGRLQAAELDAEWPDVESLIKELEMVEGIQSVSKSRFFLSPGLAPTFQVYMAPMFENQYKLLARAGNRVQELIVEASLSKEEMKSTIMSCTNRVE

SEQ ID NO: 13300 - protein, 155 aa, Arabidopsis thaliana
  misc_feature: Ceres GEMINI ID no. 5109B8
  misc_feature: Useful for making plants with altered Lignin content
MDPKSCENSSDVKGQTSDSVSKKVLIEEEEDVKKPQQGKENDSRMAKDVVSCSSNISAHVVHEEVADNVTAVSCNEAESDISKAKAKEFHTIDLSGVGERICRICHFGSDQSPEASGDDKSVSPELIEIGCKCKNELGLAHFHCAEAWFKLRGNR

SEQ ID NO: 13301 - protein, 496 aa, Arabidopsis thaliana
  misc_feature: Ceres GEMINI ID no. 5109C6
  misc_feature: Useful for making plants with altered Lignin content
  misc_feature: Useful for making plants with altered alkaloid content
  misc_feature: Useful for making plants with altered terpenoid content
MAGFSLYCFKNPRILFTLPSESPLFVLGSDKCSPATRRPSRKTRGFVVTYAHSNPKIINPKKKSRYGQTLSPYDSDEDDDDDDDDDDDDWLLNDDFAEVTEYEKKKPKSHKQTIAKKSVKKGIVKPEESETDEDDLDLGISPNATSEKKKESWRLDGRGKMSSRKYVEKLYPRLAEEIDIDPKCVPLLDYLSTFGLKESHFVQMYERHMPSLQINVFSAQERLDYLLSVGVKHRDIKRMLLRQPQILQYTVENNLKAHISFLMGLGIPNSKIGQIVAATPSLFSYSVENSLRPTIRYLIEEVGIKETDVGKVVQLSPQILVQRLDITWNTRYMFLSKELGAPRDSVVKMVKKHPQLLHYSIDDGFLPRINFLRSIGMCNSDILKVLTSLTQVLSLSLEDNLKPKYMYLVNELNNEVHILTKYPMYLSLSLDQRIRPRHRFLVELKKVRKGPFPLSSLVPNDESFCQQWAGTSVDTYLAFRQRLLLKEFANKYDKRG

SEQ ID NO: 13302 - protein, 180 aa, Arabidopsis thaliana
  misc_feature: Ceres GEMINI ID no. 5109E9
  misc_feature: Useful for making plants with altered Lignin content
MSSSSTQNQLEMRDYTCPECNIGLRVLSLPSASPPYCPLCNVASYFTSSTPFEVGPNPFEDDEESQFLDPMESLPTIKISSSMLSSASSDDSALPCAICREDFVVGESARRLPCNHLYHNDCIIPWLTSHNSCPLCRVELPVASSEDDSGLDMWFDALNLEDDLEEEAGVTLDLEQSLDG

SEQ ID NO: 13303 - protein, 536 aa, Arabidopsis thaliana
  misc_feature: Ceres GEMINI ID no. 5109G6
  misc_feature: Useful for making plants with altered Lignin content
MNNVLQFGLQSSAIYVAKFLVVPLRSLRVGSSFVGVGVGTRSFNKRLMSNATAFSINNSKRKELKIPGAAIDQNCHQMGSDTDRDEMGTLQDDRKEIEAMTVQELRSTLRKLGVPVKGRKQELISTLRLHMDSNLPDQKETSSSTRSDSVTIKRKISNREEPTEDECTNSEAYDIEHGEKRVKQSTEKNLKAKVSAKAIAKEQKSLMRTGKQQIQSKEETSSTISSELLKTEEIISSPSQSEPWTVLAHKKPQKDWKAYNPKTMRPPPLPEGTKCVKVMTWNVNGLRGLLKFESFSALQLAQRENFDILCLQETKLQVKDVEEIKKTLIDGYDHSFWSCSVSKLGYSGTAIISRIKPLSVRYGTGLSGHDTEGRIVTAEFDSFYLINTYVPNSGDGLKRLSYRIEEWDRTLSNHIKELEKSKPVVLTGDLNCAHEEIDIFNPAGNKRSAGFTIEERQSFGANLLDKGFVDTFRKQHPGVVGYTYWGYRHGGRKTNKGWRLDYFLVSQSIAANVHDSYILPDINGSDHCPIGLILKL

SEQ ID NO: 13304 - protein, 226 aa, Arabidopsis thaliana
  misc_feature: Ceres GEMINI ID no. 5109H11
  misc_feature: The plant is abnormally small.
  misc_feature: Useful for making plants with altered terpenoid content
  misc_feature: Useful for making plants with modulated biomass
MMDRGECLMSMKLRPMVTRPSSDGTLFWPFREERAFASAEEYGGGGGCMWPPRSYSCSFCGREFKSAQALGGHMNVHRRDRARLKQQSLSPSSTDQATPPECDRQQQVLDVGSKVLVQEETRKPNGTKREISDVCNNNVLESSMKRYEHDNGEVKTDLSVGLLSTEFDPRKKQLINGSSSSWKRAKTDVSRFPMMLGLVIGISEINGHHEELDLELRLGADPPKVN

SEQ ID NO: 13305 - protein, 172 aa, Arabidopsis thaliana
  misc_feature: Ceres GEMINI ID no. 5109H3
  misc_feature: The plant flowers significantly late compared to wild-type.
  misc_feature: Useful for making plants with altered Lignin content
  misc_feature: Useful for making plants with altered alkaloid content
  misc_feature: Useful for making plants with modulated flowering time
MRILCDACESAAAIVFCAADEAALCCSCDEKVHKCNKLASRHLRVGLADPSNAPSCDICENAPAFFYCEIDGSSLCLQCDMVVHVGGKRTHRRFLLLRQRIEFPGDKPNHADQLGLRCQKASSGRGQESNGNGDHDHNMIDLNSNPQRVHEPGSHNQEEGIDVNNANNHEHE

SEQ ID NO: 13306 - protein, 347 aa, Arabidopsis thaliana
  misc_feature: Ceres GEMINI ID no. 5109H5
  misc_feature: Useful for making plants with altered Lignin content
MGSTEKEQTTQHHPPHISSLVVRPSGSNDREDGRNAAGDYEPGEVSRDRPSFNRSDRYKGDNGGHRTRASSSSPGRRGYEDHKHGSDLNHSGVPPRGRELSSRREAPGRHRDYSPPLARGGAGARPYRRGLDGPEPPHGRDGMSRNNISKVQPREGDWYCLDPLCRNLNFARRESCYKCKRHRYAPANSPPLPRLLPPPMNHSPRRDFNGYRSPPRGWPRDYPPPRHDHPTWRDRERDRPHYSDHEYPPSRRIASDWAHTEPLPKPHYDRRPPLSPPRGGRWGRVLRERSRSPPLRDVPPPPLRDGPPPSLRGGGPPLHRDYRRDSHFDRERRDDGRGGRGRMGNSY

SEQ ID NO: 13307 - protein, 284 aa, Arabidopsis thaliana
  misc_feature: Ceres GEMINI ID no. 5110A1
  misc_feature: Useful for making plants with altered alkaloid content
  misc_feature: Useful for making plants with altered terpenoid content
MGQDEVGSDQTQIIKGKRTKRQRSSSTFVVTAATTVTSTSSSAGGSGGERAVSDEYNSAVSSPVTTDCTQEEEDMAICLIMLARGTVLPSPDLKNSRKIHQKISSENSSFYVYECKTCNRTFSSFQALGGHRASHKKPRTSTEEKTRLPLTQPKSSASEEGQNSHFKVSGSALASQASNIINKANKVHECSICGSEFTSGQALGGHMRRHRTAVTTISPVAATAEVSRNSTEEEIEINIGRSMEQQRKYLPLDLNLPAPEDDLRESKFQGIVFSATPALIDCHY

SEQ ID NO: 13308 - protein, 420 aa, Arabidopsis thaliana
  misc_feature: Ceres GEMINI ID no. 5110A11
  misc_feature: Useful for making plants with altered terpenoid content
MGGGGMFEEIGCFDPNAPAEMTAESSFSPSEPPPTITVIGSNSNSNCSLEDLSAFHLSPQDSSLPASASAYAHQLHINATPNCDHQFQSSMHQTLQDPSYAQQSNHWDNGYQDFVNLGPNHTTPDLLSLLQLPRSSLPPFANPSIQDIIMTTSSSVAAYDPLFHLNFPLQPPNGSFMGVDQDQTETNQGVNLMYDEENNNLDDGLNRKGRGSKKRKIFPTERERRVHFKDRFGDLKNLIPNPTKNDRASIVGEAIDYIKELLRTIDEFKLLVEKKRVKQRNREGDDVVDENFKAQSEVVEQCLINKKNNALRCSWLKRKSKFTDVDVRIIDDEVTIKIVQKKKINCLLFVSKVVDQLELDLHHVAGAQIGEHHSFLFNAKISEGSSVYASAIADRVMEVLKKQYMEALSANNGYHCYSSD

SEQ ID NO: 13309 - protein, 257 aa, Arabidopsis thaliana
  misc_feature: Ceres GEMINI ID no. 5110B1
  misc_feature: Useful for making plants with altered alkaloid content
  misc_feature: Useful for making plants with altered terpenoid content
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 13310 - protein, 198 aa, Arabidopsis thaliana
  misc_feature: Ceres GEMINI ID no. 5110B2
  misc_feature: Useful for making plants with altered alkaloid content
MEDQETKRITKKPSRSIIISLKDIPPLDPSSIPSMKPMAQDHHNVGMQRFQEKTDFKFEEEDNAISSFSNIQIDPNSTRSISLEKKLAPKPDEEHTTTTKPISKDDESKTRRGSAKSVLHEMCASKRWRPPVYECCNVDGPCHLRLFTYKVMVEIRDSSGKTVLECFGDPRRKKKAAAEHAAEGALWYLEHVKTKPHQ

SEQ ID NO: 13311 - protein, 631 aa, Arabidopsis thaliana
  misc_feature: Ceres GEMINI ID no. 5110B6
  misc_feature: Useful for making plants with altered terpenoid content
MSCSYLLSGDASVVASRRWSDVSSRQRLFLPRQSLRQPSGSSFSRCVRLVANVNDHFSKQSLATRNCLASVFSADLGGSNGNNDNGNGGGGGGDGGGDNSDDSSFDLRYLCFLLLGLSCFFHFRLSAASAIAKDQNSDSNGDAVKETVWEVRGSKRKRLVPDFVKDEFVSEESAFELSSSLTPENLLAQCRNLLTQFLLPEGFPNSVTSDYLDYSLWRGVQGIASQISGVLATQSLLYAVGLGKGAIPTAAAINWVLKDGIGYLSKIMLSKYGRHFDVHPKGWRLFADLLENAAFGMEMLTPVFPQFFVMIGAAAGAGRSAAALIQAATRSCFNAGFASQRNFAEVYNNFYMALVLITYQQLFVFLNYSGSLGEAQGMVSKSVGILLGIVVANCIGTSTSLALAAFGVVTTIHMYTNLKSYQCIQLRTLNPYRASLVFSEYLISGQAPLIKEVNDEEPLFPTVRFSNMKSPEKLQDFVLSSEAKAAAADIEERLQLGSKLSDVIHNKEEAIALFDLYRNEGYILTEHKGRFCVMLKESSTPQDMLRSLFQVNYLYWLEKNAGIEPASTYSDCKPGGRLHISLDYVRREFEHAKEDSESVGWVTEGLIARPLPTRIRLGHDRELLLSSPNSS

SEQ ID NO: 13312 - protein, 667 aa, Arabidopsis thaliana
  misc_feature: Ceres GEMINI ID no. 5110B8
  misc_feature: Useful for making plants with altered alkaloid content
  misc_feature: Useful for making plants with modulated water use efficiency
MGSTPFCYSINPSPSKLDFTRTHVFSPVSKQFYLDLSSFSGKPGGVSGFRSRRALLGVKAATALVEKEEKREAVTEKKKKSRVLVAGGGIGGLVFALAAKKKGFDVLVFEKDLSAIRGEGKYRGPIQIQSNALAALEAIDIEVAEQVMEAGCITGDRINGLVDGISGTWYVKFDTFTPAASRGLPVTRVISRMTLQQILARAVGEDVIRNESNVVDFEDSGDKVTVVLENGQRYEGDLLVGADGIWSKVRNNLFGRSEATYSGYTCYTGIADFIPADIESVGYRVFLGHKQYFVSSDVGGGKMQWYAFHEEPAGGADAPNGMKKRLFEIFDGWCDNVLDLLHATEEEAILRRDIYDRSPGFTWGKGRVTLLGDSIHAMQPNMGQGGCMAIEDSFQLALELDEAWKQSVETTTPVDVVSSLKRYEESRRLRVAIIHAMARMAAIMASTYKAYLGVGLGPLSFLTKFRVPHPGRVGGRFFVDIAMPSMLDWVLGGNSEKLQGRPPSCRLTDKADDRLREWFEDDDALERTIKGEWYLIPHGDDCCVSETLCLTKDEDQPCIVGSEPDQDFPGMRIVIPSSQVSKMHARVIYKDGAFFLMDLRSEHGTYVTDNEGRRYRATPNFPARFRSSDIIEFGSDKKAAFRVKVIRKTPKSTRKNESNNDKLLQTA

SEQ ID NO: 13313 - protein, 419 aa, Arabidopsis thaliana
  misc_feature: Ceres GEMINI ID no. 5110B9
  misc_feature: Useful for making plants with altered alkaloid content
MTSTDVSSGVSNCYVFKSRLQEYAQKYKLPTPVYEIVKEGPSHKSLFQSTVILDGVRYNSLPGFFNRKAAEQSAAEVALRELAKSSELSQCVSQPVHETGLCKNLLQEYAQKMNYAIPLYQCQKVETLGRVTQFTCTVEIGGIKYTGAATRTKKDAEISAGRTALLAIQSDTKNNLANYNTQLTVLPCEKKTIQAAIPLKETVKTLKARKAQFKKKAQKGKRTVAKNPEDIIIPPQPTDHCQNDQSEKIETTPNLEPSSCMNGLKEAAFGSVETEKIETTPNLEPPSCMNGLKEAAFGSVETEKIETTPNLEPPSCMNGLKEAAFGSVETEKIETTPNLEPSSCMNGLKEAAFGSVETEKIETTPNLEPPSCMNGLKEAAFGSVETEKIETTPNLESSSCMSGLKEAAFGSVETEASHA

SEQ ID NO: 13314 - protein, 558 aa, Arabidopsis thaliana
  misc_feature: Ceres GEMINI ID no. 5110C6
  misc_feature: Useful for making plants with altered alkaloid content
MEDTRSVASLMDSTSSKIQQLQKAFAELESQRAVTLNLKWKELEEHFHGLERSLKRRFHELEDQEKEYETKTRKAQELLEKKKAAVEAKEKAALERLQKKRDAAMFTINSALDKYNNAPVSKPSVGERWPQNAVEDSSNVFAADSITDDNPDGIVQDVQISPVMGNYEVKAYPQLLKLCGDMDSTGLHKFVSDNRKNLASLKEEIPMAFRAAANPASLVLDSLEGFYPMEAPTADGKKDANLLGMRRTCIMLMECLSILLSGLDRNCLAVVLSQNVKHRAKTIAEGWNPLLESLDMDACNGNSLEAHAFLQLLATFAIVADFKEDELLKLIPMVSRRRQAAELCRSLGLAEKMPGVIEVLVNSGKQIDAVNLAFAFELTEQFSPVSLLKSYLIEARRSSPQGRPGNASPAVQDEFNERELIGLKTVIKCIEEHSLEEQYPVEPLHKRILQLEKAKADKKRATEPMKPQPKRPRGAQPRVTDNNNNINNNKTGYGRVIPERYPQYVYDNRPFLSGPIMAAQPPPPPPPQTYTFNPAPAHGNFYANCYQYQAPPPPPYFH

SEQ ID NO: 13315 - protein, 812 aa, Arabidopsis thaliana
  misc_feature: Ceres GEMINI ID no. 5110C8
  misc_feature: Useful for making plants with altered alkaloid content
MSGSLGLTPASLKASGRSSENVSLLTLQGKIKRDPEGYETELQLIYKQFKTSVDLFHELAALSFSSTGGIGSDPSVSKDLGDRAMFLAHVTPFYPKQLAAFPAQLTGLLRTSCLAMPSGLRNHIAQALILLMNRKSLVIEDLLALFLDIQTLGDKNLRNLAFGHIVQTIRKMSITDPKHKSLQKIVISMLEQEDEAKAKRALATLCALHKKKIWLGDKNERVAIAICEACFHSSPRIMISALRFLLDYENIDDDDDSDAESDDDEESKKIDQVVINRQAVYKANNKGTSSSKKKKQAKLQRAVKSIKRKQRSSSENTTSTFSPLNHLNDAQKFAEKLFSRLQTIKGSGERVETRLMMIKVIARTIGLHKLHLLSFYPFLQNYALPHVKDITQILAAAVQSCHDGVPSDVVEPLFKQIVNQFVHDKSRPEAIAVGLNVVREMCLRVHDLMTEELLQDLALYKKSHEKAISAAARSLIALFREVAEAFDLLINPSLLVKKDRGRPGATVFIPKHYGESNVFSNVPNVELLQESDNESGSDGDQDDDGVELPIGDDVEQELIPGDCGSEDKAEEDSNDGDDMNNTEDDSDIDTSIGGDEDEEVNDSDEADTDSENEEIESEEEDGEASDSSVEDSGNKEKAKGKKRKIVDFDANLLSADTSLRALKRFAEAKNEKPSFDEGDGILSNEDFRKIKTLQAKKEAKIALARKGFKVPNSDQLSKKRVDPAKLEAHIRHKLTKEQRLELVKAGREDRGKYKSKAAVKQKKTGGSSNKQKEHRKNMPLAAIRSKAGKSKRIKKMKNSISGSQFRGRKAWK

SEQ ID NO: 13316 - protein, 290 aa, Arabidopsis thaliana
  misc_feature: Ceres GEMINI ID no. 5110C9
  misc_feature: Useful for making plants with altered Lignin content
  misc_feature: Useful for making plants with altered alkaloid content
MAMASASGSALCFTDASSSLALRRDCGALCLPPRTVTFGFVDKPLVNLERLRLSTLKIRASNATAVENGKQEGSAADSDKVPTPVVIIDQDSDPDATVLEVTFGDRLGALLDTMNALKNLGLNVVKANVYLDSSGKHNKFAITRADSGRKVEDPELLEAIRLTVINNLLEFHPESSSQLAMGAAFGVLPPTEPIDVDIATHITIEDDGPDRSLLFIESADRPGLLVELVKIISDISVAVESGEFDTEGLLAKVKFHVSYRNKALIKPLQQVLANSLRYFLRRPSTDESSF

SEQ ID NO: 13317 - protein, 304 aa, Arabidopsis thaliana
  misc_feature: Ceres GEMINI ID no. 5110D4
  misc_feature: Useful for making plants with altered alkaloid content
MNSLVGDVPQSLSSLDDTTTCYNLDASCNKSLVEERPSKILKTTHISPNLHPFSSSNPPPPKHQPSSRILSFEKTGLHVMNHNSPNLIFSPKDEEIGLPEHKKAELIIRGTKRAQSLTRSQSNAQDHILAERKRREKLTQRFVALSALIPGLKKMDKASVLGDAIKHIKYLQESVKEYEEQKKEKTMESVVLVKKSSLVLDENHQPSSSSSSDGNRNSSSSNLPEIEVRVSGKDVLIKILCEKQKGNVIKIMGEIEKLGLSITNSNVLPFGPTFDISIIAQNNNFDMKIEDVVKNLSFGLSKLT

SEQ ID NO: 13318 - protein, 565 aa, Arabidopsis thaliana
  misc_feature: Ceres GEMINI ID no. 5110D5
  misc_feature: Useful for making plants with altered alkaloid content
MPLSFERFQGEGVFGLSSSSFYSDSQKIWSNQDKTEAKQEDLGYVVGGFLPEPTSVLDALRSPSPLASYSSTTTTLSSSHGGGGTTVTNTTVTAGDDNNNNKCSQMGLDDLDGVLSASSPGQEQSILRLIMDPGSAFGVFDPGFGFGSGSGPVSAPVSDNSNLLCNFPFQEITNPAEALINPSNHCLFYNPPLSPPLFNAAELIGTTGNNNGDHTVLAQGILARLNHHLNTSSNHKSPFQRAASHIAEALLSLIHNESSPPLITPENLILRIAAYRSFSETSPFLQFVNFTANQSILESCNESGFDRIHIIDFDVGYGGQWSSLMQELASGVGGRRRNRASSLKLTVFAPPPSTVSDEFELRFTEENLKTFAGEVKIPFEIELLSVELLLNPAYWPLSLRSSEKEAIAVNLPVNSVASGYLPLILRFLKQLSPNIVVCSDRGCDRNDAPFPNAVIHSLQYHTSLLESLDANQNQDDSSIERFWVQPSIEKLLMKRHRWIERSPPWRILFTQCGFSPASLSQMAEAQAECLLQRNPVRGFHVEKRQSSLVMCWQRKELVTVSAWKC

SEQ ID NO: 13319 - protein, 222 aa, Arabidopsis thaliana
  misc_feature: Ceres GEMINI ID no. 5110E1
  misc_feature: Useful for making plants with altered alkaloid content
MDSEPGQPENGTDAEKSVVGKCSETISDSEPGQPENGTEAEKSVVQKCSEKIDESEAGQPENSTEAEKFVVRKCSEKIDGSENVPAAGCVIRTDLNSCPEFEKKPLFLTKNWRNILCRCEKCLEMYKQRKVSYLLDAEDTIVEYEKKAKEKRTEKLEKQEGEALDLLNNLDHVSKVELLHGIKDFQDGLQGLMESAGPSKAITSADIEQMFSKLKNKRKRME

SEQ ID NO: 13320 - protein, 383 aa, Arabidopsis thaliana
  misc_feature: Ceres GEMINI ID no. 5110E11
  misc_feature: Useful for making plants with altered alkaloid content
MSSPERALLNLLTDIALSFDGAILGLTLAVSAVGSALKYASTNAALKKIKDAPEVSISDLRSLLPASEDKSETNDNRKSNDQRIVVVRGVVKPKISGDEGYKNNNVLISPETGDKALIIQRTQTYVYSGWKRLFQSTGHRFMLERSLRKHGADFTRTVPFVIVGKDQQSNSSFVAVNMDGSRQPLPLTTVYNRLQPINSSFLQAFLYPDYPVGLLDIEKILPPGKDITAVGIYSFNNGVPEIKSCQDLPYFLSEMTKDKMIEDLMEQTNFIFLGSVILGIVSVGILSYAAVRTWNKWKQWNHQRELPQRPNDSVVDDEPEDADEIPDGELCVICVSRRRVPAFIPCGHVVCCRRCASTVERELNPKCPVCLQSIRGSMRVYYS

SEQ ID NO: 13321 - protein, 320 aa, Arabidopsis thaliana
  misc_feature: Ceres GEMINI ID no. 5110E4
  misc_feature: Useful for making plants with altered alkaloid content
MATAVGGGSDVEVGFAKLQGEDFEYYMQSYSIILGRNSKKATVDVDLSSLGGGMNISRNHARIFYDFTRRRFSLEVLGKNGCLVEGVLHLPGNPNVKLDSQDLLQIGDKEFYFLLPVRSILGGPLGPRHHVSGQTSVVPYHNYQSGPGSGSGKKGVRSRELYEYDDEDDDDDDDEEDDMRGSGKKTRRDGHEVVYASGEKKREGRSKVDREADDQQFLQLEEKDVVSSVATVLSDLCGPGEWMPMEKLHSVILKEYGNVWHHSRVRRYLSQEDWAIPEAKGKPWYGLLMLLRKYPEHFVINTRSKGRVTLEFVSLVTLLS

SEQ ID NO: 13322 - protein, 808 aa, Arabidopsis thaliana
  misc_feature: Ceres GEMINI ID no. 5110E6
  misc_feature: Useful for making plants with altered alkaloid content
MATRGSRSEKVKRIFQQFDGNHDGGLNREEMAALVVAVNPRVKFSDEQINAILDEVFRTYAEFIDPNKGLTYDGLLRTYDDGAGDVDRDFDALGLELNADETTIKGSEAASSSSITDERAVEAQKKQRTAAWAVSPNHGIVFDETWKLVDDLEILVKRLKSKQEKDGKLKADNNNNNVDAFSDAGWSRELGPSSEISEKRIYWEESSHDYGVFVKELGVLRSKADGARSREEAFDGHMAIGRVLYEHQLFKEALVSFKRACELQPTDVRPHFKAGNCLYVLGKCKESKDEFLLALEAAESGGNQWAYLLPQIYVNLGIALEGEGMVLSACEYYREAAILCPTHFRALKLLGSALFGVGEYRAAVKALEEAIYLKPDYADAHCDLASSLHSMGEDERAIEVFQRAIDLKPGHVDALYNLGGLYMDLGRFQRASEMYTRVLTVWPNHWRAQLNKAVSLLGAGETEEAKRALKEALKLTNRVELHDAISHLKHLQKKKGKNNGNGNGGEGPFIVVEPSKFKTVGEKTTLRPDLATALQIRAFQRVTRLGKCDVEAVRKEMRDNDVPVSYSGSGGPTKSIRKPNLEEILRRLLSSLKPDTFQGAIKAINEKILALLDDSGSGRVDMGMFYAVIAPLCGGHSDKRKRVAFDALLWRPVNEGSSQITKTDAVKYIKLLRAIYIPSHGMSEMLEVHGEEEAESSVTVTFNQFLAMFDDPDWGFGIMSTILKLEANDRNRHGNQVCSVCRYPVIGSRFKEVKARFSLCNQCYGEGKVPPSFKQEEYKFREYESEAEAMKAKCVCFSMQSHKKAIAT

SEQ ID NO: 13323 - protein, 717 aa, Arabidopsis thaliana
  misc_feature: Ceres GEMINI ID no. 5110E8
  misc_feature: Useful for making plants with altered alkaloid content
MEDADGLSFDFEGGLDSGPVQNTASVPVAPPENSSSAAVNVAPTYDHSSATVAGAGRGRSFRQTVCRHWLRGLCMKGDACGFLHQFDKARMPICRFFRLYGECREQDCVYKHTNEDIKECNMYKLGFCPNGPDCRYRHAKLPGPPPPVEEVLQKIQQLTTYNYGTNRLYQARNVAPQLQDRPQGQVPMQGQPQESGNLQQQQQQQPQQSQHQVSQTLIPNPADQTNRTSHPLPQGLVKFLRFYLTSTVTKTINRPALGWLYPLVLLLSIISLLFSISAVLNGLIASGFQQDSCDPKSHVFFISDWSPRVDCLFLCSSVAILPITYFVVKSNNRENFELSVQQGVWATQRSNEAKLNEAFDSVENVILIFSVNRTRHFQGCAKMTSRIGGYIGGGNWKHEHGTAQYGRNFSVKWLKLCELSFHKTRNLRNPYNENLPVKISRDCQELEPSVGEQLASLLYLEPDSELMAISIAAEAKREEEKAKGVNPESRAENPDIVPFEDNEEEEEEEDESEEEEESMAGGPQGRGRGRGIMWPPQMPLGRGIRPMPGMGGFPLGVMGPGDAFPYGPGGYNGMPDPFGMGPRPFGPYGPRFGGDFRGPVPGMMFPGRPPQQFPHGGYGMMGGGRGPHMGGMGNAPRGGRPMYYPPATSSARPGPSNRKTPERSDERGVSGDQQNQDASHDMEQFEVGNSLRNEESESEDEDEAPRRSRHGEGKKRR

SEQ ID NO: 13324 - protein, 192 aa, Arabidopsis thaliana
  misc_feature: Ceres GEMINI ID no. 5110F11
  misc_feature: Useful for making plants with altered terpenoid content
METATGEITIVCNHCDRDIPSLNIDLHRVHCARNLEKCKICGDMVPKKHAEEHYLNTHAPIACSMCKETIEREIFDSHKGEICPKRIVTCEFCEFPLPAVDLAEHQEVCGNRTELCYQCNSYVRLRERYNHETKCPGTVESSRRIPRAAEGDGNGRRRRDGNGVSNKRLFFTIAITGIAVIIGSLFFQRKPE

SEQ ID NO: 13325 - protein, 481 aa, Arabidopsis thaliana
  misc_feature: Ceres GEMINI ID no. 5110F5
  misc_feature: Useful for making plants with altered alkaloid content
MESTRSDPELDDDFSEIYKEYTGPASAVTNNNIQDKDKPVKQRSEERCDEEEEQLPDPNSVPTDFTSREAKVWEAKSKATERNWKKRKEEEMICKICGESGHFTQGCPSTLGANRKSQEFFERVPARDNNVRVLFTEKVMESIERETSCKIKLDEKFIIVSGKDRLILRKGVDAVHKVKEDGEMKSSSVSHRSRSRSPRRTSVGPSRARNSEPQRQQLPSHGSSSFPERSGRQDKFVDNRFREETRVRENQRNVPRGSPQAKAYGSDRARSRSTHSKSPGRPRYSGWDKPYDRQKPEVSGYRSERWDQERMGGSSDIQVSHQFERPPFPQTLEELELEYTRDALELEKKRDKEEDEENNKHRETIRELRESYMKKLAGLRGMNAKQWDDFLQLDAQRRQQQARQQNSGLSYGNYRQFPPYAEFDDGYSSNPPPYGGNNMPMDSKGRYPNHGDNYSSRHQDNNYGGFQRQRREEYGKAYNRY

SEQ ID NO: 13326 - protein, 635 aa, Arabidopsis thaliana
  misc_feature: Ceres GEMINI ID no. 5110F8
  misc_feature: Useful for making plants with altered alkaloid content
MANKLKVDELRLKLAERGLSTTGVKAVLVERLEEAIAEDTKKEESKSKRKRNSSNDTYESNKLIAIGEFRGMIVKELREEAIKRGLDTTGTKKDLLERLCNDANNVSNAPVKSSNDEAEDDNNGFEEEKKEEKIVTATKKGAAVLDQWIPDEIKSQYHVLQRGDDVYDAILNQTNVRDNNNKFFVLQVLESDSKKTYMVYTRWGRVGVKGQSKLDGPYDSWDRAIEIFTNKFNDKTKNYWSDRKEFIPHPKSYTWLEMDYGKEENDSPVNNDIPSSSSEVKPEQSKLDTRVAKFISLICNVSMMAQHMMEIGYNANKLPLGKISKSTISKGYEVLKRISEVIDRYDRTRLEELSGEFYTVIPHDFGFKKMSQFVIDTPQKLKQKIEMVEALGEIELATKLLSVDPGLQDDPLYYHYQQLNCGLTPVGNDSEEFSMVANYMENTHAKTHSGYTVEIAQLFRASRAVEADRFQQFSSSKNRMLLWHGSRLTNWAGILSQGLRIAPPEAPVTGYMFGKGVYFADMFSKSANYCYANTGANDGVLLLCEVALGDMNELLYSDYNADNLPPGKLSTKGVGKTAPNPSEAQTLEDGVVVPLGKPVERSCSKGMLLYNEYIVYNVEQIKMRYVIQVKFNYKH

SEQ ID NO: 13327 - protein, 493 aa, Arabidopsis thaliana
  misc_feature: Ceres GEMINI ID no. 5110G4
  misc_feature: Useful for making plants with altered Lignin content
MESQGPSNGHPMDISSNSIPSSACNLCGRVVQSASDDLEIFSLCVDCKFLLLEDFGTPAPPLARRQTIRRRRMRRRRRTTRHDSSESVGVGDLSSQQFTHLISIARQSLSTVQASEDLRDDLRTSSHTTPSGSTRWRLFSESESDDFDNFGETESNASFSLYRFPHADNDTISFSAYGGESDASTDRHADIFVQPDDRSDIDFDTDIDPMRAGLNQWNSDEEDREWEEGAGPSGVAGTRYRNYLASPSESYSSMTRFDSPELERSFRQRIIERRHSLSRNIFTGLEDLDFSPYAANVGDYLDERGFDELLEQLAESDNSRRGAPPASVSCVRNLPRVIIAEEHVMKGLVCAICKELFSLRNETTQLPCLHLYHAHCIVPWLSARNSCPLCRYELPTDDKDYEEGKRNVLDVSEDSSSSDDGTESGEEEYVERGESESGVSRVSRGRWLFLAAAPVVSLVGVVLAMWLSSPHRRGIAISHSQRENRTRRWLPFF

SEQ ID NO: 13328 - protein, 231 aa, Arabidopsis thaliana
  misc_feature: Ceres GEMINI ID no. 5110G8
  misc_feature: The plant flowers significantly late compared to wild-type.
  misc_feature: The plant is abnormally small.
  misc_feature: Useful for making plants with altered alkaloid content
  misc_feature: Useful for making plants with modulated biomass
  misc_feature: Useful for making plants with modulated flowering time
MGRRKVEIKRIENKSSRQVTFCKRRNGLMEKARQLSILCESSVALIIISATGRLYSFSSGDSMAKILSRYELEQADDLKTLCLNIVERDQHRITLFFTVGIALESPRRGSKLDLEEKTLNYLSHKELLETIQCKIEEAKSDNVSIDCLKSLEEQLKTALSVTRARKTELMMELVKTHQEKEKLLREENQSLTNQLIKMGKMKKSVEAEDARAMSPESSSDNKPPETLLLLK

SEQ ID NO: 13329 - protein, 277 aa, Arabidopsis thaliana
  misc_feature: Ceres GEMINI ID no. 5110H1
  misc_feature: Useful for making plants with altered Lignin content
MGRKMVKMTRITNEKTRITTYKKRKACLYKKASEFSTLCGVDTCVIVYGPSRAGDEMVMEPELWPKDGSKVREILTKYRDTASSSCTKTYTVQECLEKNNTKVEKPTIATKYPTWDKKLDQCSLNDLYAVFMAVENKIQEATNRNQTFPDTSCWSNDQLGLCGYNRQCFEQYQLFPLPTMDYNGLSFFPFNNQMTSNTAEVSSFSNVTEPMIANGQSLFYGSCSDGPYGPMVQRTAYMEPIHWGLGNSMFNNVKQFQDYPFRFAQVNDLEDSSKLSM

SEQ ID NO: 13330 - protein, 387 aa, Arabidopsis thaliana
  misc_feature: Ceres GEMINI ID no. 5110H5
  misc_feature: The leaves start out wild-type green and gradually turn yellow-greenin color, while the cotyledons stay wild-type green.
  misc_feature: Useful for biocontainment applications
  misc_feature: Useful for making plants with altered Lignin content
  misc_feature: Useful for making plants with altered alkaloid content
  misc_feature: Useful for making plants with altered terpenoid content
MGSSEMEKSGKEKEPKTTPPSTSSSAPATVVSQEPSSAVSAGVAVTQDWSGFQAYSPMPPHGYVASSPQPHPYMWGVQHMMPPYGTPPHPYVTMYPPGGMYAHPSLPPGSYPYSPYAMPSPNGMAEASGNTGSVIEGDGKPSDGKEKLPIKRSKGSLGSLNMIIGKNNEAGKNSGASANGACSKSAESGSDGSSDGSDANSQNDSGSRHNGKDGETASESGGSAHGPPRNGSNLPVNQTVAIMPVSATGVPGPPTNLNIGMDYWSGHGNVSGAVPGVVVDGSQSQPWLQDEREIKRQRRKQSNRESARRSRLRKQAECDELAQRAEVLNGENSSLRAEINKLKSQYEELLAENSSLKNKFSSAPSLEGGDLDKNEQEPQRSTRQDVA

SEQ ID NO: 13331 - protein, 451 aa, Arabidopsis thaliana
  misc_feature: Ceres GEMINI ID no. 5110H6
  misc_feature: Useful for making plants with altered Lignin content
MGRESVAVVTAPPSATAPGTASVATSLAPGFRFHPTDEELVSYYLKRKVLGQPVRFDAIGEVDIYKHEPWDLAVFSRLKTRDQEWYFYSALDKKYGNGARMNRATNRGYWKATGKDREIRRDILLLGMKKTLVFHSGRAPDGLRTNWVMHEYRLVEYETEKNGNLVQDAYVLCRVFHKNNIGPPSGNRYAPFMEEEWADDEGALIPGIDVKLRLEPPPVANGNDQMDQEIQSASKSLININEPPRETAPLDIESDQQNHHENDLKPEEHNNNNNYDENEETLKREQMEEEERPPRPVCVLNKEAPLPLLQYKRRRQSESNNNSSRNTQDHCSSTTTTVDNTTTLISSSAAATNTAISALLEFSLMGISDKKEKPQQPLRPHKEPLPPQTPLASPEEKVNDLQKEIHQMSVERETFKLEMMSAEAMISILQSRIDALRQENEELKKNNANGQ

SEQ ID NO: 13332 - protein, 373 aa, Arabidopsis thaliana
  misc_feature: Ceres GEMINI ID no. 5111A1
  misc_feature: Useful for making plants with altered alkaloid content
  misc_feature: Useful for making plants with altered terpenoid content
MAADDVIPRDAQKEPKLTVSYLVDSVGIPIKFAESILKEVSSKDKCNPNSVLNLLRSYDFTDSQISSIITTDPELLMEDAENSLCPKLKFLESREILSSRLNDIVTRVPKILRMEEEKSMITYYDFVKTITLTSSRSDFYKVCELYPYIESSIRKVIEMGFDPFAPKIFDATVVVCTLSNETLEERVNIYKTLGFDVRDVWEMFKKCPTFLNISEKKITQSFETLKKCGLVEEERYPQCIGFSEKKILNAVETFLGQGFSKDEVMMMVKCYPPCLNLSAESIKRKTDFLVKKMNCREGVVSIPVVLEFSMEKMIVPRCNVIKALTSKRLLKTEVSSMFSVLICPDEVFLERYVSKHDDQELVDELMSIFTKDQ

SEQ ID NO: 13333 - protein, 409 aa, Arabidopsis thaliana
  misc_feature: Ceres GEMINI ID no. 5111B1
  misc_feature: Useful for making plants with altered terpenoid content
MASSKGSQSVRNLMYPGKHALLPPKIPFPSVSASYSEYIPTGLIGSRHGQKLSNEKTHHQRTSSESHLVEELPFWLDDLLNEQPESPARKCGHRRSSSDSYAYLDVANATNISLTLQNDFSYRNTVLSTQRGVQELDRNKNAQDAAFYSGASFLKQKSRQRDSLVATGACPSWLPFARENGGGKNLGALYMSQDATVISSERKNYAEPFSHDPKMLSSEENNSNPSPVTYEADNTKRAKQQFAQRSRVRKLQYISELERNVQTLQAEGSKVSAELDFLNQRNLILSMENKALKKRLESIAQEKLIKQSSYQDSTVLKIVYLMSSVYYPVEQEVLEKEIGRLRALYQQQQQTQKPSASRGRATSKDLDSQFSSLSLNTKDSNCRRDSVSVMGPGDSTRSDPYLPPHHRRF

SEQ ID NO: 13334 - protein, 378 aa, Arabidopsis thaliana
  misc_feature: Ceres GEMINI ID no. 5111C1
  misc_feature: Useful for making plants with altered terpenoid content
MESDLIDLFEGAKKAADAAALDGVTSSGPEVSQCIDALKQLKKFPVTYDTLVATQVGKKLRSLAKHPVEDIKSVATDLLEIWKKVVIEETAKAKKTEGTNGCKEAKVNKMDVEKPSNPAPVKVQKLQRGDSAKSIKVERKEPDNKVVTGVKIERKVPDIKVTNGTKIDYRGQAVKDEKVSKDNQSSMKAPAKAANAPPKLTAMLKCNDPVRDKIRELLVEALCRVAGEADDYERESVNASDPLRVAVSVESLMFEKLGRSTGAQKLKYRSIMFNLRDSNNPDLRRRVLTGEISPEKLITLSAEDMASDKRKQENNQIKEKALFDCERGLAAKASTDQFKCGRCGQRKCTYYQMQTRSADEPMTTYVTCVNCDNHWKFC

SEQ ID NO: 13335 - protein, 350 aa, Arabidopsis thaliana
  misc_feature: Ceres GEMINI ID no. 5111D1
  misc_feature: Useful for making plants with altered alkaloid content
MALSSAGVVSHLHPPSFSSSSGLSVNRVLFRNRNASPCGLSLPILNPSRSVLVFARGKNRKGFVSSSSSSPKKNKKKSLDGADNGGGEEEEDPFEALFNLLEEDLKNDNSDDEEISEEELEALADELARALGVGDDVDDIDLFGSVTGDVDVDVDNDDDDNDDDDNDDDDDDSEEDERPTKLKNWQLKRLAYALKAGRRKTSIKNLAAEVCLDRAYVLELLRDPPPKLLMLSATLPDEKPPVAAPENSSPDPSPVESLSAEDVVVEPKEKVKDEAVHVMQQRWSAQKRVKKAHIETLEKVYRRSKRPTNAVVSSIVQVTNLPRKRVLKWFEDKRAEDGVPDKRAPYQAPV

SEQ ID NO: 13336 - protein, 473 aa, Arabidopsis thaliana
  misc_feature: Ceres GEMINI ID no. 5117H5
  misc_feature: The plant produces a reduced number of seeds.
  misc_feature: Useful for biocontainment applications
  misc_feature: Useful for making plants with modulated light quality response
  misc_feature: Useful for making plants with modulated low light sensitivity
  misc_feature: Useful for making plants with modulated light quality sensitivity
  misc_feature: Useful for making plants with modulated nitrogen use efficiency
MDNNNNNNTFSSLDNVMTNQNPLLMDFIPSREDSTSFSTMLPWNTIRSDPLQMGGFDIFNSMLTNKYLSSSPRSIDVQDNRNVEFMAPPPHPPPLHPLDHLRHYDDSSNNMWGFEANSEFQAFSGVVGPSEPMMSTFGEEDFPFLISNKRNNELSLSLASDVSDECSEISLCAATRLASEQASCSSKDISNNVVTQGFSQLIFGSKYLHSVQEILSHFAAYSLDYSSRGTESGAASSAFTSRFENITEFLDGDSNNSEAGFGSTFQRRALEAKKTHLLDLLQMVDDRYSHCVDEIHTVISAFHAATELDPQLHTRFALQTVSFLYKNLRERICKKIISMGSVLERGKDKTQETSMFHQHCLLQQLKRKNHQIWRPQRGLPEKSVSVLRNWMFQNFLHPYPKDSEKHLLAIRSGLTRSQVSNWFINARVRLWKPMIEEMYAEMNKRKLNNSHIQPNGPTLRMPKSVMMSQAMHK

SEQ ID NO: 13337 - protein, 58 aa, Arabidopsis thaliana
  misc_feature: Ceres GEMINI ID no. 5118G1
  misc_feature: Useful for making plants with altered Lignin content
  misc_feature: Useful for making plants with altered cell wall content and/or composition
MEAMKMKMMVFIMVVAVAFSAATAATVEAPAPSPTSDAAMFVPALFASVVALASGFIF

SEQ ID NO: 13338 - protein, 195 aa, Arabidopsis thaliana
  misc_feature: Ceres GEMINI ID no. 5122B7
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: Useful for making plants with modulated low light sensitivity
MASHSNKGKGIAEGSSQPQSQPQPQPHQPQSPPNPPALSRYESQKRRDWNTFCQYLRNQQPPVHISQCGSNHILDFLQYLDQFGKTKVHIHGCVFFGQVEPAGQCNCPLKQAWGSLDALIGRLRAAFEENGGLPERNPFAGGGIRVFLREVRDSQAKARGVPYKKRKKRKKRNPMKSHDGEDGTTGTSSSSNLAS

SEQ ID NO: 13339 - protein, 191 aa, Arabidopsis thaliana
  misc_feature: Ceres GEMINI ID no. 5122D5
  misc_feature: The plant produces a reduced number of seeds.
  misc_feature: Useful for biocontainment applications
  misc_feature: Useful for making plants with modulated low light sensitivity
MSSDRHTPTKDPPDHPSSSSNHHKQPLPPQPQQPLSRYESQKRRDWNTFVQYLKSQNPPLMMSQFDYTHVLSFLRYLDQFGKTKVHHQACVFFGQPDPPGPCTCPLKQAWGSLDALIGRLRAAYEEHGGGSPDTNPFANGSIRVHLREVRESQAKARGIPYRKKKRRKTKNEVVVVKKDVANSSTPNQSFT

SEQ ID NO: 13340 - protein, 324 aa, Arabidopsis thaliana
  misc_feature: Ceres GEMINI ID no. 5131E3
  misc_feature: Useful for making plants with modulated low light sensitivity
MEGRDMLSWEQKTLLSELINGFDAAKKLQARLREAPSPSSSFSSPATAVAETNEILVKQIVSSYERSLLLLNWSSSPSVQLIPTPVTVVPVANPGSVPESPASINGSPRSEEFADGGGSSESHHRQDYIFNSKKRKMLPKWSEKVRISPERGLEGPQDDVFSWRKYGQKDILGAKFPRSYYRCTHRSTQNCWATKQVQRSDGDATVFEVTYRGTHTCSQAITRTPPLASPEKRQDTRVKPAITQKPKDILESLKSNLTVRTDGLDDGKDVFSFPDTPPFYNYGTINGEFGHVESSPIFDVVDWFNPTVEIDTTFPAFLHESIYY

SEQ ID NO: 13341 - protein, 292 aa, Arabidopsis thaliana
  misc_feature: Ceres GEMINI ID no. 5134F7
  misc_feature: Useful for making plants with altered Lignin content
  misc_feature: Useful for making plants with altered cell wall content and/or composition
MAKIYSPSFPGTLCLCIFTLLTLMFIRVSARPATFVEDFKAAWSESHIRQMEDGKAIQLVLDQSTGCGFASKRKYLFGRVSMKIKLIPGDSAGTVTAFYMNSDTATVRDELDFEFLGNRSGQPYSVQTNIFAHGKGDREQRVNLWFDPSMDYHTYTILWSHKHIVFYVDDVPIREYKNNEAKNIAYPTSQPMGVYSTLWEADDWATRGGLEKIDWSKAPFYAYYKDFDIEGCPVPGPTFCPSNPHNWWEGYAYQSLNAVEARRYRWVRVNHMVYDYCTDRSRFPVPPPECRA

SEQ ID NO: 13342 - protein, 334 aa, Arabidopsis thaliana
  misc_feature: Ceres GEMINI ID no. 5149B5
  misc_feature: Useful for making plants with modulated low light sensitivity
METTGEVVKTTTGSDGGVTVVRSNAPSDFHMAPRSETSNTPPNSVAPPPPPPPQNSFTPSAAMDGFSSGPIKKRRGRPRKYGHDGAAVTLSPNPISSAAPTTSHVIDFSTTSEKRGKMKPATPTPSSFIRPKYQVENLGEWSPSSAAANFTPHIITVNAGEDVTKRIISFSQQGSLAICVLCANGVVSSVTLRQPDSSGGTLTYEGRFEILSLSGTFMPSDSDGTRSRTGGMSVSLASPDGRVVGGGVAGLLVAATPIQVVVGTFLGGTNQQEQTPKPHNHNFMSSPLMPTSSNVADHRTIRPMTSSLPISTWTPSFPSDSRHKHSHDFNITLT

SEQ ID NO: 13343 - protein, 518 aa, Arabidopsis thaliana
  misc_feature: Ceres GEMINI ID no. 5149E3
  misc_feature: Useful for making plants with modulated low light sensitivity
MDMYNNNIGMFRSLVCSSAPPFTEGHMCSDSHTALCDDLSSDEEMEIEELEKKIWRDKQRLKRLKEMAKNGLGTRLLLKQQHDDFPEHSSKRTMYKAQDGILKYMSKTMERYKAQGFVYGIVLENGKTVAGSSDNLREWWKDKVRFDRNGPAAIIKHQRDINLSDGSDSGSEVGDSTAQKLLELQDTTLGALLSALFPHCNPPQRRFPLEKGVTPPWWPTGKEDWWDQLSLPVDFRGVPPPYKKPHDLKKLWKIGVLIGVIRHMASDISNIPNLVRRSRSLQEKMTSREGALWLAALYREKAIVDQIAMSRENNNTSNFLVPATGGDPDVLFPESTDYDVELIGGTHRTNQQYPEFENNYNCVYKRKFEEDFGMPMHPTLLTCENSLCPYSQPHMGFLDRNLRENHQMTCPYKVTSFYQPTKPYGMTGLMVPCPDYNGMQQQVQSFQDQFNHPNDLYRPKAPQRGNDDLVEDLNPSPSTLNQNLGLVLPTDFNGGEETVGTENNLHNQGQELPTSWIQ

SEQ ID NO: 13344 - protein, 216 aa, Arabidopsis thaliana
  misc_feature: Ceres GEMINI ID no. 5149G2
  misc_feature: Useful for making plants with modulated nitrogen use efficiency
MNGEEVKTSQPQKKLQNPTPRLNERILSSLSKRSVAAHPWHDLEIGPGAPVIFNVVIEISKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHITNINELPPHRLSEIRRFFEDYKKNENKEVAVNDFLQPGPAIEAIQYSMDLYAEYILHTLRR

SEQ ID NO: 13345 - protein, 321 aa, Arabidopsis thaliana
  misc_feature: Ceres GEMINI ID no. 5154A4
  misc_feature: Useful for making plants with altered Lignin content
  misc_feature: Useful for making plants with altered cell wall content and/or composition
MADVHKGKVCVTGAGGFLGSWVVDLLLSKDYFVHGTVRDPDNEKYAHLKKLEKAGDKLKLFKADLLDYGSLQSAIAGCSGVFHVACPVPPASVPNPEVELIAPAVDGTLNVLKACIEANVKRVVYVSSVAAAFMNPMWSKNQVLDEACWSDQEYCKKTENWYCLAKTRAESEAFEFAKRTGLHLVSVCPTLVLGPILQQNTVNASSLVLLKLLKEGFETRDNQERHLVDVRDVAQALLLVYEKAEAEGRYICTSHTVKEEIVVEKLKSFYPHYNYPKKYIDAEDRVKVSSEKLQKLGWTYRPLEETLVDSVESYRKAKLVD

SEQ ID NO: 13346 - protein, 490 aa, Arabidopsis thaliana
  misc_feature: Ceres GEMINI ID no. 5155D5
  misc_feature: Useful for making plants with modulated nitrogen use efficiency
MAEEPTTTTLVTPEKLPSPSLTPSEVSESTQDALPTETETLEKVTETNPPETADTTTKPEEETAAEHHPPTVTETETASTEKQEVKDEASQKEVAEEKKSMIPQNLGSFKEESSKLSDLSNSEKKSLDELKHLVREALDNHQFTNTPEEVKIWGIPLLEDDRSDVVLLKFLRAREFKVKDSFAMLKNTIKWRKEFKIDELVEEDLVDDLDKVVFMHGHDREGHPVCYNVYGEFQNKELYNKTFSDEEKRKHFLRTRIQFLERSIRKLDFSSGGVSTIFQVNDMKNSPGLGKKELRSATKQAVELLQDNYPEFVFKQAFINVPWWYLVFYTVIGPFMTPRSKSKLVFAGPSRSAETLFKYISPEQVPVQYGGLSVDPCDCNPDFSLEDSASEITVKPGTKQTVEIIIYEKCELVWEIRVTGWEVSYKAEFVPEEKDAYTVVIQKPRKMRPSDEPVLTHSFKVNELGKVLLTVDNPTSKKKKLVYRFNVKPL

SEQ ID NO: 13347 - protein, 393 aa, Arabidopsis thaliana
  misc_feature: Ceres GEMINI ID no. 5156A11
  misc_feature: Abnormal phyllotaxy, leaf number higher than wild-type
  misc_feature: Useful for making plants with modulated biomass
  misc_feature: Useful for making plants with modulated low light sensitivity
MFSWLARMALFCLRPMRRYGRMNRDDDDDDDHDGDSSSSGDSLLWSRELERHSFGDFSIAVVQANEVIEDHSQVETGNGAVFVGVYDGHGGPEASRYISDHLFSHLMRVSRERSCISEEALRAAFSATEEGFLTLVRRTCGLKPLIAAVGSCCLVGVIWKGTLLIANVGDSRAVLGSMGSNNNRSNKIVAEQLTSDHNAALEEVRQELRSLHPDDSHIVVLKHGVWRIKGIIQVSRSIGDAYLKRPEFSLDPSFPRFHLAEELQRPVLSAEPCVYTRVLQTSDKFVIFASDGLWEQMTNQQAVEIVNKHPRPGIARRLVRRAITIAAKKREMNYDDLKKVERGVRRFFHDDITVVVIFIDNELLMVEKATVPELSIKGFSHTVGPSKFSIFLS

SEQ ID NO: 13348 - protein, 385 aa, Arabidopsis thaliana
  misc_feature: Ceres GEMINI ID no. 5163C11
  misc_feature: The plant flowers significantly late compared to wild-type.
  misc_feature: Useful for making plants with modulated drought sensitivity
  misc_feature: Useful for making plants with modulated flowering time
  misc_feature: Useful for making plants with modulated water use efficiency
MDMKSGHSSPVMTDSPPISNSRLTIRQNRLPYSSAAATAISQNNNLLLTVPRKKTGILDDVKSNGWLDAMKSSSPPPTILNKDNLSNDATDMTYREWMQLKYPSALTSFEKIMSFAKGKRIALFLDYDGTLSPIVEEPDCAYMSSAMRSAVQNVAKYFPTAIISGRSRDKVYEFVNLSELYYAGSHGMDIMSPAGESLNHEHSRTVSVYEQGKDVNLFQPASEFLPMIDKVLCSLIESTKDIKGVKVEDNKFCISVHYRNVEEKNWTLVAQCVDDVIRTYPKLRLTHGRKVLEIRPVIDWDKGKAVTFLLESLGLNNCEDVLPIYVGDDRTDEDAFKVLRDGPNHGYGILVSAVPKDSNAFYSLRDPSEVMEFLKSLVTWKRSMG

SEQ ID NO: 13349 - protein, 452 aa, Arabidopsis thaliana
  misc_feature: Ceres GEMINI ID no. 5166B2
  misc_feature: Useful for making plants with altered Lignin content
  misc_feature: Useful for making plants with altered cell wall content and/or composition
MGFFLCSSSSIFFKFGISIIFLVSFSGLTPSEAYDPLDPSGNITVKWDIITWTGDGYVATVTVYNFQQYRHIQAPGWTLGWSWAKREVIWGMNGGQTTEQGDCSKFKGTIPHCCKKTPSVVDLLPGSPYNQQIANCCRGGVLNSWAQDPATAVSAFQLTVGQAGTTNKTVRVPKNFTLKAPGPGYTCSPAKIVKPTRFIGTDKRRVTQALMTWNVTCTYSQFLAQKTPTCCVSLSSFYNKTIVSCPTCSCGCRNTSQPGNCVDPKGPRIASVIPNPGKNAYIPPLVQCTKHMCPVRIHWHVKVNYKQYWRVKVTITNFNYNMNYSQWNLVVQHPNFDNLTQTFSFNYKPLTPYASINDTGILWGIKFYNDLLMQAGPFGNVQSELLFQKEASAFTFEKGWAFPRRIYFNGDNCVMPPPDSYPWLPNTGSHKSVGSLFAAMALLLIVFLHGNL

SEQ ID NO: 13350 - protein, 519 aa, Arabidopsis thaliana
  misc_feature: Ceres GEMINI ID no. 5166H4
  misc_feature: Useful for making plants with modulated nitrogen use efficiency
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVSVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVQTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 13351 - protein, 398 aa, Arabidopsis thaliana
  misc_feature: Ceres GEMINI ID no. 5170E1
  misc_feature: Useful for making plants with modulated nitrogen use efficiency
MDLQLKQWRSQQQQQHQTESEEQPSAAKIPKHVFDQIHSHTATSTALPLFTPEPTSSKLSSLSPDSSSRFPKMGSFFSWAQWQELELQALIYRYMLAGAAVPQELLLPIKKSLLHLSPSYFLHHPLQHLPHYQPAWYLGRAAMDPEPGRCRRTDGKKWRCSRDVFAGHKYCERHMHRGRNRSRKPVETPTTVNATATSMASSVAAAATTTTATTTSTFAFGGGGGSEEVVGQGGSFFFSGSSNSSSELLHLSQSCSEMKQESNNMNNKRPYESHIGFSNNRSDGGHILRPFFDDWPRSSLQEADNSSSPMSSATCLSISMPGNSSSDVSLKLSTGNEEGARSNNNGRDQQNMSWWSGGGSNHHHHNMGGPLAEALRSSSSSSPTSVLHQLGVSTQAFH

SEQ ID NO: 13352 - protein, 182 aa, Arabidopsis thaliana
  misc_feature: Ceres GEMINI ID no. 5213F1
  misc_feature: Useful for making plants with modulated low light sensitivity
  misc_feature: Useful for making plants with modulated nitrogen use efficiency
MEGETAAKAAASSSSSPSRYESQKRRDWNTFLQYLRNHKPPLNLSRCSGAHVLEFLKYLDQFGKTKVHATACPFFGQPNPPSQCTCPLKQAWGSLDALIGRLRAAFEEIGGGLPESNPFAAKAVRIYLKEVRQTQAKARGIPYDKKKRKRPHTDTATPIAGDGDDAEGSGGAALVVTAATTV

SEQ ID NO: 13353 - protein, 461 aa, Arabidopsis thaliana [sequence omitted]

SEQ ID NO: 13354 - protein, 104 aa, Arabidopsis thaliana
  misc_feature: Ceres GEMINI ID no. 5239B2
  misc_feature: Useful for making plants with modulated cold sensitivity
MAIKKSNKAALSQAASLKQILKRCSSLGKKNQGNCYFNDVPKGHFPVYVGQHRSRYVVPISWLDHHEFQSLLQLAEEEFGFEHEMGLTIPCDEVVFRSLISMFR

SEQ ID NO: 13355 - protein, 819 aa, Arabidopsis thaliana
  misc_feature: Ceres HVG ID no. 103
  misc_feature: Useful for making plants with modulated drought sensitivity
MEAFLKEFGDYYGYPDGPKNIQEIRDTEFKRLDKGVVYLDHAGSTLYSELQMEYIFKDFTSNVFGNPHSQSDISSATSDLIADARHQVLEYFNASPEDYSCLFTSGATAALKLVGETFPWTQDSNFLYTMENHNSVLGIREYALAQGASACAVDIEEAANQPGQLTNSGPSIKVKHRAVQMRNTSKLQKEESRGNAYNLFAFPSECNFSGLRFNLDLVKLMKENTETVLQGSPFSKSKRWMVLIDAAKGCATLPPDLSEYPADFVVLSFYKLFGYPTGLGALLVRNDAAKLLKKTYFSGGTVAASIADIDFVKRRERVEEFFEDGSASFLSIAAIRHGFKLLKSLTPSAIWMHTTSLSIYVKKKLQALRHGNGAAVCVLYGSENLELSSHKSGPTVTFNLKRPDGSWFGYLEVEKLASLSGIQLRTGCFCNPGACAKYLELSHSELRSNVEAGHICWDDNDVINGKPTGAVRVSFGYMSTFEDAKKFIDFIISSFASPPKKTGNGTVVSGRFPQLPSEDLESKESFPSHYLKSITVYPIKSCAGFSVIRWPLCRTGLLHDREWMVQGLTGEILTQKKVPEMSLIKTFIDLEEGLLSVESSRCEDKLHIRIKSDSYNPRNDEFDSHANILENRNEETRINRWFTNAIGRQCKLLRYSSSTSKDCLNRNKSPGLCRDLESNINFANEAQFLLISEESVADLNRRLEAKDEDYKRAHEKLNPHRFRPNLVISGGEPYGEDKWKTVKIGDNHFTSLGGCNRCQMINISNEAGLVKKSNEPLTTLASYRRVKGKILFGTLLRYEIDEKRQCWIGVGEEVNPDIE

SEQ ID NO: 13356 - protein, 789 aa, Arabidopsis thaliana
  misc_feature: Ceres HVG ID no. 106
  misc_feature: Useful for making plants with modulated flowering time
MVSFSAPKKRRRGRSQRSMSSLNSLPVPNVGLLPGNSNFVSSSASSSGRFNVEVVNGSNQTVKSYPGIGDEIITINKEATTEALLALTAGFPADSLTEEEIEFGVVPIVGGIEQVNYILIRNHIISKWRENISSWVTKEMFLNSIPKHCSSLLDSAYNYLVTHGYINFGIAQAIKDKFPAQSSKSSVIIVGAGLSGLAAARQLMRFGFKVTVLEGRKRPGGRVYTKKMEANRVGAAADLGGSVLTGTLGNPLGIIARQLGSSLYKVRDKCPLYRVDGKPVDPDVDIKVEVAFNQLLDKASKLRQLMGDVSMDVSLGAALETFRQVSGNDVATEEMGLFNWHLANLEYANAGLVSKLSLAFWDQDDPYDMGGDHCFLPGGNGRLVQALAENVPILYEKTVQTIRYGSNGVKVTAGNQVYEGDMVLCTVPLGVLKNGSIKFVPELPQRKLDCIKRLGFGLLNKVAMLFPYVFWSTDLDTFGHLTEDPNYRGEFFLFYSYAPVAGGALLIALVAGEAAHKFETMPPTDAVTRVLHILRGIYEPQGINVPDPLQTVCTRWGGDPFSLGSYSNVAVGASGDDYDILAESVGDGRLFFAGEATTRRYPATMHGAFVTGLREAANMAQSAKARGIRKRIDRNPSRNAHSCAILLADLFRDPDLEFGSFCIIFSRRNPDPKSPAILRVTLSEPRKRNEDPKADQHSNKILFQQLQSHFNQQQQIQVYTLLTRQQALDLREVRGGDEKRLYYLCETLGVKLVGRKGLGVGADSVIASIKAERTGRKLPSSSTSGTKSG

SEQ ID NO: 13357 - protein, 276 aa, Arabidopsis thaliana
  misc_feature: Ceres HVG ID no. 109
  misc_feature: Useful for making plants with altered carbon content
MAASTLYKSCLLQPKSGSTTRRLNPSLVNPLTNPTRVSVLGKSRRDVFAKASIEMAESNSIPSVVVNSSKQHGPIIVIDNYDSFTYNLCQYMGELGCHFEVYRNDELTVEELKKKNPRGVLISPGPGTPQDSGISLQTVLELGPLVPLFGVCMGLQCIGEAFGGKIVRSPFGVMHGKSSMVHYDEKGEEGLFSGLSNPFIVGRYHSLVIEKDTFPSDELEVTAWTEDGLVMAARHRKYKHIQGVQFHPESIITTEGKTIVRNFIKIVEKKESEKLT

SEQ ID NO: 13358 - protein, 1051 aa, Arabidopsis thaliana
  misc_feature: Ceres HVG ID no. 125
  misc_feature: Useful for making plants with altered lignin content
MAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVAMKEEAAGEVPVAFVVKSKDSELSEDDVKQFVSKQVVFYKRINKVFFTESIPKAPSGKILRKDLRAKLANGLMAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVA

SEQ ID NO: 13359 - protein, 102 aa, Arabidopsis thaliana
  misc_feature: Ceres HVG ID no. 145
  misc_feature: Useful for making plants with altered protein content
MDKVMRMSSEKGVVIFTKSSCCLCYAVQILFRDLRVQPTIHEIDNDPDCREIEKALLRLGCSTAVPAVFVGGKLVGSTNEVMSLHLSGSLVPLIKPYQSILY

SEQ ID NO: 13360 - protein, 351 aa, Arabidopsis thaliana
  misc_feature: Ceres HVG ID no. 147
  misc_feature: Useful for making plants with altered oil content
DDDDDDDDDEVDGDDNEKEKIGLYELKKGNLTVKFTNWGASIISLHFPDKNGKMDDIVLGYDSVKTYKTDKVYFGATVGRVANRIGKGKFKLNGKEYKTSVNDGKNTLHGGKKGFGDVVWAVAKHQYDGKKPHIVFTHTSPDGDQGFPGELSVTVTYKLVKDNELSVVMEAKPKDKATPVNLAHHSYWNLGGHNSGDILSEEIQILGSGYTPVDGELIPTGKINPVKGTAYDFLQLRPIKDNMKDLKTGYDINYCLDGKAKKMRKIVELVDKKSGRKMELSGNQAGLQFYTGGMLKDVKGKNGAVYQAFGGLCLETQSYPDALNHPKFPSQIVEPGKKYKHTMLFKFSIVS

SEQ ID NO: 13361 - protein, 171 aa, Zea mays
  misc_feature: Ceres HVG ID no. 149
  misc_feature: Useful for making plants with altered oil content
MGTQAPENYPAEKVQDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVAGVRRHGGVRGERTTSRPPTSS

SEQ ID NO: 13362 - protein, 139 aa, Arabidopsis thaliana
  misc_feature: Ceres HVG ID no. 162
  misc_feature: Useful for making plants with modulated biomass
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTMF

SEQ ID NO: 13363 - protein, 2657 aa, Arabidopsis thaliana
  misc_feature: Ceres HVG ID no. 168
  misc_feature: Useful for making plants with altered cell wall content and/or composition
MNTGGRLIAGSHNRNEFVLINADESARIRSVQELSGQTCQICGDEIELTVSSELFVACNECAFPVCRPCYEYERREGNQACPQCKTRYKRIKGSPRVDGDDEEEEDIDDLEYEFDHGMDPEHAAEAALSSRLNTGRGGLDSAPPGSQIPLLTYCDEDADMYSDRHALIVPPSTGYGNRVYPAPFTDSSAPPQARSMVPQKDIAEYGYGSVAWKDRMEVWKRRQGEKLQVIKHEGGNNGRGSNDDDELDDPDMPMMDEGRQPLSRKLPIRSSRINPYRMLILCRLAILGLFFHYRILHPVNDAYGLWLTSVICEIWFAVSWILDQFPKWYPIERETYLDRLSLRYEKEGKPSGLAPVDVFVSTVDPLKEPPLITANTVLSILAVDYPVDKVACYVSDDGAAMLTFEALSDTAEFARKWVPFCKKFNIEPRAPEWYFSQKMDYLKNKVHPAFVRERRAMKRDYEEFKVKINALVATAQKVPEEGWTMQDGTPWPGNNVRDHPGMIQVFLGHSGVRDTDGNELPRLVYVSREKRPGFDHHKKAGAMNSLIRVSAVLSNAPYLLNVDCDHYINNSKAIRESMCFMMDPQSGKKVCYVQFPQRFDGIDRHDRYSNRNVVFFDINMKGLDGIQGPIYVGTGCVFRRQALYGFDAPKKKKPPGKTCNCWPKWCCLCCGLRKKSKTKAKDKKTNTKETSKQIHALENVDEGVIVPVSNVEKRSEATQLKLEKKFGQSPVFVASAVLQNGGVPRNASPACLLREAIQVISCGYEDKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLIVYCSLPAVCLLTGKFIVPEISNYAGILFMLMFISIAVTGILEMQWGGVGIDDWWRNEQFWVIGGASSHLFALFQGLLKVLAGVNTNFTVTSKAADDGAFSELYIFKWTTLLIPPTTLLIINIIGVIVGVSDAISNGYDSWGPLFGRLFFALWVIVHLYPFLKGMLGKQDKMPTIIVVWSILLASILTLLWVRVNPFVAKGGPVLEICGLNCGNMNTGGRLIAGSHNRNEFVLINADESARIRSVQELSGQTCQICGDEIELTVSSELFVACNECAFPVCRPCYEYERREGNQACPQCKTRYKRIKGSPRVDGDDEEEEDIDDLEYEFDHGMDPEHAAEAALSSRLNTGRGGLDSAPPGSQIPLLTYCDEDADMYSDRHALIVPPSTGYGNRVYPAPFTDSSAPPQARSMVPQKDIAEYGYGSVAWKDRMEVWKRRQGEKLQVIKHEGGNNGRGRQPLSRKLPIRSSRINPYRMLILCRLAILGLFFHYRILHPVNDAYGLWLTSVICEIWFAVSWILDQFPKWYPIERETYLDRLSLRYEKEGKPSGLAPVDVFVSTVDPLKEPPLITANTVLSILAVDYPVDKVACYVSDDGAAMLTFEALSDTAEFARKWVPFCKKFNIEPRAPEWYFSQKMDYLKNKVHPAFVRERRAMKRDYEEFKVKINALVATAQKVPEEGWTMQDGTPWPGNNVRDHPGMIQVFLGHSGVRDTDGNELPRLVYVSREKRPGFDHHKKAGAMNSLIRVSAVLSNAPYLLNVDCDHYINNSKAIRESMCFMMDPQSGKKVCYVQFPQRFDGIDRHDRYSNRNVVFFDINMKGLDGIQGPIYVGTGCVFRRQALYGFDAPKKKKPPGKTCNCWPKWCCLCCGLRKKSKTKAKDKKTNTKETSKQIHALENVDEGVIVPVSNVEKRSEATQLKLEKKFGQSPVFVASAVLQNGGVPRNASPACLLREAIQVISCGYEDKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLIVYCSLPAVCLLTGKFIVPEISNYAGILFMLMFISIAVTGILEMQWGGVGIDDWWRNEQFWVIGGASSHLFALFQGLLKVLAGVNTNFTVTSKAADDGAFSELYIFKWTTLLIPPTTLLIINIIGVIVGVSDAISNGYDSWGPLFGRLFFALWVIVHLYPFLKGMLGKQDKMPTIIVVWSILLASILTLLWVRVNPFVAKGGPVLEICGLNCGNMCFMMDPQSGKKVCYVQFPQRFDGIDRHDRYSNRNVVFFDINMKGLDGIQGPIYVGTGCVFRRQALYGFDAPKKKKPPGKTCNCWPKWCCLCCGLRKKSKTKAKDKKTNTKETSKQIHALENVDEGVIVPVSNVEKRSEATQLKLEKKFGQSPVFVASAVLQNGGVPRNASPACLLREAIQVISCGYEDKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLIVYCSLPAVCLLTGKFIVPEISNYAGILFMLMFISIAVTGILEMQWGGVGIDDWWRNEQFWVIGGASSHLFALFQGLLKVLAGVNTNFTVTSKAADDGAFSELYIFKWTTLLIPPTTLLIINIIGVIVGVSDAISNGYDSWGPLFGRLFFALWVIVHLYPFLKGMLGKQDKMPTIIVVWSILLASILTLLWVRVNPFVAKGGPVLEICGLNCGN

SEQ ID NO: 13364 - protein, 2526 aa, Arabidopsis thaliana
  misc_feature: Ceres HVG ID no. 171
  misc_feature: Useful for making plants with altered cell wall content and/or composition
MNTGGRLIAGSHNRNEFVLINADESARIRSVEELSGQTCQICGDEIELSVDGESFVACNECAFPVCRPCYEYERREGNQSCPQCKTRYKRIKGSPRVEGDEEDDGIDDLDFEFDYSRSGLESETFSRRNSEFDLASAPPGSQIPLLTYGEEDVEISSDSHALIVSPSPGHIHRVHQPHFPDPAAHPRPMVPQKDLAVYGYGSVAWKDRMEEWKRKQNEKYQVVKHDGDSSLGDGDDADIPMMDEGRQPLSRKVPIKSSKINPYRMLIVLRLVILGLFFHYRILHPVNDAYALWLISVICEIWFAVSWVLDQFPKWYPIERETYLDRLSLRYEKEGKPSELAGVDVFVSTVDPMKEPPLITANTVLSILAVDYPVDRVACYVSDDGAAMLTFEALSETAEFARKWVPFCKKYTIEPRAPEWYFCHKMDYLKNKVHPAFVRERRAMKRDYEEFKVKINALVATAQKVPEEGWTMQDGTPWPGNNVRDHPGMIQVFLGNNGVRDVENNELPRLVYVSREKRPGFDHHKKAGAMNSLIRVSGVLSNAPYLLNVDCDHYINNSKALREAMCFMMDPQSGKKICYVQFPQRFDGIDKSDRYSNRNVVFFDINMKGLDGLQGPIYVGTGCVFRRQALYGFDAPKKKKTKRMTCNCWPKWCLFCCGLRKNRKSKTTDKKKKNREASKQIHALENIEEGTKGTNDAAKSPEAAQLKLEKKFGQSPVFVASAGMENGGLARNASPASLLREAIQVISCGYEDKTEWGKEIGWIYGSVTEDILTGFKMHSHGWRSVYCTPKIPAFKGSAPINLSDRLHQVLRWALGSVEIFLSRHCPIWYGYGGGLKWLERLSYINSVVYPWTSIPLLVYCSLPAICLLTGKFIVPEISNYASILFMALFGSIAVTGILEMQWGKVGIDDWWRNEQFWVIGGVSAHLFALFQGLLKVLAGVETNFTVTSKAADDGEFSELYIFKWTSLLIPPTTLLIINVIGVIVGISDAISNGYDSWGPLFGRLFFAFWVILHLYPFLKGLLGKQDRMPTIILVWSILLASILTLLWVRVNPFVAKGGPILEICGLDCLKKKNREASKQIHALENIEEGTKGTNDAAKSPEAAQLKLEKKFGQSPVFVASAGMENGGLARNASPASLLREAIQVISCGYEDKTEWGKEIGWIYGSVTEDILTGFKMHSHGWRSVYCTPKIPAFKGSAPINLSDRLHQVLRWALGSVEIFLSRHCPIWYGYGGGLKWLERLSYINSVVYPWTSIPLLVYCSLPAICLLTGKFIVPEISNYASILFMALFGSIAVTGILEMQWGKVGIDDWWRNEQFWVIGGVSAHLFALFQGLLKVLAGVETNFTVTSKAADDGEFSELYIFKWTSLLIPPTTLLIINVIGVIVGISDAISNGYDSWGPLFGRLFFAFWVILHLYPFLKGLLGKQDRMPTIILVWSILLASILTLLWVRVNPFVAKGGPILEICGLDCLMNTGGRLIAGSHNRNEFVLINADESARIRSVEELSGQTCQICGDEIELSVDGESFVACNECAFPVCRPCYEYERREGNQSCPQCKTRYKRIKGSPRVEGDEEDDGIDDLDFEFDYSRSGLESETFSRRNSEFDLASAPPGSQIPLLTYGEEDVEISSDSHALIVSPSPGHIHRVHQPHFPDPAAHPRPMVPQKDLAVYGYGSVAWKDRMEEWKRKQNEKYQVVKHDGDSSLGDGDDPLSRKVPIKSSKINPYRMLIVLRLVILGLFFHYRILHPVNDAYALWLISVICEIWFAVSWVLDQFPKWYPIERETYLDRLSLRYEKEGKPSELAGVDVFVSTVDPMKEPPLITANTVLSILAVDYPVDRVACYVSDDGAAMLTFEALSETAEFARKWVPFCKKYTIEPRAPEWYFCHKMDYLKNKVHPAFVRERRAMKRDYEEFKVKINALVATAQKVPEEGWTMQDGTPWPGNNVRDHPGMIQVFLGNNGVRDVENNELPRLVYVSREKRPGFDHHKKAGAMNSLIRVSGVLSNAPYLLNVDCDHYINNSKALREAMCFMMDPQSGKKICYVQFPQRFDGIDKSDRYSNRNVVFFDINMKGLDGLQGPIYVGTGCVFRRQALYGFDAPKKKKTKRMTCNCWPKWCLFCCGLRKNRKSKTTDKKKKNREASKQIHALENIEEGTKGTNDAAKSPEAAQLKLEKKFGQSPVFVASAGMENGGLARNASPASLLREAIQVISCGYEDKTEWGKEIGWIYGSVTEDILTGFKMHSHGWRSVYCTPKIPAFKGSAPINLSDRLHQVLRWALGSVEIFLSRHCPIWYGYGGGLKWLERLSYINSVVYPWTSIPLLVYCSLPAICLLTGKFIVPEISNYASILFMALFGSIAVTGILEMQWGKVGIDDWWRNEQFWVIGGVSAHLFALFQGLLKVLAGVETNFTVTSKAADDGEFSELYIFKWTSLLIPPTTLLIINVIGVIVGISDAISNGYDSWGPLFGRLFFAFWVILHLYPFLKGLLGKQDRMPTIILVWSILLASILTLLWVRVNPFVAKGGPILEICGLDCL

SEQ ID NO: 13365 - protein, 3678 aa, Arabidopsis thaliana
  misc_feature: Ceres HVG ID no. 172
  misc_feature: Useful for making plants with altered cell wall content and/or composition
MNTGGRLIAGSHNRNEFVLINADENARIRSVQELSGQTCQICRDEIELTVDGEPFVACNECAFPVCRPCYEYERREGNQACPQCKTRFKRLKGSPRVEGDEEEDDIDDLDNEFEYGNNGIGFDQVSEGMSISRRNSGFPQSDLDSAPPGSQIPLLTYGDEDVEISSDRHALIVPPSLGGHGNRVHPVSLSDPTVAAHPRPMVPQKDLAVYGYGSVAWKDRMEEWKRKQNEKLQVVRHEGDPDFEDGDDADFPMMDEGRQPLSRKIPIKSSKINPYRMLIVLRLVILGLFFHYRILHPVKDAYALWLISVICEIWFAVSWVLDQFPKWYPIERETYLDRLSLRYEKEGKPSGLSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEDGWTMQDGTPWPGNSVRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKGPRKTCNCWPKWCLLCFGSRKNRKAKTVAADKKKKNREASKQIHALENIEEGRVTKGSNVEQSTEAMQMKLEKKFGQSPVFVASARMENGGMARNASPACLLKEAIQVISCGYEDKTEWGKEIGWIYGSVTEDILTGFKMHSHGWRSVYCTPKLAAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPMTLLIINVIGVIVGVSDAISNGYDSWGPLFGRLFFALWVIIHLYPFLKGLLGKQDRMPTIIVVWSILLASILTLLWVRVNPFVAKGGPILEICGLDCLRLIAGSHNRNEFVLINADENARIRSVQELSGQTCQICRDEIELTVDGEPFVACNECAFPVCRPCYEYERREGNQACPQCKTRFKRLKGSPRVEGDEEEDDIDDLDNEFEYGNNGIGFDQVSEGMSISRRNSGFPQSDLDSAPPGSQIPLLTYGDEDVEISSDRHALIVPPSLGGHGNRVHPVSLSDPTVAAHPRPMVPQKDLAVYGYGSVAWKDRMEEWKRKQNEKLQVVRHEGDPDFEDGDDADFPMMDEGRQPLSRKIPIKSSKINPYRMLIVLRLVILGLFFHYRILHPVKDAYALWLISVICEIWFAVSWVLDQFPKWYPIERETYLDRLSLRYEKEGKPSGLSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEDGWTMQDGTPWPGNSVRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKGPRKTCNCWPKWCLLCFGSRKNRKAKTVAADKKKKNREASKQIHALENIEEGRVTKGSNVEQSTEAMQMKLEKKFGQSPVFVASARMENGGMARNASPACLLKEAIQVISCGYEDKTEWGKEIGWIYGSVTEDILTGFKMHSHGWRSVYCTPKLAAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPMTLLIINVIGVIVGVSDAISNGYDSWGPLFGRLFFALWVIIHLYPFLKGLLGKQDRMPTIIVVWSILLASILTLLWVRVNPFVAKGGPILEICGLDCLMNTGGRLIAGSHNRNEFVLINADENARIRSVQELSGQTCQICRDEIELTVDGEPFVACNECAFPVCRPCYEYERREGNQACPQCKTRFKRLKGSPRVEGDEEEDDIDDLDNEFEYGNNGIGFDQVSEGMSISRRNSGFPQSDLDSAPPGSQIPLLTYGDEDVEISSDRHALIVPPSLGGHGNRVHPVSLSDPTVAAHPRPMVPQKDLAVYGYGSVAWKDRMEEWKRKQNEKLQVVRMDEGRQPLSRKIPIKSSKINPYRMLIVLRLVILGLFFHYRILHPVKDAYALWLISVICEIWFAVSWVLDQFPKWYPIERETYLDRLSLRYEKEGKPSGLSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEDGWTMQDGTPWPGNSVRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKGPRKTCNCWPKWCLLCFGSRKNRKAKTVAADKKKKNREASKQIHALENIEEGRVTKGSNVEQSTEAMQMKLEKKFGQSPVFVASARMENGGMARNASPACLLKEAIQVISCGYEDKTEWGKEIGWIYGSVTEDILTGFKMHSHGWRSVYCTPKLAAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPMTLLIINVIGVIVGVSDAISNGYDSWGPLFGRLFFALWVIIHLYPFLKGLLGKQDRMPTIIVVWSILLASILTLLWVRVNPFVAKGGPILEICGLDCLFRRQALYGFDAPKKKKGPRKTCNCWPKWCLLCFGSRKNRKAKTVAADKKKKNREASKQIHALENIEEGRVTKGSNVEQSTEAMQMKLEKKFGQSPVFVASARMENGGMARNASPACLLKEAIQVISCGYEDKTEWGKEIGWIYGSVTEDILTGFKMHSHGWRSVYCTPKLAAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPMTLLIINVIGVIVGVSDAISNGYDSWGPLFGRLFFALWVIIHLYPFLKGLLGKQDRMPTIIVVWSILLASILTLLWVRVNPFVAKGGPILEICGLDCL

SEQ ID NO: 13366 - protein, 1346 aa, Arabidopsis thaliana
  misc_feature: Ceres HVG ID no. 175
  misc_feature: Useful for making plants with modulated drought sensitivity
MDQQPERREGRSFPERKGQKRKLEEGAAAVEDREISAVSTDGGQALLSEVAAQVSVLNSAFSWQESDRAAAKRATQVLAELAKNAEDLVNVIVDGGAVPALMTHLQAPPYNDGDLAEKPYEHEVEKGSAFALGLLAIKPEYQKLIVDKGALPHLVNLLKRNKDGSSSRAVNSVIRRAADAITNLAHENSSIKTRVRVEGGIPPLVELLEFSDSKVQRAAAGALRTLAFKNDDNKNQIVECNALPTLILMLGSEDAAIHYEAVGVIGNLVHSSPHIKKEVLTAGALQPVIGLLSSCCPESQREAALLLGQFASTDSDCKVHIVQRGAVRPLIEMLQSPDVQLKEMSAFALGRLAQDAHNQAGIAHSGGLGPLLKLLDSRNGSLQHNAAFALYGLADNEDNVSDFIRVGGIQKLQDGEFIVQVLRHLLYLMRISEKSIQRRVALALAHLWLELLLGLLGSLNTKQQLDGAAALYKLANKSMALSPVDAAPPSPTQRVYLGEQYVNNATLSDVTFLVEDAFRAMFDGGYREKDARDIEIPNIKWEVFELMMRFIYTGSVDITNEISKDLLRAADQYLLEGLKRLCEYTIAQYLTKSDTVTLNMKGYYVGKYRRHVRAIRSIPCDVAEASLYHVHPGAFRMDQQPERREGRSFPERKGQKRKLEEGAAAVEDREISAVSTDGGQALLSEVAAQVSVLNSAFSWQESDRAAAKRATQVLAELAKNEDLVNVIVDGGAVPALMTHLQAPPYNDGDLAEKPYEHEVEKGSAFALGLLAIKPEYQKLIVDKGALPHLVNLLKRNKDGSSSRAVNSVIRRAADAITNLAHENSSIKTRVRVEGGIPPLVELLEFSDSKVQRAAAGALRTLAFKNDDNKNQIVECNALPTLILMLGSEDAAIHYEAVGVIGNLVHSSPHIKKEVLTAGALQPVIGLLSSCCPESQREAALLLGQFASTDSDCKVHIVQRGAVRPLIEMLQSPDVQLKEMSAFALGRLAQDAHNQAGIAHSGGLGPLLKLLDSRNGSLQHNAAFALYGLADNEDNVSDFIRVGGIQKLQDGEFIVQATKDCVSKTLKRLEEKIHGRVLRHLLYLMRISEKSIQRRVALALAHLCSPEDQRTIFIDDNGLELLLGLLGSLNTKQQLDGAAALYKLANKSMALSPVDAAPPSPTQRVYLGEQYVNNATLSDVTFLVEGRTFYAHRICLLASSDAFRAMFDGGYREKDARDIEIPNIKWEVFELMMRFIYTGSVDITNEISKDLLRAADQYLLEGLKRLCEYTIAQDITLESIGDMYELSEAFHAMSLRQACIMFILEHFDKLSSMPWQNELVQRTIPEIREYFCRALTKSTTNLQSLRL

SEQ ID NO: 13367 - protein, 733 aa, Arabidopsis thaliana
  misc_feature: Ceres HVG ID no. 177
  misc_feature: Useful for making plants with modulated drought sensitivity
MEDPLIGRDSLGGGGTDRVRRSEAITHGTPFQKAAALVDLAEDGIGLPVEILDQSSFGESARYYFIFTRLDLIWSLNYFALLFLNFFEQPLWCEKNPKPSCKDRDYYYLGELPYLTNAESIIYEVITLAILLVHTFFPISYEGSRIFWTSRLNLVKVACVVILFVDVLVDFLYLSPLAFDFLPFRIAPYVRVIIFILSIRELRDTLVLLSGMLGTYLNILALWMLFLLFASWIAFVMFEDTQQGLTVFTSYGATLYQMFILFTTSNNPDVWIPAYKSSRWSSVFFVLYVLIGVYFVTNLILAVVYDSFKEQLAKQVSGMDQMKRRMLEKAFGLIDSDKNGEIDKNQCIKLFEQLTNYRTLPKISKEEFGLIFDELDDTRDFKINKDEFADLCQAIALRFQKEEVPSLFEHFPQIYHSALSQQLRAFVRSPNFGYAISFILIINFIAVVVETTLDIEESSAQKPWQVAEFVFGWIYVLEMALKIYTYGFENYWREGANRFDFLVTWVIVIGETATFITPDENTFFSNGEWIRYLLLARMLRLIRLLMNVQRYRAFIATFITLIPSLMPYLGTIFCVLCIYCSIGVQVFGGLVNAGNKKLFETELAEDDYLLFNFNDYPNGMVTLFNLLVMGNWQVWMESYKDLTGTWWSITYFVSFYVITILLLLNLVVAFVLEAFFTELDLEEEEKCQGQDSQEKRNRRRSAGSKSRSQRVDTLLHHMLGDELSKPECSTSDT

SEQ ID NO: 13368 - protein, 369 aa, Glycine max
  misc_feature: Ceres HVG ID no. 25
  misc_feature: Useful for making plants with modulated biomass
MYLGVRKRPWGRYAAEIRNPYTKERHWLGTFDTAEEAAIAYDLSSIKICGINARTNFHYPFVSLPPLPMSSLPPPPPPPTPELDPSVEVCLEMMNAASYDGDDESLVIASILQSFSNSGNCSFMYLGVRKRPWGRYAAEIRNPYTKERHWLGTFDTAEEAAIAYDLSSIKICGINARTNFHYPFVSLPPLPMSSLPPPPPPPTPELDPSVEVCLEMMNAASYDGDDESLVIASILQSFSNSGNCSFMYLGVRKRPWGRYAAEIRNPYTKERHWLGTFDTAEEAAIAYDLSSIKICGINARTNFHYPFVSLPPLPMSSLPPPPPPPTPELDPSVEVCLEMMNAASYDGDDESLVIASILQSFSNSGNCSF

SEQ ID NO: 13369 - protein, 353 aa, Arabidopsis thaliana
  misc_feature: Ceres HVG ID no. 259
  misc_feature: Useful for making plants with modulated drought sensitivity
MAYEKELDAAKKAASLAARLCQKVQKALLQSDVQSKSDKSPVTVADYGSQAVVSLVLEKELSSEPFSLVAEEDSGDLRKDGSQDTLERITKLVNDTLATEESFNGSTLSTDDLLRAIDCGTSEGGPNGRHWVLDPIDGTKGFLRGDQYAVALGLLEEGKVVLGVLACPNLPLASIAGNNKNKSSSDEIGCLFFATIGSGTYMQLLDSKSSPVKVQVSSVENPEEASFFESFEGAHSLHDLSSSIANKLGVKAPPVRIDSQAKYGALSRGDGAIYLRFPHKGYREKIWDHVAGAIVVTEAGGIVTDAAGKPLDFSKGKYLDLDTGIIVANEKLMPLLLKAVRDSIAEQEKASAL

SEQ ID NO: 13370 - protein, 219 aa, Arabidopsis thaliana
  misc_feature: Ceres HVG ID no. 263
  misc_feature: Useful for making plants with modulated drought sensitivity
MANEVILLDFWPSMFGMRTRIALREKGVEFEYREEDLRNKSPLLLQMNPIHKKIPVLIHNGKPVNESIIQVQYIDEVWSHKNPILPSDPYLRAQARFWADFIDKKLYDAQRKVWATKGEEQEAGKKDFIEILKTLESELGDKPYFSGDDFGYVDIALIGFYTWFPAYEKFANFSIESEVPKLIAWVKKCLQRESVAKSLPDPEKVTEFVSELRKKFVPE

SEQ ID NO: 13371 - protein, 873 aa, Arabidopsis thaliana
  misc_feature: Ceres HVG ID no. 266
  misc_feature: Useful for making plants with modulated drought sensitivity
MGTHINFNNLGGGGHPGGEGSSNQMKPTGSVMPLARQSSVYSLTFDELQNTLGGPGKDFGSMNMDELLKSIWTAEEAQAMAMTSAPAATAVAQPGAGIPPPGGNLQRQGSLTLPRTISQKTVDEVWKCLITKDGNMEGSSGGGGESNVPPGRQQTLGEMTLEEFLFRAGVVREDNCVQQMGQVNGNNNNGFYGNSTAAGGLGFGFGQPNQNSITFNGTNDSMILNQPPGLGLKMGGTMQQQQQQQQLLQQQQQQMQQLNQPHPQQRLPQTIFPKQANVAFSAPVNITNKGFAGAANNSINNNNGLASYGGTGVTVAATSPGTSSAENNSLSPVPYVLNRGRRSNTGLEKVIERRQRRMIKNRESAARSRARKQAYTLELEAEIEKLKKTNQELQKKQAEMVEMQKNELKETSKRPWGSKRQCLRRTLTGPWMGTHINFNNLGGGGHPGGEGSSNQMKPTGSVMPLARQSSVYSLTFDELQNTLGGPGKDFGSMNMDELLKSIWTAEEAQAMAMTSAPAATAVAQPGAGIPPPGGNLQRQGSLTLPRTISQKTVDEVWKCLITKDGNMEGSSGGGGESNVPPGRQQTLGEMTLEEFLFRAGVVREDNCVQQMGQVNGNNNNGFYGNSTAAGGLGFGFGQPNQNSITFNGTNDSMILNQPPGLGLKMGGTMQQQQQQQQLLQQQQQQMQQLNQPHPQQRLPQTIFPKQANVAFSAPVNITNKGFAGAANNSINNNNGLASYGGTGVTVAATSPGTSSAENNSLSPVPYVLNRGRRSNTGLEKVIERRQRRMIKNRESAARSRARKQAYTLELEAEIEKLKKTNQELQKKQVSFCLQPLSERNVEATVGQQKAMLEKDINRTMVKDEATRTDEPDS

SEQ ID NO: 13372 - protein, 416 aa, Arabidopsis thaliana
  misc_feature: Ceres HVG ID no. 269
  misc_feature: Useful for making plants with modulated drought sensitivity
  misc_feature: Useful for making plants with modulated water use efficiency
MDGSMNLGNEPPGDGGGGGGLTRQGSIYSLTFDEFQSSVGKDFGSMNMDELLKNIWSAEETQAMASGVVPVLGGGQEGLQLQRQGSLTLPRTLSQKTVDQVWKDLSKVGSSGVGGSNLSQVAQAQSQSQSQRQQTLGEVTLEEFLVRAGVVREEAQVAARAQIAENNKGGYFGNDANTGFSVEFQQPSPRVVAAGVMGNLGAETANSLQVQGSSLPLNVNGARTTYQQSQQQQPIMPKQPGFGYGTQMGQLNSPGIRGGGLVGLGDQSLTNNVGFVQGASAAIPGALGVGAVSPVTPLSSEGIGKSNGDSSSLSPSPYMFNGGVRGRKSGTVEKVVERRQRRMIKNRESAARSRARKQAYTVELEAEVAKLKEENDELQRKQARIMEMQKNQETEMRNLLQGGPKKKLRRTESGPW

SEQ ID NO: 13373 - protein, 453 aa, Arabidopsis thaliana
  misc_feature: Ceres HVG ID no. 271
  misc_feature: Useful for making plants with modulated drought sensitivity
MASGREEFVYMAKLAEQAERYEEMVEFMEKVSAAVDGDELTVEERNLLSVAYKNVIGARRASWRIISSIEQKEESRGNDDHVTAIREYRSKIETELSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQMASGREEFVYMAKLAEQAERYEEMVEFMEKVSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQ

SEQ ID NO: 13374 - protein, 538 aa, Arabidopsis thaliana
  misc_feature: Ceres HVG ID no. 272
  misc_feature: Useful for making plants with modulated drought sensitivity
  misc_feature: The sequence is a functional homolog of SEQ ID NO 2 in US patent 7041875
MLDSLVSKLPSLSTSDHASVVALNLFVALLCACIVLGHLLEENRWMNESITALLIGLGTGVTILLISKGKSSHLLVFSEDLFFIYLLPPIIFNAGFQVKKKQFFRNFVTIMLFGAVGTIISCTIISLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGAATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVFGMLTKPLISYLLPHQNATTSMLSDDNTPKSIHIPLLDQDSFIEPSGNHNVPRPDSIRGFLTRPTRTVHYYWRQFDDSFMRPVFGGRGFVPFVPGSPTERNPPDLSKA

SEQ ID NO: 13375 - protein, 715 aa, Arabidopsis thaliana
  misc_feature: Ceres HVG ID no. 275
  misc_feature: Useful for making plants with modulated drought sensitivity
MKSLHVAANAGDLAEDCGILGGDADDTVLMDGIDEVGREIWLDDHGGDNNHVHGHQDDDLIVHHDPSIFYGDLPTLPDFPCMSSSSSSSTSPAPVNAIVSSASSSSAASSSTSSAASWAILRSDGEDPTPNQNQYASGNCDDSSGALQSTASMEIPLDSSQGFGCGEGGGDCIDMMETFGYMDLLDSNEFFDTSAIFSQDDDTQNPNLMDQTLERQEDQVVVPMLENNSGGDMQMMNSSLEQDDDLAAVFLEWLKNNKETVSAEDLRKVKIKKATIESAARRLGGGKEAMKQLLKLILEWVQTNHLQRRRTTTTTTNLSYQQSFQQDPFQNPNPNNNNLIPPSDQTCFSPSTWVPPPPQQQAFVSDPGFGYMPAPNYPPQPEFLPLLESPPSWPPPPQSGPMPHQQFPMPPTSQYNQFGDPTGFNGYNMNPYQYPYVPAGQMRDQRLLRLCSSATKEARKKRMARQRRFLSHHHRHNNNNNNNNNQQNQTQIGETCAAVAPQLNPVATTATGGTWMYWPNVPAVPPQLPPVMETQLPTMDRAGSASAMPRQQVVPDRRQGWKPEKNLRFLLQKVLKQSDVGNLGRIVLPKKEAETHLPELEARDGISLAMEDIGTSRVWNMRYRFWPNNKSRMYLLENTGDFVKTNGLQEGDFIVIYSDVKLIRGVKVRQPSGQKPEAPPSSAATKRQNKSQRNINNNSPSANVVVASPTSQTVK

SEQ ID NO: 13376 - protein, 918 aa, Arabidopsis thaliana
  misc_feature: Ceres HVG ID no. 28
  misc_feature: Useful for making plants with altered tocopherol content
MGHQNAAVSENQNHDDGAASSPGFKLVGFSKFVRKNPKSDKFKVKRFHHIEFWCGDATNVARRFSWGLGMRFSAKSDLSTGNMVHASYLLTSGDLRFLFTAPYSPSLSAGEIKPTTTASIPSFDHGSCRSFFSSHGLGVRAVAIEVEDAESAFSISVANGAIPSSPPIVLNEAVTIAEVKLYGDVVLRYVSYKAEDTEKSEFLPGFERVEDASSFPLDYGIRRLDHAVGNVPELGPALTYVAGFTGFHQFAEFTADDVGTAESGLNSAVLASNDEMVLLPINEPVHGTKRKSQIQTYLEHNEGAGLQHLALMSEDIFRTLREMRKRSSIGGFDFMPSPPPTYYQNLKKRVGDVLSDDQIKECEELGILVDRDDQGTLLQIFTKPLGDRPTIFIEIIQRVGCMMKDEEGKAYQSGGCGGFGKGNFSELFKSIEEYEKTLEAKQLVGMCLSLASTAQRNTQFRSRVLVLAELVKSMGHQNAAVSENQNHDDGAASSPGFKLVGFSKFVRKNPKSDKFKVKRFHHIEFWCGDATNVARRFSWGLGMRFSAKSDLSTGNMVHASYLLTSGDLRFLFTAPYSPSLSAGEIKPTTTASIPSFDHGSCRSFFSSHGLGVRAVAIEVEDAESAFSISVANGAIPSSPPIVLNEAVTIAEVKLYGDVVLRYVSYKAEDTEKSEFLPGFERVEDASSFPLDYGIRRLDHAVGNVPELGPALTYVAGFTGFHQFAEFTADDVGTAESGLNSAVLASNDEMVLLPINEPVHGTKRKSQIQTYLEHNEGAGLQHLALMSEDIFRTLREMRKRSSIGGFDFMPSPPPTYYQNLKKRVGDVLSDDQIKECEELGILVDRDDQGTLLQIFTKPLGDRPTIFIEIIQRVGCMMKDEEGKAYQSGGCGGFGKGNFSELFKSIEEYEKTLEAKQLVG

SEQ ID NO: 13377 - protein, 2150 aa, Arabidopsis thaliana
  misc_feature: Ceres HVG ID no. 286
  misc_feature: Useful for making plants with modulated biomass
  misc_feature: Useful for making plants with modulated seed size
MASSEVSMKGNRGGDNFSSSGFSDPKETRNVSVAGEGQKSNSTRSAAAERALDPEAALYRELWHACAGPLVTVPRQDDRVFYFPQGHIEQASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVMASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNSPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNSMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 13378 - protein, 1091 aa, Arabidopsis thaliana
  misc_feature: Ceres HVG ID no. 296
  misc_feature: Useful for making plants with modulated low light sensitivity
MYKQPRQELEAYYFEPNSVEKLRYLPVNNSRKRFCTLEPFPDSPPYNALSTATYDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLLEGLVAQLASSGSSIYKALNRCPEPASTELLSYMHILYEVCPYFKFGYMSANGAIAEAMKEENRVHIIDFQIGQGSQWVTLIQAFAARPGGPPRIRITGIDDMTSAYARGGGLSIVGNRLAKLAKQFNVPFEFNSVSVSVSEVKPKNLGVRPGEALAVNFAFVLHHMPDESVSTENHRDRLLRMVKSLSPKVVTLVEQESNTNTAAFFPRFMETMNYYAAMFESIDVTLPRDHKQRINVEQHCLARDVVNIIACEGADRVERHELLGKWRSRFGMAGFTPYPLSPLVNSTIKSLLRNYSDKYRLEERDGALYLGWMHRDLVASCAWKDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLLEGLVAQLASSGSSIYKALNRCPEPASTELLSYMHILYEVCPYFKFGYMSANGAIAEAMKEENRVHIIDFQIGQGSQWVTLIQAFAARPGGPPRIRITGIDDMTSAYARGGGLSIVGNRLAKLAKQFNVPFEFNSVSVSVSEVKPKNLGVRPGEALAVNFAFVLHHMPDESVSTENHRDRLLRMVKSLSPKVVTLVEQESNTNTAAFFPRFMETMNYYAAMFESIDVTLPRDHKQRINVEQHCLARDVVNIIACEGADRVERHELLGKWRSRFGMAGFTPYPLSPLVNSTIKSLLRNYSDKYRLEERDGALYLGWMHRDLVASCAWKYKQPRQELEAYYFEPNSVEKLRYLPVNNSRKRFCTLEPFPDSPPYNALSTATYDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLPRW

SEQ ID NO: 13379 - protein, 441 aa, Arabidopsis thaliana
  misc_feature: Ceres HVG ID no. 308
  misc_feature: Useful for making plants with modulated low light sensitivity
  misc_feature: Useful for making plants with modulated light quality sensitivity
MERDEEASGPMMEMCTNGGEETSNRRPIISGEPLDIEAYAALYKGRTKIMRLLFIANHCGGNHALQFDALRMAYDEIKKGENTQLFREVVNKIGNRLGEKYGMDLAWCEAVDRRAEQKKVKLENELSSYRTNLIKESIRMGYNDFGDFYYACGMLGDAFKNYIRTRDYCTTTKHIIHMCMNAILVSIEMGQFTHVTSYVNKAEQNPETLEPMVNAKLRCASGLAHLELKKYKLAARKFLDVNPELGNSYNEVIAPQDIATYGGLCALASFDRSELKQKVIDNINFRNFLELVPDVRELINDFYSSRYASCLEYLASLKSNLLLDIHLHDHVDTLYDQIRKKALIQYTLPFVSVDLSRMADAFKTSVSGLEKELEALITDNQIQARIDSHNKILYARHADQRNATFQKVLQMGNEFDRDVRAMLLRANLLKHEYHARSARKL

SEQ ID NO: 13380 - protein, 485 aa, Arabidopsis thaliana
  misc_feature: Ceres HVG ID no. 310
  misc_feature: Useful for making plants with modulated low light sensitivity
MDIEQKQAEIIDQLVKRASTCKSEALGPLIIEATSHPSLFAFSEILALPNVAQLEGTTDSVYLDLLRLFAHGTWGDYKCNATRLPHLSPDQILKLKQLTVLTLAESNKVLPYDTLMVELDVSNVRELEDFLINECMYAGIVRGKLDQLKRCFEVPFAAGRDLRPGQLGNMLHTLSNWLNTSENLLISIQDKIKWADNMSEMDKKHRKEAEEGVEEVKKSLSMKGDVDIRGNKEMFGEPSGVMDYEEDGIRPKRRRHPVTRMDIEQKQAEIIDQLVKRASTCKSEALGPLIIEATSHPSLFAFSEILALPNVAQLEGTTDSVYLDLLRLFAHGTWGDYKCNATRLPHLSPDQILKLKQLTVLTLAESNKVLPYDTLMVELDVSNVRELEDFLINECMYAGIVRGKLDQLKRCFEVPFAAGRDLRPGQLGNMLHTLSNWLNTSENLLISIQDKIKWADNMSEMDKKHRKEAEEGVEEVKKSLSMKRE

SEQ ID NO: 13381 - protein, 429 aa, Arabidopsis thaliana
  misc_feature: Ceres HVG ID no. 311
  misc_feature: Useful for making plants with modulated low light sensitivity
  misc_feature: Useful for making plants with modulated light quality sensitivity
MIGAVNSVEAVITSIQGLSGSPEDLSALHDLLRGAQDSLRAEPGVNFSTLDQLDASKHSLGYLYFLEVLTCGPVSKEKAAYEIPIIARFINSCDAGQIRLASYKFVSLCKILKDHVIALGDPLRGVGPLLNAVQKLQVSSKRLTALHPDVLQLCLQAKSYKSGFSILSDDIVEIDQPRDFFLYSYYGGMICIGLKRFQKALELLYNVVTAPMHQVNAIALEAYKKYILVSLIHNGQFTNTLPKCASTAAQRSFKNYTGPYIELGNCYNDGKIGELEALVVARNAEFEEDKNLGLVKQAVSSLYKRNILRLTQKYLTLSLQDIANMVQLGNAKEAEMHVLQMIQDGQIHALINQKDGMVRFLEDPEQYKSSEMIEIMDSVIQRTIGLSKNLLAMDESLSCDPLYLGKVGRERQRYDFGDDFDTVPQKFSM

SEQ ID NO: 13382 - protein, 333 aa, Arabidopsis thaliana [sequence omitted]

SEQ ID NO: 13383 - protein, 1107 aa, Arabidopsis thaliana
  misc_feature: Ceres HVG ID no. 327
  misc_feature: Useful for making plants with modulated cold sensitivity
MGRSKLASRPAEEDLNPGKSKRKKISLGPENAAASISTGIEAGNERKPGLYCCNYCDKDLSGLVRFKCAVCMDFDLCVECFSVGVELNRHKNSHPYRVMDNLSFSLVTSDWNADEEILLLEAIATYGFGNWKEVADHVGSKTTTECIKHFNSAYMQSPCFPLPDLSHTIGKSKDELLAMSKDSAVKTEIPAFVRLSPKEELPVSAEIKHEASGKVNEIDPPLSALAGVKKKGNVPQAKDIIKLEAAKQQSDRSVGEKKLRLPGEKVPLVTELYGYNLKREEFEIEHDNDAEQLLADMEFKDSDTDAEREQKLQVLRIYSKRLDERKRRKEFVLERNLLYPDQYEMSLSAEERKIYKSCKVFARFQSKEEHKELIKKVIEEHQILRRIEDLQEARTAGCRTTSDANRFIEEKRKKEAEESMLLRLNHGAPGSIAGKTLKSPRGLPRNLHPFGSDSLPKVTPPRIYSGLDTWDVDGLLGADLLSETEKKMCNETRILPVHYLKMLDILTREIKKGQIKKKSDAYSFFKVEPSKVDRVYDMLVHKGIGDSTNLPGRSASLVPMGRSKLASRPAEEDLNPGKSKRKKISLGPENAAASISTGIEAGNERKPGLYCCNYCDKDLSGLVRFKCAVCMDFDLCVECFSVGVELNRHKNSHPYRVMDNLSFSLVTSDWNADEEILLLEAIATYGFGNWKEVADHVGSKTTTECIKHFNSAYMQSPCFPLPDLSHTIGKSKDELLAMSKDSAVKTEIPAFVRLSPKEELPVSAEIKHEASGKVNEIDPPLSALAGVKKKGNVPQAKDIIKLEAAKQQSDRSVGEKKLRLPGEKVPLVTELYGYNLKREEFEIEHDNDAEQLLADMEFKDSDTDAEREQKLQVLRIYSKRLDERKRRKEFVLERNLLYPDQYEMSLSAEERKIYKSCKVFARFQSKEEHKELIKKVIEEHQILRRIEDLQEARTAGCRTTSDANRFIEEKRKKEAEESMLLRLNHGAPGSIAGKTLKSPRGLPRNLHPFGSDSLPKVTPPRIYSGLDTWDVDGLLGADLLSETEKKMCNETRILPVHYLKMLDILTREIKKGQIKKKSDAYSFFKVEPSKVDRVYDMLVHKGIGDST

SEQ ID NO: 13384 - protein, 505 aa, Arabidopsis thaliana
  misc_feature: Ceres HVG ID no. 331
  misc_feature: Useful for making plants with modulated flowering time
MRDEYRQSRGCGFVKYSSKETAMAAIDGLNGTYTMRGCNQPLIVRFAEPKRPKPGESREMAPPVGLGSGPRFQASGPRPTSNFGDSSGDVSHTNPWRPATSRNVGPPSNTGIRGAGSDFPPKPGQATLPSNQGGPLGGYGVPPLNPLPVPGVSSSATLQQQNRAAGQHITPLKKPLHSPQGLPLPLRPQTNFPGAQAPLQNPYAYSSQLPTSQLPPQQNISRATAPQTPLNINLRPTTVSSATVQFPPRSQQQPLQKMQHPPSELAQLLSQQTQSLQATFQSSQQAISQLQQQVQSMQQPNQNLPLSQNGRAGKQQWAGSAIPRVASTTGSTPVSYVQTAAPAVSQSVGSVKCTWTEHTSPDGFKYYYNGLTGESKWEKPEEMIVFEREQQKQQQHQEKPTIQQSQTQLQPLQQQPQQVQQQYQGQQLQQPFYSSLYPTPGASHNTQYPSLPVGQNSQFPMSGIGQNAQDYARTHIPVGAASMNDISRTQQSRQSPQELMWKNKA

SEQ ID NO: 13385 - protein, 953 aa, Arabidopsis thaliana
  misc_feature: Ceres HVG ID no. 332
  misc_feature: Useful for making plants with modulated flowering time
MDAFKEEIEIGSSVESLMELLDSQKVLFHSQIDQLQDVVVAQCKLTGVNPLAQEMAAGALSIKIGKRPRDLLNPKAVKYLQAVFAIKDAISKRESREISALFGITVAQVREFFVTQKTRVRKQVRLSREKVVMSNTHALQDDGVPENNNATNHVEPVPLNSIHPEACSISWGEGETVALIPPEDIPPDISDSDKYFVENIFSLLRKEETFSGQVKLMEWIMQIQDASVLIWFLSKGGVLILTTWLSQAASEEQTSVLLLILKVLCHLPLHKASPENMSAILQSVNGLRFYRISDISNRAKGLLSRWTKLFAKIQAMKKQNRNSSQIDSQSQLLLKQSIAEIMGDSSNPEDILSLSNGKSENVRRIESSQGPKLLLTSADDSTKKHMLGSNPSYNKERRKVQMVEQPGQKAAGKSPQTVRIGTSGRSRPMSADDIQKAKMRALYMQSKNSKKDPLPSAIGDSKIVAPEKPLALHSAKDSPPIQNNEAKTEDTPVLSTVQPVNGFSTIQPVNGPSAVQPVNGPLAVQPVNGPSALQPVNGPSAVIVPVQADEIKKPSTPPKSISSKVGVMMKMSSQTILKNCKRKQIDWHVPPGMELDELWRVAAGGNSKEADVQRNRNRRERETTYQSLQTIPLNPKEPWDREMDYDDSLTPEIPSQQPPEESLTEPQDSLDERRIAAGAATTSSSLSSPEPDLELLAALLKNPDLVYALTSGKPSNLAGQDMVKLLDVIKTGAPNSSSSSNKQVEERVEVSLPSPTPSTNPGMSGWGQEGIRNPFSRQNQVGTAVARSGTQLRVGSMQWHQTNEQSIPRHAPSAYSNSITLAHTEREQQQYMQPKLHHNLHFQQQQQQPISTTSYAVREPVGQMGTGTSSSWRSQQSQNSYYSHQENEIASASQVTSYQGNSQYMSSNPGYESWSPDNSPSRNQLNMRGQQQQASRKHDSSTHPYWNQNKRWR

SEQ ID NO: 13386 - protein, 1468 aa, Arabidopsis thaliana
  misc_feature: Ceres HVG ID no. 333
  misc_feature: Useful for making plants with modulated flowering time
MKESGKKTQQSPSVDEKYSQWKGLVPILYDWLANHNLVWPSLSCRWGPQLEQATYKNRQRLYLSEQTDGSVPNTLVIANCEVVKPRVAAAEHISQFNEEARSPFVKKYKTIIHPGEVNRIRELPQNSKIVATHTDSPDVLIWDVETQPNRHAVLGAANSRPDLILTGHQDNAEFALAMCPTEPFVLSGGKDKSVVLWSIQDHITTIGTDSKSSGSIIKQTGEGTDKNESPTVGPRGVYHGHEDTVEDVAFSPTSAQEFCSVGDDSCLILWDARTGTNPVTKVEKAHDADLHCVDWNPHDDNLILTGSADNTVRLFDRRKLTANGVGSPIYKFEGHKAAVLCVQWSPDKSSVFGSSAEDGLLNIWDYDRVSKKSDRAAKSPAGLFFQHAGHRDKVVDFHWNASDPWTIVSVSDDCETTGGGGTLQIWRMSDLIYRPEEEVVAELEKFKSHVMTCASKPMESDEAAAVSPQATTPSGGTGASGPKKRGRKPKTKEDSQTPSSQQQSDVKMKESGKKTQQSPSVDEKYSQWKGLVPILYDWLANHNLVWPSLSCRWGPQLEQATYKNRQRLYLSEQTDGSVPNTLVIANCEVVKPRVAAAEHISQFNEEARSPFVKKYKTIIHPGEVNRIRELPQNSKIVATHTDSPDVLIWDVETQPNRHAVLGAANSRPDLILTGHQDNAEFALAMCPTEPFVLSGGKDKSVVLWSIQDHITTIGTDSKSSGSIIKQTGEGTDKNESPTVGPRGVYHGHEDTVEDVAFSPTSAQEFCSVGDDSCLILWDARTGTNPVTKVEKAHDADLHCVDWNPHDDNLILTGSADNTVRLFDRRKLTANGVGSPIYKFEGHKAAVLCVQWSPDKSSVFGSSAEDGLLNIWDYDRVSKKSDRAAKSPAGLFFQHAGHRDKVVDFHWNASDPWTIVSVSDDCETTGGGGTLQIWRMSDLIYRPEEEVVAELEKFKSHVMTCASKPDEAAAVSPQATTPSGGTGASGPKKRGRKPKTKEDSQTPSSQQQSDVKMKESGKKTQQSPSVDEKYSQWKGLVPILYDWLANHNLVWPSLSCRWGPQLEQATYKNRQRLYLSEQTDGSVPNTLVIANCEVVKPRVAAAEHISQFNEEARSPFVKKYKTIIHPGEVNRIRELPQNSKIVATHTDSPDVLIWDVETQPNRHAVLGAANSRPDLILTGHQDNAEFALAMCPTEPFVLSGGKDKSVVLWSIQDHITTIGTDSKSSGSIIKQTGEGTDKNESPTVGPRGVYHGHEDTVEDVAFSPTSAQEFCSVGDDSCLILWDARTGTNPVTKVEKAHDADLHCVDWNPHDDNLILTGSADNTVRLFDRRKLTANGVGSPIYKFEGHKAAVLCVQWSPDKSSVFGSSAEDGLLNIWDYDRVSKKSDRAAKSPAGLFFQHAGHRDKVVDFHWNASDPWTIVSVSDDCETTGGGGTLQIWRMSDLIYRPEEEVVAELEKFKSHVMTCASKP

SEQ ID NO: 13387 - protein, 1173 aa, Arabidopsis thaliana
  misc_feature: Ceres HVG ID no. 340
  misc_feature: Useful for making plants with modulated biomass
MASSSSSERWIDGLQFSSLLWPPPRDPQQHKDQVVAYVEYFGQFTSEQFPDDIAELVRHQYPSTEKRLLDDVLAMFVLHHPEHGHAVILPIISCLIDGSLVYSKEAHPFASFISLVCPSSENDYSEQWALACGEILRILTHYNRPIYKTEQQNGDTERNCLSKATTSGSPTSEPKAGSPTQHERKPLRPLSPWISDILLAAPLGIRSDYFRWCSGVMGKYAAGELKPPTIASRGSGKHPQLMPSTPRWAVANGAGVILSVCDDEVARYETATLTAVAVPALLLPPPTTSLDEHLVAGLPALEPYARLFHRYYAIATPSATQRLLLGLLEAPPSWAPDALDAAVQLVELLRAAEDYASGVRLPRNWMHLHFLRAIGIAMSMRAGVAADAAAALLFRILSQPALLFPPLSQVEGVEIQHAPIGGYSSNYRKQIEVPAAEATIEATAQGIASMLCAHGPEVEWRICTIWEAAYGLIPLNSSAVDLPEIIVATPLQPPILSWNLYIPLLKVLEYLPRGSPSEACLMKIFVATVETILSRTFPPESSRELTRKARSSFTTRSATKNLAMSELRAMVHALFLESCAGVELASRLLFVVLTVCVSHEAQSSGSKRPRSEYASTTENIEANQPVSNNQTANRKSRNVKGQGPVAAFDSYVLAAVCALACEVQLYPMISGGGNFSNSAVAGTITKPVKINGSSKEYGAGIDSAISHTRRILAILEALFSLKPSSVGTPWSYSSSEIVAAAMVAAHISELFRRSKALTHALSGLMRCKWDKEIHKRASSLYNLIDVHSKVVASIVDKAEPLEAYLKNTPVQKDSVTCLNWKQENTCASTTCFDTAVTSASRTEMNPRGNHKYARHSDEGSGRPSEKGIKDFLLDASDLANFLTADRLAGFYCGTQKLLRSVLAEKPELSFSVVSLLWHKLIAAPEIQPTAESTSAQQGWRQVVDALCNVVSATPAKAAAAVVLQAERELQPWIAKDDEEGQKMWKINQRIVKVLVELMRNHDRPESLVILASASDLLLRATDGMLVDGEACTLPQLELLEATARAIQPVLAWGPSGLAVVDGLSNLLKCRLPATIRCLSHPSAHVRALSTSVLRDIMNQSSIPIKVTPKLPTTEKNGMNSPSYRFFNAASIDWKADIQNCLNWEAHSLLSTTMPTQFLDTAARELGCTISLSQ

SEQ ID NO: 13388 - protein, 297 aa, Arabidopsis thaliana
  misc_feature: Ceres HVG ID no. 342
  misc_feature: Useful for making plants with modulated flowering time
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRLMSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFAWQANSVCTRVAPELQHSRVC

SEQ ID NO: 13389 - protein, 421 aa, Arabidopsis thaliana
  misc_feature: Ceres HVG ID no. 347
  misc_feature: Useful for making plants with modulated flowering time
MSNIVVLDNGGGLIKAGQGGERDPTTVIPNCLYKPLSSKKFIHPSPLTTLSDEIDLTSAAVRRPIDRGYLINSDLQREIWSHLFTSLLHIAPSSSSLLLTEAPLSIPSVQRTTDELVFEDFGFSSLYIAHPQSLVHLYEASRQPDSILSKTQCSLVVDCGFSFTHAVPVLHNFTLNHAIKRIDLGGKAFTNYLKELVSYRSINVMDETFLVDDAKEKLCFVSLDLLRDLRLARNGNTLIKSTYVLPDGVTHTKGYVKDPQAAKRFLSLSEKESVVVMDKVGERKKADMNKNEIDLTNERFLVPETLFQPADLGMNQAGLAECIVRAINSCHSYLQPVLYQSIILTGGSTLFPQLKERLEGELRPLVPDHFDVKITTQEDPILGVWRGGSLLASSPDFESMCVTKAEYEELGSARCRRRFFH

SEQ ID NO: 13390 - protein, 1689 aa, Arabidopsis thaliana
  misc_feature: Ceres HVG ID no. 349
  misc_feature: Useful for making plants with modulated flowering time
MSSEVKQLIVVAEGTAALGPYWQTIVSDYLEKIIRSFCGSELNGERNPVSTVELSLVIFNSHGSYCACLVQRSGWTRDVDIFLHWLSSIQFGGGGFNEVATAEGLAEALMRFSRSLNLTIFSDFMTQMFSPPSGQAQPSNDLKRHCILITASNPHILPTPVYRPRLQNVERNENGDAQAESRLSDAETVASYFAKCSVSLSVVCPKQLPTIRALYNAGKPNQQSADLSIDTAKNTFYLVLISENFVEACAALSHSATNLPQTQSPVKVDRATVAPSIPVTGQPPAPVSSANGPIQNRQPVSVGPVPTATVKVEPSTVTSMAPVPSFPHIPAVARPATQAIPSIQTSSASPVSQDMVSNAENAPDIKPVVVSGMTPPLRTGPPGGANVNLLNNLSQVRQVMSSAALAGAASSVGQSAVAMHMSNMISTGMATSLPPSQTVFSTGQQGITSMAGSGALMGSAQTGQSPGPNNAFSPQTTSNVASNLGVSQPMQGMNQGSHSGAMMQGGISMNQNMMSGLGQGNVSSGTGGMMPTPGVGQQAQSGIQQLGGSNSSAPNMQLSQPSSGAMQTSQSKYVKVWEGNLSGQRQGQPVLITRLEGYRSASASDSLAANWPPTMQIVRLISQDHMNNKQYVGKADFLVFRAMSQHGFLGQLQDKKLCAVIQLPSQTLLLSVSDKACRLIGMLFPGDMVVFKPQIPNQQQQQQQQLHQQQQQQQQIQQQQQQQQHLQQQQMPQLQQQQQQHQQQQQQQHQLSQLQHHQQQQQQQQQQQQQHQLTQLQHHHQQQQQASPLNQMQQQTSPLNQMQQQTSPLNQMQQQQQPQQMVMGGQAFAQAPGRSQQGGGGGQPNMPGAGFMGMSSEVKQLIVVAEGTAALGPYWQTIVSDYLEKIIRSFCGSELNGERNPVSTVELSLVIFNSHGSYCACLVQRSGWTRDVDIFLHWLSSIQFGGGGFNEVATAEGLAEALMMFSPPSGQAQPSNDLKRHCILITASNPHILPTPVYRPRLQNVERNENGDAQAESRLSDAETVASYFAKCSVSLSVVCPKQLPTIRALYNAGKPNQQSADLSIDTAKNTFYLVLISENFVEACAALSHSATNLPQTQSPVKVDRATVAPSIPVTGQPPAPVSSANGPIQNRQPVSVGPVPTATVKVEPSTVTSMAPVPSFPHIPAVARPATQAIPSIQTSSASPVSQDMVSNAENAPDIKPVVVSGMTPPLRTGPPGGANVNLLNNLSQVRQVMSSAALAGAASSVGQSAVAMHMSNMISTGMATSLPPSQTVFSTGQQGITSMAGSGALMGSAQTGQSPGPNNAFSPQTTSNVASNLGVSQPMQGMNQGSHSGAMMQGGISMNQNMMSGLGQGNVSSGTGGMMPTPGVGQQAQSGIQQLGGSNSSAPNMQLSQPSSGAMQTSQSKYVKVWEGNLSGQRQGQPVLITRLEGYRSASASDSLAANWPPTMQIVRLISQDHMNNKQYVGKADFLVFRAMSQHGFLGQLQDKKLCAVIQLPSQTLLLSVSDKACRLIGMLFPGDMVVFKPQIPNQQQQQQQQLHQQQQQQQQIQQQQQQQQHLQQQQMPQLQQQQQQHQQQQQQQHQLSQLQHHQQQQQQQQQQQQQHQLTQLQHHHQQQQQASPLNQMQQQTSPLNQMQQQTSPLNQMQQQQQPQQMVMGGQAFAQAPGRSQQGGGGGQPNMPGAGFMG

SEQ ID NO: 13391 - protein, 175 aa, Arabidopsis thaliana
  misc_feature: Ceres HVG ID no. 350
  misc_feature: Useful for making plants with modulated flowering time
MSLSRRDPLVVGSVVGDVLDPFTRLVSLKVTYGHREVTNGLDLRPSQVLNKPIVEIGGDDFRNFYTLVMVDPDVPSPSNPHQREYLHWLVTDIPATTGNAFGNEVVCYESPRPPSGIHRIVLVLFRQLGRQTVYAPGWRQQFNTREFAEIYNLGLPVAASYFNCQRENGCGGRRT

SEQ ID NO: 13392 - protein, 110 aa, Arabidopsis thaliana
  misc_feature: Ceres HVG ID no. 351
  misc_feature: Useful for making plants with modulated flowering time
MSGVWVFKNGVIRLVENPNQSGSDTQNRRKVMVYLPTGEVVSSYSTLEQILQSLGWERYFGGGDTDLLQFHKRSSIDLISLPRDFTKFNSVYMYDIVVKNPNYFHVRDSH

SEQ ID NO: 13393 - protein, 994 aa, Arabidopsis thaliana
  misc_feature: Ceres HVG ID no. 355
  misc_feature: Useful for making plants with modulated flowering time
MGAVAINRKRSDESFNFINQQSTNPLRNSPYFQASKKRRFSFAMSEDSGKPASSNPTISRISRYPDAKAPLRREIHAPSRGILRYGKAKSNDYCEKDANFFVRKYDDAKRSALEALRFVNKGKDFVDLGDEVEKEEVVSDDSSVQAIEVIDCDDDEEKKNLQPSFSSGVTDVKKGENFRVEDTSMMLDSLSLDRDVDNDASSLEAYRKLMQSAEKRNSKLEALGFEIVLNEKKLSLLRQSRPKTVEKRVEVPREPFIPLTEDEEAEVYRAFSGRNRRKVLATHENSNIDITGEVLQCLTPSAWLNDEVINVYLELLKERETREPKKYLKCHYFNTFFYKKLVSDSGYNFKAVRRWTTQRKLGYALIDCDMIFVPIHRGVHWTLAVINNRESKLLYLDSLNGVDPMILNALAKYMGDEANEKSGKKIDANSWDMEFVEDLPQQKNGYDCGMFMLKYIDFFSRGLGLCFSQEHMPYFRLRTAKEILRLRADMEFVEDLPQQKNGYDCGMFMLKYIDFFSRGLGLCFSQEHMPYFRLRTAKEILMEFVEDLPQQKNGYDCGMFMLKYIDFFSRGLGLCFSQEHMPYFRLRTAKEILRLRADEDSGKPASSNPTISRISRYPDAKAPLRREIHAPSRGILRYGKAKSNDYCEKDANFFVRKYDDAKRSALEALRFVNKGKDFVDLGDEVEKEEVVSDDSSVQAIEVIDCDDDEEKKNLQPSFSSGVTDVKKGENFRVEDTSMMLDSLSLDRDVDNDASSLEAYRKLMQSAEKRNSKLEALGFEIVLNEKKLSLLRQSRPKTVEKRVEVPREPFIPLTEDEEAEVYRAFSGRNRRKVLATHENSNIDITGEVLQCLTPSAWLNDEVINVYLELLKERETREPKKYLKCHYFNTFFYKKLVSDSGYNFKAVRRWTTQRKLGYALIDCDMIFVPIHRGVHWTLAVINNRESKLLYLDSLNGVDPMILNALAKYMGDEANEKSGKKIDANSWDMEFVEDLPQ

SEQ ID NO: 13394 - protein, 1224 aa, Arabidopsis thaliana
  misc_feature: Ceres HVG ID no. 356
  misc_feature: Useful for making plants with modulated flowering time
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYAMASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 13395 - protein, 758 aa, Arabidopsis thaliana
  misc_feature: Ceres HVG ID no. 377
  misc_feature: Useful for making plants with modulated heat sensitivity
MIFKIEDVTVYFPYDNIYPEQYEYMVELKRALDAKGHCLLEMPTGTGKTIALLSLITSYRLSRPDSPIKLVYCTRTVHEMEKTLGELKLLHDYQVRHLGTQAKILALGLSSRKNLCVNTKVLAAENRDSVDAACRKRTASWVRALSTENPNVELCDFFENYEKAAENALLPPGVYTLEDLRAFGKNRGWCPYFLARHMIQFANVIVYSYQYLLDPKVAGFISKELQKESVVVFDEAHNIDNVCIEALSVSVRRVTLEGANRNLNKIRQEIDRFKATDAGRLRAEYNRLVEGLALRGDLSGGDQWLANPALPHDILKEAVPGNIRRAEHFVHVLRRLLQYLGVRLDTENVEKESPVSFVSSLNSQAGIEQKTLKFCYDRLQSLMLTLEITDTDEFLPIQTVCDFATLVGTYARGFSIIIEPYDERMPHIPDPILQLSCHDASLAIKPVFDRFQSVVITSGTLSPIDLYPRLLNFTPVVSRSFKMSMTRDCICPMVLTRGSDQLPVSTKFDMRSDPGVVRNYGKLLVEMVSIVPDGVVCFFVSYSYMDGIIATWNETGILKEIMQQKLVFIETQDVVETTLALDNYRRACDCGRGAVFFSVARGKVAEGIDFDRHYGRLVVMYGVPFQYTLSKILRARLEYLHDTFQIKEGDFLTFDALRQAAQCVGRVIRSKADYGMMIFADKRYSRHDKRSKLPGWILSHLRDAHLNLSTDMAIHIAREFLRKMAQPYDKAGTMGRKTLLTQEDLEKMAETGVQDMAY

SEQ ID NO: 13396 - protein, 527 aa, Oryza sativa (japonica cultivar-group)
  misc_feature: Ceres HVG ID no. 381
  misc_feature: Useful for making plants with modulated phosphate use efficiency
MAGGQLNVLSTLDQAKTQWYHFMAIVIAGMGFFTDAYDLFCISLVTKLLGRIYYTDDSKDTPGALPPNVSAAVTGVALCGTLAGQLFFGWLGDKLGRKSVYGFTLILMVVCSVASGLSFGSSAKGVVSTLCFFRFWLGFGIGGDYPLSATIMSEYANKRTRGAFIAAVFAMQGFGILFGAIVALAVSAGFRHAYPAPSYSDNHAASLVPQADYVWRIILMFGTVPAALTYYWRMKMPETARYTALIARNAKQAAADMSKVLHTQIEESADRAETVAVGGESWGLFSRQFLRRHGLHLLATTSTWFLLDIAFYSQNLFQKDIFSKVGWIPPAKTMNALEELYRIARAQALIALCGTIPGYWFTVAFIEIMGRFWIQIMGFAMMTAFMLGLAIPYHHWTTPGHHTGFIVMYGFTFFFANFGPNSTTFIVPAEIYPARLRSTCHGISAAAGKAGAIIGAFGFLYAAQDQHKPEPGYPRGIGIKNALFVLAGTNFLGTIMTLLVPESKGMSLEVISQEVADGDDEEAAYPK

SEQ ID NO: 13397 - protein, 528 aa, Oryza sativa (japonica cultivar-group)
  misc_feature: Ceres HVG ID no. 382
  misc_feature: Useful for making plants with modulated phosphate use efficiency
MAGSQLNVLVKLDQAKTQWYHFMAIVIAGMGFFTDAYDLFCIALVTKLLGRLYYTDITKPNPGTLPPNVSSAVTGVALCGTLAGQLFFGWLGDKLGRKSVYGFTLILMVVCSIASGLSFGHTPKSVIATLCFFRFWLGFGIGGDYPLSATIMSEYASKKTRGAFIAAVFAMQGFGILFGAIVALVVSAGFRHAYPAPSYAQNPAASLAPQADYTWRLILMFGTIPAGLTYYWRMKMPETARYTALVARNAKQAAADMSKVLHAEIEERPEVVESQVVAGETWGLFSRQFMKRHGMHLLATTSTWFLLDIAFYSQNLFQKDIFSKVGWIPPAKTMNALEELYRISRAQALIALCGTIPGYWFTVAFIDIVGRFWIQIMGFFMMTVFMLALGVPYDHWTHPAHHTGFVVLYALTFFFANFGPNSTTFIVPAEIFPARLRSTCHGISAASGKAGAIIGAFGFLYAAQDQHNPDAGYSRGIGIRNALFVLAGTNFLGMLMTLLVPESKGLSLEEMSKDNVVDETAQEAIAQA

SEQ ID NO: 13398 - protein, 526 aa, Oryza sativa (japonica cultivar-group)
  misc_feature: Ceres HVG ID no. 383
  misc_feature: Useful for making plants with modulated phosphate use efficiency
  misc_feature (129)..(129): Xaa is any aa, unknown, or other
  misc_feature (262)..(262): Xaa is any aa, unknown, or other
  misc_feature (269)..(269): Xaa is any aa, unknown, or other
  misc_feature (492)..(492): Xaa is any aa, unknown, or other
MADGQLKVLTTLDHARTQWYHFMAIVIAGMGFFTDAYDLFCISLVSKLLGRIYYTDLAGDNPGSLPPNVSAAVNGVALCGTLAGQLFFGWLGDKLGRKSVYGFTLVLMVVCSVASGLSFGRTAKGVVAXLCFFRFWLGFGIGGDYPLSATIMSEYANKRTRGAFIAAVFAMQGFGILFGAIVALVVSAGFRNAYPAPSYADGRAASLVPEADYVWRIILMFGTVPAALTYYWRMKMPETARYTALIARNAKQAAADMSKVLXTEIQEDXERAEAVAAGGAGNEWGLFSRQFVRRHGVHLVATTSTWFLLDIAFYSQNLFQKDIFSKVGWIPPARTMNAVEEVFRIARAQALIALCGTIPGYWFTVAFIDVAGRFAIQLMGFAMMTVFMLGLAAPYHHWTTPGNHTGFVVMYGFTFFFANFGPNATTFIVPAEIYPARLRSTCHGISAAAGKAGAIVGAFGFLYAAQDPHKPEAGYKPGIGIRNALFVLAGTXFLGMLMTLLVPESKGMSLEEVSKENVADDEEATA

SEQ ID NO: 13399 - protein, 538 aa, Oryza sativa (japonica cultivar-group)
  misc_feature: Ceres HVG ID no. 384
  misc_feature: Useful for making plants with modulated phosphate use efficiency
MAGELKVLNALDSAKTQWYHFTAIVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKSRFDAPAYRDDRTGSTVPQADYAWRIVLMFGAIPALLTYYWRMKMPETARYTALVAKNAKQAAADMTQVLNVEIVEEQEKADEVARREQFGLFSRQFLRRHGRHLLGTTVCWFVLDIAFYSSNLFQKDIYTAVQWLPKADTMSALEEMFKISRAQTLVALCGTIPGYWFTVFFIDIIGRFVIQLGGFFFMTAFMLGLAVPYHHWTTPGNHIGFVVMYAFTFFFANFGPNSTTFIVPAEIFPARLRSTCHGISAAAGKAGAIVGSFGFLYAAQSTDASKTDAGYPPGIGVRNSLFFLAGCNVIGFFFTFLVPESKGKSLEELSGENEDDDDVPEAPATADHRTAPAPPA

SEQ ID NO: 13400 - protein, 545 aa, Oryza sativa (japonica cultivar-group)
  misc_feature: Ceres HVG ID no. 385
  misc_feature: Useful for making plants with modulated phosphate use efficiency
  misc_feature (205)..(205): Xaa is any aa, unknown, or other
  misc_feature (206)..(206): Xaa is any aa, unknown, or other
MVQDRKVLDALDTAKTQWYHFTAVVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKLRFDAPAYRDDRAGXXADYAWRIVLMFGAIPALLTYYWRMKMPETARYTALVAKNDKKAAADMARVLNVELVDEQEKAAAATAAAAEEEAARREQYGLFSREFARRHGHHLLGTTVCWFVLDIAYYSQNLFQKDIYTAVQWLPKADTMSALEEMFKISRAQTLVALCGTIPGYWFTVLFIDIVGRFAIQLGGFFLMTAFMLGLAVPYHHWTTPGNHVGFVVMYAFTFFFANFGPNSTTFIVPAEIFPARLRSTCHGISSAAGKMGAIVGSFGFLYAAQSTDPSKTDAGYPRGIGVRNSLFLLAGCNVVGFLFTFLVPESKGKSLEELSGENEMEAEPAAATNSYRQTVPDSGQSE

SEQ ID NO: 13401 - protein, 541 aa, Oryza sativa (japonica cultivar-group)
  misc_feature: Ceres HVG ID no. 388
  misc_feature: Useful for making plants with modulated phosphate use efficiency
MARQEQQQHLQVLSALDAAKTQWYHFTAIVVAGMGFFTDAYDLFCISLVTKLLGRIYYTDLAKENPGSLPPNVAAAVNGVAFCGTLAGQLFFGWLGDKLGRKSVYGMTLLMMVICSIASGLSFSHTPTSVMATLCFFRFWLGFGIGGDYPLSATIMSEYANKKTRGAFIAAVFAMQGFGILAGGIVTLIISSAFRAGFPAPAYQDDRAGSTVRQADYVWRIILMLGAMPALLTYYWRMKMPETARYTALVAKNAKQAAADMSKVLQVEIQEEQDKLEQMVTRNSSSFGLFSRQFARRHGLHLVGTATTWFLLDIAFYSQNLFQKDIFTSINWIPKAKTMSALEEVFRIARAQTLIALCGTVPGYWFTVFLIDIVGRFAIQLLGFFMMTVFMLGLAVPYHHWTTKGNHIGFVVMYAFTFFFANFGPNSTTFIVPAEIFPARLRSTCHGISAAAGKAGAIIGSFGFLYAAQDPHKPDAGYKPGIGVRNSLFVLAGCNLLGFICTFLVPESKGKSLEEMSGEAEDDDDEVAAAGGGAAVRPQTA

SEQ ID NO: 13402 - protein, 541 aa, Oryza sativa (japonica cultivar-group)
  misc_feature: Ceres HVG ID no. 392
  misc_feature: Useful for making plants with modulated phosphate use efficiency
  misc_feature (63)..(63): Xaa is any aa, unknown, or other
MGRQDQQLQVLNALDAAKTQWYHFTAIIVAGMGFFTDAYDLFCISLVTKLLGRIYYTDPASPXPGSLPPNIAAAVNGVALCGTLSGQLFFGWLGDKLGRKSVYGMTLLLMVICSIASGLSFSHTPTSVMATLCFFRFWLGFGIGGDYPLSATIMSEYANKKTRGAFIAAVFAMQGFGILAGGVVTLAMSAGFQAAFPAPAYEVNAAASTVPQADYVWRIILMLGALPAILTYYWRMKMPETARYTALVAKDAKQASSDMAKVLQVEIEVEEEKLQDITRGRDYGLFSARFAKRHGAHLLGTAATWFLVDVAYYSQNLFQKDIFTSIHWIPKARTMSELEEVFRISRAQTLIALCGTVPGYWFTVFLIDIIGRFKIQLLGFAGMTAFMLGLAIPYHHWTMPGNQVIFVFLYGFTFFFANFGPNATTFIVPAEIFPARLRSTCHGISAASGKAGAIIGAFGFLYAAQPQDKAHVDAGYKPGIGVRNALFVLAGCNLVGFLMTWMLVPESKGKSLEEMSGEADDEEASANGGATAVNSSGVEMV

SEQ ID NO: 13403 - protein, 749 aa, Arabidopsis thaliana
  misc_feature: Ceres HVG ID no. 394
  misc_feature: Useful for making plants with modulated phosphate use efficiency
MAKKGKEVLNALDAAKTQMYHFTAIVIAGMGFFTDAYDLFSISLVTKLLGRIYYHVDSSKKPGTLPPNVAAAVNGVAFCGTLAGQLFFGWLGDKLGRKKVYGITLMLMVLCSLGSGLSFGHSANGVMATLCFFRFWLGFGIGGDYPLSATIMSEYANKKTRGAFIAAVFAMQGFGILAGGIVSLIVSSTFDHAFKAPTYEVDPVGSTVPQADYVWRIVLMFGAIPALLTYYWRMKMPETARYTALVARNTKQAASDMSKVLQVDLIAEEEAQSNSNSSNPNFTFGLFTREFARRHGLHLLGTTTTWFLLDIAYYSSNLFQKDIYTAIGWIPAAETMNAIHEVFTVSKAQTLIALCGTVPGYWFTVAFIDILGRFFIQLMGFIFMTIFMFALAIPYDHWRHRENRIGFLIMYSLTMFFANFGPNATTFVVPAEIFPARLRSTCHGISAASGKAGAIVGAFGFLYAAQSSDSEKTDAGYPPGIGVRNSLLMLACVNFLGIVFTLLVPESKGKSLEEISREDEEQSGGDTVVEMTVANSGRKVPVMNAIHEVFTVSKAQTLIALCGTVPGYWFTVAFIDILGRFFIQLMGFIFMTIFMFALAIPYDHWRHRENRIGFLIMYSLTMFFANFGPNATTFVVPAEIFPARLRSTCHGISAASGKAGAIVGAFGFLYAAQSSDSEKTDAGYPPGIGVRNSLLMLACVNFLGIVFTLLVPESKGKSLEEISREDEEQSGGDTVVEMTVANSGRKVPV

SEQ ID NO: 13404 - protein, 594 aa, Arabidopsis thaliana
  misc_feature: Ceres HVG ID no. 395
  misc_feature: Useful for making plants with modulated phosphate use efficiency
MAREQLQVLNALDVAKTQWYHFTAIIIAGMGFFTDAYDLFCISLVTKLLGRIYYHVEGAQKPGTLPPNVAAAVNGVAFCGTLAGQLFFGWLGDKLGRKKVYGMTLMVMVLCSIASGLSFGHEPKAVMATLCFFRFWLGFGIGGDYPLSATIMSEYANKKTRGAFVSAVFAMQGFGIMAGGIFAIIISSAFEAKFPSPAYADDALGSTIPQADLVWRIILMAGAIPAAMTYYSRSKMPETARYTALVAKDAKQAASDMSKVLQVEIEPEQQKLEEISKEKSKAFGLFSKEFMSRHGLHLLGTTSTWFLLDIAFYSQNLFQKDIFSAIGWIPPAQSMNAIQEVFKIARAQTLIALCSTVPGYWFTVAFIDVIGRFAIQMMGFFFMTVFMFALAIPYNHWTHKENRIGFVIMYSLTFFFANFGPNATTFVVPAEIFPARFRSTCHGISAASGKLGAMVGAFGFLYLAQNPDKDKTDAGYPPGIGVRNSLIVLGVVNFLGILFTFLVPESKGKSLEEMSGENEDNENSNNDSRTVPIVMTVLIHFNSVLVHRQLQRSFHFLLPLSQHFPLKIRKLKILPLSFYTLLTILKHFIRSDPT

SEQ ID NO: 13405 - protein, 1377 aa, Arabidopsis thaliana
  misc_feature: Ceres HVG ID no. 396
  misc_feature: Useful for making plants with modulated phosphate use efficiency
MTLPYRFSSVRNHSLLLKTSHLCTPRSALGCCFSPKESPFFRKNTAQFLSPQKHTSLPLKLVCPLASFSSYADSEGEEQHHADQPIQNPHESSTVSNESDGKGNAEATGDFSGMAQAFHISSTTARAISIVIAFSALTLPIFMKSLGQGLALKTKLLSYATLLFGFYMAWNIGANDVANAMGTSVGSGALTIRQAVMTAAVLEFSGALLMGTHVTSTMQKGILMANVFQGKDMLLFAGLLSSLAAAGTWLQVASYYGWPVSTTHCIVGSMVGFGLVYGGAGAVFWSSLAKVASSWVISPILGALVSFLVYKCIRRFVYSAPNPGQAAAAAAPVAVFVGVASISSAALPLSKIFPIALSQALACGVAGAIVFDRIIRKQLGHLLAKTKSPETSQNQPKTIGFLSDIAGPTGTQLEIVYGIFGYMQVLSACFMSFAHGGNDVSNAIGPLAAALSILQNGAAAGGAEIVIPMDVLAWGGFGIVAGLTMWGYRVIATIGKKITELTPTRGFAAEFAAASVVLFASKLGLPISATHTLVGAVMGVGFARGLNSVRAETVREIVASWLVTIPVGATLAVIYTWIFTKILSFVLMQIHFHHHQYHHQLHSHHPWPISHLYMTLPYRFSSVRNHSLLLKTSHLCTPRSALGCCFSPKESPFFRKNTAQFLSPQKHTSLPLKLVCPLASFSSYADSEGEEQHHADQPIQNPHESSTVSNESDGKGNAEATGDFSGMAQAFHISSTTARAISIVIAFSALTLPIFMKSLGQGLALKTKLLSYATLLFGFYMAWNIGANDVANAMGTSVGSGALTIRQAVMTAAVLEFSGALLMGTHVTSTMQKGILMANVFQGKDMLLFAGLLSSLAAAGTWLQVASYYGWPVSTTHCIVGSMVGFGLVYGGAGAVFWSSLAKVASSWVISPILGALVSFLVYKCIRRFVYSAPNPGQAAAAAAPVAVFVGVASISSAALPLSKIFPIALSQALACGVAGAIVFDRIIRKQLGHLLAKTKSPETSQNQPKTIGFLSDIAGPTGTQLEIVYGIFGYMQVLSACFMSFAHGGNDVSNAIGPLAAALSILQNGAAAGGAEIVIPMDVLAWGGFGIVAGLTMWGYRVIATIGKKITELTPTRGFAAEFAAASVVLFASKLGLPISATHTLVGAVMGVGFARGLNSVRAETVREIVASWLVTIPVGATLAVIYTWIFTKILSFVLMTLPYRFSSVRNHSLLLKTSHLCTPRSALGCCFSPKESPFFRKNTAQFLSPQKHTSLPLKLVCPLASFSSYADSEGEEQHHADQPIQNPHESSTVSNESDGKGNAEATGDFSGMAQAFHISSTTARAISIVIAFSALTLPIFMKSLGQGLALKTKLLSYATLLFGFYMAWNIGANDV

SEQ ID NO: 13406 - protein, 516 aa, Arabidopsis thaliana
  misc_feature: Ceres HVG ID no. 397
  misc_feature: Useful for making plants with modulated carbohydrate content
  misc_feature: Useful for making plants with modulated phosphate use efficiency
MANEEQGSILKALDVAKTQWYHVTAVVVSGMGFFTDSYDLFVISLITKLLGRIYYQVPGSSSPGSLPDGISAAVSGVAFAGTFIGQIFFGCLGDKLGRKRVYGLTLLIMTICSICSGLSLGRDPKTVMVTLCFFRFWLGFGIGGDYPLSATIMSEYSNKRTRGAFIAAVFGMQGIGILAAGAVSLLVSAVFESKFPSRAYILDGAASTVPQADYVWRIILMVGALPALLTYYWRMKMPETARYTALVSKNAEQAALDMTKVLNVDIEASAAKNDQARVSSDEFGLFSMKFLRRHGLHLLGTASTWFLLDIAFYSQNLFQKDIFTTIGWLPSAKTMNAIQELYMIAKAQTIIACCSTVPGYFFTVGFIDYMGRKKIQIMGFAMMTIFMLSLAIPYHHWTLPANRIGFVVLYSFTFFFSNFGPNATTFIVPAEIFPARIRSTCHGISAASGKAGAMVGSFGFSALVKALGMSNTLYIMAGINLLGLLLTFTIPETNGKSLEELSGETEPEKIKEKIVV

SEQ ID NO: 13407 - protein, 524 aa, Arabidopsis thaliana
  misc_feature: Ceres HVG ID no. 398
  misc_feature: Useful for making plants with modulated carbohydrate content
  misc_feature: Useful for making plants with modulated phosphate use efficiency
MAEQQLGVLKALDVAKTQLYHFTAIVIAGMGFFTDAYDLFCVSLVTKLLGRIYYFNPESAKPGSLPPHVAAAVNGVALCGTLSGQLFFGWLGDKLGRKKVYGLTLVMMILCSVASGLSFGHEAKGVMTTLCFFRFWLGFGIGGDYPLSATIMSEYANKKTRGAFIAAVFAMQGVGILAGGFVALAVSSIFDKKFPAPTYAVNRALSTPPQVDYIWRIIVMFGALPAALTYYWRMKMPETARYTALVAKNIKQATADMSKVLQTDIELEERVEDDVKDPKQNYGLFSKEFLRRHGLHLLGTTSTWFLLDIAFYSQNLFQKDIFSAIGWIPKAATMNATHEVFRIARAQTLIALCSTVPGYWFTVAFIDTIGRFKIQLNGFFMMTVFMFAIAFPYNHWIKPENRIGFVVMYSLTFFFANFGPNATTFIVPAEIFPARLRSTCHGISAAAGKAGAIVGAFGFLYAAQSQDKAKVDAGYPPGIGVKNSLIMLGVLNFIGMLFTFLVPEPKGKSLEELSGEAEVSHDEK

SEQ ID NO: 13408 - protein, 521 aa, Arabidopsis thaliana
  misc_feature: Ceres HVG ID no. 399
  misc_feature: Useful for making plants with modulated carbohydrate content
  misc_feature: Useful for making plants with modulated phosphate use efficiency
MADQQLGVLKALDVAKTQLYHFTAIVIAGMGFFTDAYDLFCVSLVTKLLGRLYYFNPTSAKPGSLPPHVAAAVNGVALCGTLAGQLFFGWLGDKLGRKKVYGITLIMMILCSVASGLSLGNSAKGVMTTLCFFRFWLGFGIGGDYPLSATIMSEYANKKTRGAFIAAVFAMQGVGILAGGFVALAVSSIFDKKFPSPTYEQDRFLSTPPQADYIWRIIVMFGALPAALTYYWRMKMPETARYTALVAKNIKQATADMSKVLQTDLELEERVEDDVKDPKKNYGLFSKEFLRRHGLHLLGTTSTWFLLDIAFYSQNLFQKDIFSAIGWIPKAATMNAIHEVFKIARAQTLIALCSTVPGYWFTVAFIDIIGRFAIQLMGFFMMTVFMFAIAFPYNHWILPDNRIGFVVMYSLTFFFANFGPNATTFIVPAEIFPARLRSTCHGISAATGKAGAIVGAFGFLYAAQPQDKTKTDAGYPPGIGVKNSLIMLGVINFVGMLFTFLVPEPKGKSLEELSGEAEVDK

SEQ ID NO: 13409 - protein, 554 aa, Oryza sativa (indica cultivar-group)
  misc_feature: Ceres HVG ID no. 402
  misc_feature: Useful for making plants with modulated salt sensitivity
MSSLDATTPRYDEFKRIYHLFLFHAHPFWLQLLYFLFISLLGFLMLKALPMKTSMVPRPMDLDLIFTSVSATTVSSMVAVEMESFSNSQLLLITLLMLLGGEVFTSILGLYFTNAKYSSKMIATLPDDDDHGGSGKPPPATTSPSSTLVELELAPPMDVVVVNPTTTATTHDEVELGLGRRNKHGCTCTTTHTSSSSSASKTTTTRLLMFVVMGYHAVVHVAGYTAIVVYLSAVGGAGAVVAGKGISAHTFAIFTVVSTFANCGFVPTNEGMVSFRSFPGLLLLVMPHVLLGNTLFPVFLRLAIAALERVTGWPELGELLIRRRRGGGEGYDHLLPSSRTRFLALTVAVLVVAQLALFCAMEWGSDGLRGLTAGQKLVGALFMAVNSRHSGEMVVDLSTVSSAVVVLYVVMMYLPPYTTFVPVQDKHQQTGAQSGQEGSSSSSIWQKLLMSPLSCLAIFIVVICITERRQIADDPINYSVLNIVVEVISAYGNVGFSTGYSCARQVRPDGSCRDLWVGFSGKWSKQGKLTLMAVMFYGRLKKFSLHGGQAWKIE

SEQ ID NO: 13410 - protein, 932 aa, Arabidopsis thaliana
  misc_feature: Ceres HVG ID no. 408
  misc_feature: Useful for making plants with modulated cold sensitivity
  misc_feature: Useful for making plants with modulated heat sensitivity
MADTVEKVPTVVESSSSSTVEASNSAEKTEPTTEKKKWGDVEDDDDEEEAVSELNSLSIKEEEKPDSILEEPEDSNIKAVTSGDTPYTSASRFEDLNLSPELMKGLYVEMKFEKPSKIQAISLPMIMTPPHKHLIAQAHNGSGKTTCFVLGMLSRVDPTLREPQALCICPTRELANQNMEVLQKMGKFTGITAELAVPDSTRGAPAATRGAPVSAHVVIGTPGTLKKWMAFKRLGLNHLKILVFDEADHMLATDGFRDDSLKIMKDIGRVNPNFQVLLFSATFNETVKDFVARTVKDPNQLFVKREDLALDSVKQYKVVCPKEQNKIEVIKDQIMELGDIGQTIIFVKTKASAQKVHKALAEMGYDVTSVHGNLTESDRDKIVKEFKECLTQVLIATDVIARGFDQQRVNLVVNYNLPTKYETGEPDYEVYLHRVGRAGRFGRKGAVFNLLLDDGWDKEVMEKIEKYFEANVKEIKSWNSEEEYKSALKEAGLLDEEEEKPDSILEEPEDSNIKAVTSGDTPYTSASRFEDLNLSPELMKGLYVEMKFEKPSKIQAISLPMIMTPPHKHLIAQAHNGSGKTTCFVLGMLSRVDPTLREPQALCICPTRELANQNMEVLQKMGKFTGITAELAVPDSTRGAPAATRGAPVSAHVVIGTPGTLKKWMAFKRLGLNHLKILVFDEADHMLATDGFRDDSLKIMKDIGRVNPNFQVLLFSATFNETVKDFVARTVKDPNQLFVKREDLALDSVKQYKVVCPKEQNKIEVIKDQIMELGDIGQTIIFVKTKASAQKVHKALAEMGYDVTSVHGNLTESDRDKIVKEFKECLTQVLIATDVIARGFDQQRVNLVVNYNLPTKYETGEPDYEVYLHRVGRAGRFGRKGAVFNLLLDDGWDKEVMEKIEKYFEANVKEIKSWNSEEEYKSALKEAGLLDE

SEQ ID NO: 13411 - protein, 184 aa, Sorghum bicolor
  misc_feature: Ceres HVG ID no. 419
  misc_feature: Useful for making plants with modulated biomass
MDAAGQIKLQQQHQPPCSDNNFSLLAAAADSSSWPPPQVRSPPSSSSSSSYTCGYCKKEFRSAQGLGGHMNVHRLDRARLIHQQYMSSSSHRTAPPPSNPNPSCAVLDLGLSLSSLLARGGGDGGGLPVPLEKQLGDRFSSASSAAATNDYYSEVKNLELRMGACSHGGDGTEERLDLQLRLGY

SEQ ID NO: 13412 - protein, 405 aa, Zea mays
  misc_feature: Ceres HVG ID no. 420
  misc_feature: Useful for making plants with modulated endosperm cell number
  misc_feature: Useful for making plants with modulated endosperm size
MERVFSVEEIPNPYWVPPHPQSAAAGAVAAPAGEAAGLMNRCPSEWYFQKFLEEAVLDSPVPVAGVSRGSVGAGVEAAERKTPGTAAAAAASSSVVDPVEYNAIVKQKLEKDLAAVALWRASGAAPPDNSPAGSSLPSVDVPHAGPLKPMGGTGSLVQNKLAGAPGGGSSPHVVQNADIPVKQTTSSSSREQSDDDDMEGDAETTGNGNPVQQRLQRRKQSNRESARRSRSRKAAHLNELEAQVAQLRVENSSLLRRLADVNQKFNEAAVDNRVLKADVETLRAKVKMAEDSVKRVTGMNTLFPAVSDMSSLSMPFNGSPSDSASDAAVPIQDDLNSYFANPSEIGGSNGYMPDIASSAQEDDDFVNGAQVAGKMGSTDSLQRVASLEHLQKRMCGGPASSGSTS

SEQ ID NO: 13413 - protein, 113 aa, Oryza sativa (indica cultivar-group)
  misc_feature: Ceres HVG ID no. 459
  misc_feature: Useful for making plants with modulated biotic stress sensitivity
MADWAMHHYLLLANQQRHRALADVAVRRRQLLLDSGRVFMLLGAVILMHMLTTTGGGASSGCTRGAEPCVALLLWLLGAALAMLSLVAGRFPVLAAAIAEELGDHLLGGLWSL

SEQ ID NO: 13414 - protein, 433 aa, Zea mays
  misc_feature: Ceres HVG ID no. 484
  misc_feature: Useful for making plants with modulated biomass
MVLDLNVASPADSGTSSSSVLNSADGGFRFGLLGSPVDDDDCSGEMAPGASTGFMTRQLFPSPTPPAEPEPEPVAAPVPVWQPQRAEDLGMAQKPVAPAKNTRRGPRSRSSQYRGVTFYRRTGRWESHIWDCGKQVYLGGFDTAHAAARAYDRAAIKFRGLDADINFSLSDYEDDLKQMRNWTKEEFVHILRRQSTGFARGSSKYRGVTLHKCGRWEARMGQLLGKKYIYLGLFDSEVEAARAYDRAALRFNGREAVTNFEPSSYNAGDNNLRDTETEAIDDGDAIDLDLRISQPNVQDPKRDNTLAGLQPTCDSPESSNTMASQPMSSSSPWPGYHQNPAVSFHHQRLYSSACHGFFPNHQVQERPVERRPELGAQPFPSWAWQAQGSPHVPLHHSAASSGFSTAAGANGGMPLPSHPPAQFPTTTNPFFFP

SEQ ID NO: 13415 - protein, 313 aa, Zea mays
  misc_feature: Ceres HVG ID no. 485
  misc_feature: Useful for making plants with modulated biomass
MNTRACGSSGSGGRNDQTMMGFSEHPKPAASGQAQPSPPSSPSERPPAGRGRRRAQEPGRFLGVRRRPWGRYAAEIRDPTTKERHWLGTFDTAQEAALAYDRAALSMKGAQARTNFVYTHAAYNYPPFLAPFHHPSSVQQQHYGAAPHVGSYGHHHYHHQGSAAAVGASSGECSSTMATAVPPVERADGTLLLDRGGGGHHHHPEFLFASADDNSGYLSSVVPESCLRPRSSAAAVEDLRRYSDADAYGMGVGLREDVDDLAQMVAGFWGGGAGDADQLCGGGFPSGGAGDSMAVASSQGSSDGYSPFSFLSH

SEQ ID NO: 13416 - protein, 531 aa, Zea mays
  misc_feature: Ceres HVG ID no. 486
  misc_feature: Useful for making plants with modulated biomass
MVQGEESSWRMERAALPLNQALAYGVQAHAAAAAAPPTCFLDFQPAAASAAYFGFGELEEALIHGGGAASAGGGVDPGVIIKNDVAQAKSAAGYLAGAGTGRPPTLEIFPSWPMRHQQQLHSGNSQSVGSTGTDSSSAQNTMSQMELVSPASSAPRQEVMMVTTDDYSYKPGLAAAPAAAAPPSFQQHHPLPLQLHGGEGGGDHDKRKHGSTRKDGKLVDAKTERRLAQNREAARKSRLRKKAYVQQLETSRIRLQQVEHELQRARSQGLFVGGCSAAGDMSSGAAMFDMEYARWLDDDTKRLAELRGGLQAHLLDGNLGLIVEECMQHYDELFQLKAALARSDVFHLLTGSWATPAERCFFWMGGFRPSELLKILIPQLDPLTEQQLLGICNLQQSSEQAEEALAQGLHQLHQSLADTVAAGTLNDGAAAPNYMNIMAVALEKLASLENFYQQADNLRHQTLHQMRRILTTRQAARCFLSIGEYYSRLRALSNLWASRPRDNFIGTESLSPTATELQALHHQQQNQFAGF

SEQ ID NO: 13417 - protein, 491 aa, Hordeum vulgare subsp. vulgare
  misc_feature: Ceres HVG ID no. 524
  misc_feature: Useful for making plants with modulated biotic stress sensitivity
MAGGGGKAKPLEFTPTWIVALVCSVMVIISLLFERLLHRLGKRLIRSRKKPLYEALLKVKEELMLLGFISLLLTVFQGPMGKVCVSPITMLHLQPCKPPPDETDHLGDAVFAGVLGGGRRLLAGGASSDEYCLKKDKVPLLSSEAIHQLHIFIFVLAVTHFLLSAITVLLGMAQTRNWRHWETKIQEKDDSAPQMIKHVREFKFIQDHFKDHRKRSRIFAWMRSFFKQFYGSITEEDYTTMRLGFIMKHCKGTPKFNFYSYMIRALEVDFKKVVGISWYLWAMLMIFLLLNVEGWYVYIWITLVPFIMLLVVASKMEHIITELAYEVAHKHTAIRGDLVVAPSDDFFWFHRPKLVLLLIHIVLFQNAFQIAFFFWLLVTYGFKSCIMGKPAYVITRVVISVICQILCGYSTLPLYAIVSHMGNSFKKTIFDENVTEGLVNWAEKARRGTRTPNKITTDASSSPIDEANGGIVQMTNTRANSSVDQGTARLI

SEQ ID NO: 13418 - protein, 296 aa, Arabidopsis thaliana
  misc_feature: Ceres HVG ID no. 56
  misc_feature: Useful for making plants with modulated drought sensitivity
  misc_feature (106)..(106): Xaa is any aa, unknown, or other
  misc_feature (282)..(282): Xaa is any aa, unknown, or other
MKNGQCAQELQSSTQASHDSQGDQKTNLSIDAPIQDSGSVSASSNDSRKVSRQDIELVQNLIERCLQLYMNRDEVVKTLLTRARIDPGFTTLVWQKLEEENADFFXAYYIRLKLKKQIILFNHLLEHQYHLMKYPPGPPKVPLAPIQNGMHPMAPVNMPMGYPVLQHPQMHVPGHPHHLDAMGVSSCHVVNGVPAPANFHPLRMNTANDMVIDTTANDATPQVIPPNSGAMPEMVASPASVASSGHFPFAASDMSGMVMDTSVLDSAFTSDVGPDGEGAGNXRDSLRSFDQIPWKL

SEQ ID NO: 13419 - protein, 88 aa, Arabidopsis thaliana
  misc_feature: Ceres HVG ID no. 57
  misc_feature: Useful for making plants with modulated drought sensitivity
MTTIAAAGLNVATPRVVVRPVARVLGPVRLNYPWKFGSMKRMVVVKATSEGEISEKVEKSIAMIILRLMSVVLMIIKKYVFDVRIMKL

SEQ ID NO: 13420 - protein, 714 aa, Arabidopsis thaliana
  misc_feature: Ceres HVG ID no. 575
  misc_feature: Useful for making plants with modulated asexual embryo production
MASMNNWLGFSLSHQELPSSQSDHHQDHSQNTDSRLGFHSDEISGTNVSGECFDLTSDSTAPSLNLPATFGILEAFRNNQPQDWNMKSLGMNPDTNYKTASGLPIFMGTSCNSQTIDQNQEPKLENFLGGHSFGNHEHKLNGCNTMYDTTGDYVFQNCSLQLPSEATSNERTSNNGGGDNKNSSIGLSMIKTWLRNQPAPTQQDTNNKNNGGAQSLSLSMSTGSQSAASALPLLAVNGGVNNTGGDQSSSDNNKQQKSTTPSLDSQTGAVESVPRKSIDTFGQRTSIYRGVTRHRWTGRYEAHLWDNSCRREGQTRKGRQGGYDKEEKAARAYDLAALKYWGTTTTTNFPITNYEKEIEEMKHMTRQEYVASLRRKSSGFSRGASIYRGVTRYHGRWQARIGRVAGNKDLYLGTFSTQEEAAEAYDIAAIKFRGLNAVTNFDMSRYDVNSILESSTLPIGGAAKRLKEAEHAEIAMDIAQRTDDHDNMGSQLTDGISSYGAVQHGWPTVAFQQAQPFSMHYPYGQRLWCKQEQDSDNRSFQELHQLQLGNTHNFFQPSVLHNLVSMDSSSMEHSSGSNSVVYSSGVNDGTSTGTNGGYQGIGYGSSAGYAVPMATVISNNDNNHNQGNGYGDGDQVKALGYENMFSPSDPYHARNLHYLSQQPSAGGIKASAYDQGSACYNWVPTAVPTIAAARSNNMAVCHGAQPFTVWNDGT

SEQ ID NO: 13421 - protein, 205 aa, Arabidopsis thaliana
  misc_feature: Ceres HVG ID no. 58
  misc_feature: Useful for making plants with modulated drought sensitivity
  misc_feature: Useful for making plants with modulated water use efficiency
MLTEEELKRLYRIQKTLMQMLRDRGYFIADSELTMTKQQFIRKHGDNMKREDLVTLKAKRNDNSDQLYIFFPDEAKVGVKTMKMYTNRMKSENVFRAILVVQQNLTPFARTCISEISSKFHLEVFQEAEMLVNIKEHVLVPEHQVLTTEEKKTLLERYTVKETQLPRIQVTDPIARYFGLKRGQVVKIIRPSETAGRYVTYRYVV

SEQ ID NO: 13422 - protein, 298 aa, Oryza sativa
  misc_feature: Ceres HVG ID no. 588
  misc_feature: Useful for making plants with modulated silicon content
MASNNSRTNSRANYSNEIHDLSTVQNGTMPTMYYGEKAIADFFPPHLLKKVVSEVVATFLLVFMTCGAAGISGSDLSRISQLGQSIAGGLIVTVMIYAVGHISGAHMNPAVTLAFAVFRHFPWIQVPFYWAAQFTGAICASFVLKAVIHPVDVIGTTTPVGPHWHSLVVEVIVTFNMMFVTLAVATDTRAVGELAGLAVGSAVCITSIFAGAISGGSMNPARTLGPALASNKFDGLWIYFLGPVMGTLSGAWTYTFIRFEDTPKEGSSQKLSSFKLRRLRSQQSIAADDVDEMENIQV

SEQ ID NO: 13423 - protein, 72 aa, Arabidopsis thaliana
  misc_feature: Ceres HVG ID no. 59
  misc_feature: Useful for making plants with modulated drought sensitivity
MSGLQAQDSACSLDKPSKDVVATATKPKKRICCACPDTKKLRDECIVEHGESACTKWIEAHILCLRSESFKV

SEQ ID NO: 13424 - protein, 361 aa, Zea mays
  misc_feature: Ceres HVG ID no. 592
  misc_feature: Useful for making plants with modulated drought sensitivity
MTKHAAYSSEDVVAAVAAPAPAGRHFTSFQALKGAPLDCKKHAAVDLSASGAAVVGGGPWFESMKASSPRRAADAEHGDWMEKHPSALAQFEPLLAAAKGKQIVMFLDYDGTLSPIVEDPDRAVMSEEMREAVRRVAEHFPTAIVSGRCRDKVLNFVKLTELYYAGSHGMDIQGPAACRQPNHVQQAEAAAVHYQAASEFLPVIEEVFRTLTAKMESIAGARVEHNKYCLSVHFRCVREEEWNAVNEEVRSVLREYPNLKLTHGRKVLEIRPSIKWDKGKALEFLLKSLGYAGRNDVFPIYIGDDRTDEDAFKVLRNMGQGIGILVSKLPKETAASYSLSDPAEVKEFLRKLANKKGARQP

SEQ ID NO: 13425 - protein, 618 aa, Arabidopsis thaliana
  misc_feature: Ceres HVG ID no. 595
  misc_feature: Useful for making plants with modulated biomass
MSLPIPPKFLPPLKSPPIHHHQTPPPLAPPRAAISISIPDTGLGRTGTILDESTSSAFRDYQSLFVSQRSETIEPVVIKPIEGSIPVNFPSGTYYLAGPGLFTDDHGSTVHPLDGHGYLRAFHIDGNKRKATFTAKYVKTEAKKEEHDPVTDTWRFTHRGPFSVLKGGKRFGNTKVMKNVANTSVLKWAGRLLCLWEGGEPYEIESGSLDTVGRFNVENNGCESCDDDDSSDRDLSGHDIWDTAADLLKPILQGVFKMPPKRFLSHYKVDGRRKRLLTVTCNAEDMLLPRSNFTFCEYDSEFKLIQTKEFKIDDHMMIHDWAFTDTHYILFANRVKLNPIGSIAAMCGMSPMVSALSLNPSNESSPIYILPRFSDKYSRGGRDWRVPVEVSSQLWLIHSGNAYETREDNGDLKIQIQASACSYRWFDFQKMFGYDWQSNKLDPSVMNLNRGDDKLLPHLVKVSMTLDSTGNCNSCDVEPLNGWNKPSDFPVINSSWSGKKNKYMYSAASSGTRSELPHFPFDMVVKFDLDSNLVRTWSTGARRFVGEPMFVPKNSVEEGEEEDDGYIVVVEYAVSVERCYLVILDAKKIGESDAVVSRLEVPRNLTFPMGFHGLWASD

SEQ ID NO: 13426 - protein, 341 aa, Arabidopsis thaliana
  misc_feature: Ceres HVG ID no. 598
  misc_feature: Useful for making plants with modulated flowering time
  misc_feature: The sequence is a functional homolog of SEQ ID NO 11 in US patent 7045682
MPRPFFHKLIFSSTIQEKRLRVPDKFVSKFKDELSVAVALTVPDGHVWRVGLRKADNKIWFQDGWQEFVDRYSIRIGYLLIFRYEGNSAFSVYIFNLSHSEINYHSTGLMDSAHNHFKRARLFEDLEDEDAEVIFPSSVYPSPLPESTVPANKGYASSAIQTLFTGPVKAEEPTPTPKIPKKRGRKKKNADPEEINSSAPRDDDPENRSKFYESASARKRTVTAEERERAINAAKTFEPTNPFFRVVLRPSYLYRGCIMYLPSGFAEKYLSGISGFIKVQLAEKQWPVRCLYKAGRAKFSQGWYEFTLENNLGEGDVCVFELLRTRDFVLKVTAFRVNEYV

SEQ ID NO: 13427 - protein, 146 aa, Arabidopsis thaliana
  misc_feature: Ceres HVG ID no. 66
  misc_feature: Useful for making plants with high aluminum sensitivity
  misc_feature: Useful for making plants with modulated high pH sensitivity
  misc_feature: Useful for making plants with modulated low iron sensitivity
  misc_feature: Useful for making plants with modulated phosphate use efficiency
MNLQAVSCSFGFLSSPLGVTPRTSFRRFVIRAKTEPSEKSVEIMRKFSEQYARRSGTYFCVDKGVTSVVIKGLAEHKDSYGAPLCPCRHYDDKAAEVGQGFWNCPCVPMRERKECHCMLFLTPDNDFAGKDQTITSDEIKETTANM

SEQ ID NO: 13428 - protein, 265 aa, Arabidopsis thaliana
  misc_feature: Ceres HVG ID no. 660
  misc_feature: Useful for making plants with altered cell wall content and/or composition
  misc_feature: Useful for making plants with altered lignin content
MADGSTSSSESTTACAGSGTRREIMLFGVRVVLDPMRKCVSLNNLSDYEQTAETPKIDGEDRDEQDMNKTPAGYASADEALPMSSSNGKIERKRGVPWTEEEHKLFLLGLQRVGKGDWKGISRNFVKTRTSTQVASHAQKYFLRRSNLNRRRRRSSLFDMTTDTVIPMEEDHQVLIQENTSQSSSPVPEINNFSIHPVMQVFPEFPVPTGNQSYGQLTSSNLINLVPLTFQSSPAPLSLNLSLASSNLNEPSPSMHPAFNTIGVA

SEQ ID NO: 13429 - protein, 305 aa, Arabidopsis thaliana
  misc_feature: Ceres HVG ID no. 67
  misc_feature: Useful for making plants with modulated high pH sensitivity
  misc_feature: Useful for making plants with modulated seed number
MMNVAVTATPSSLLYSPLLLPSQGPNRRMQWKRNGKRRLGTKVAVSGVITAGFELKPPPYPLDALEPHMSRETLDYHWGKHHKTYVENLNKQILGTDLDALSLEEVVLLSYNKGNMLPAFNNAAQAWNHEFFWESIQPGGGGKPTGELLRLIERDFGSFEEFLERFKSAAASNFGSGWTWLAYKANRLDVANAVNPLPKEEDKKLVIVKTPNAVNPLVWDYSPLLTIDTWEHAYYLDFENRRAEYINTFMEKLVSWETVSTRLESAIARAVQREQEGTETEDEENPDDEVPEVYLDSDIDVSEVD

SEQ ID NO: 13430 - protein, 2326 aa, Zea mays
  misc_feature: Ceres HVG ID no. 691
  misc_feature: Described in US Patent 6,069,298
  misc_feature: Useful for making plants with altered oil content
  misc_feature: Useful for making plants with modulated herbicide sensitivity
  misc_feature (2029)..(2029): Xaa is any aa, unknown, or other
MSQLGLAAAASKALPLLPNRQRSSAGTTFSSSSLSRPLNRRKSHTRSLRDGGDGVSDAKKHSQSVRQGLAGIIDLPSEAPSEVDISHGSEDPRGPTDSYQMNGIINETHNGRHASVSKVVEFCAALGGKTPIHSILVANNGMAAAKFMRSVRTWANDTFGSEKAIQLIAMATPEDMRINAEHIRIADQFVEVPGGTNNNNYANVQLIVGMAQKLGVSAVWPGWGHASENPELPDALTAKGIVFLGPPASSMNALGDKVGSALIAQAAGVPTLAWSGSHVEVPLECCLDAIPEEMYRKACVTTTEEAVASCQVVGYPAMIKASWGGGGKGIRKVHNDDEVRALFKQVQGEVPGSPIFVMRLASQSRHLEVQLLCDQYGNVAALHSRDCSVQRRHQKIIEEGPVTVAPRETVKALEQAARRLAKAVGYVGAATVEYLYSMETGDYYFLELNPRLQVEHPVTEWIAEVNLPAAQVAVGMGIPLWQIPEIRRFYGMDYGGGYDIWRKTAALATPFNFDEVDSQWPKGHCVAVRITSEDPDDGFKPTGGKVKEISFKSKPNVWAYFSVKSGGGIHEFADSQFGHAFAYGLSRPAAITNMSLALKEIQIRGEIHSNVDYTVDLLNASDFRENKIHTGWLDTRIAMRVQAERPPWYISVVGGALYKTVTTNAATVSEYVSYLTKGHIPPKHISLVNSTVNLNIEGSKYTIETVRTGHGSYRLRMNDSTVEANVQSLCDGGLLMQLDGNSHVIYAEEEAGGTRLQIDGKTCLLQNDHDPSKLLAETPCKLLRFLVADGAHVDADVPYAEVEVMKMCMPLLSPASGVIHCMMSEGQALQAGDLIARLDLDDPSAVKRAEPFDGIFPQMELPVAVSSQVHKRYAASLNAARMVLAGYEHNINEVVQDLVCCLDNPELPFLQWDELMSVLATRLPRNLKSELEDKYKEYKLNFYHGKNEDFPSKLLRDIIEENLSYGSEKEKATNERLVEPLMNLLKSYEGGRESHAHFVVKSLFEEYLTVEELFSDGIQSDVIETLRHQHSKDLQKVVDIVLSHQGVRNKAKLVTALMEKLVYPNPGGYRDLLVRFSSLNHKRYYKLALKASELLEQTKLSELRASVARSLSDLGMHKGEMSIKDNMEDLVSAPLPVEDALISLFDYSDRTVQQKVIETYISRLYQPHLVKDSIQMKFKESGAITFWEFYEGHVDTRNGHGAIIGGKRWGAMVVLKSLESASTAIVAALKDSAQFNSSEGNMMHIALLSAENESNISGISSDDQAQHKMEKLSKILKDTSVASDLQAAGLKVISCIVQRDEARMPMRHTFLWLDDKSCYEEEQILRHVEPPLSTLLELDKLKVKGYNEMKYTPSRDRQWHIYTLRNTENPKMLHRVFFRTIVRQPNAGNKFRSAQISDAEVGCPEESLSFTSNSILRSLMTAIEELELHAIRTGHSHMYLCILKEQKLLDLIPFSGSTIVDVGQDEATACSLLKSMALKIHELVGARMHHLSVCQWEVKLKLDCDGPASGTWRVVTTNVTGHTCTIDIYREVEEIESQKLVYHSASSSAGPLHGVALNNPYQPLSVIDLKRCSARNNRTTYCYDFPLAFETALQKSWQSNGSTVSEGNENSKSYVKATELVFAEKHGSWGTPIIPMERPAGLNDIGMVAWIMEMSTPEFPNGRQIIVVANDITFRAGSFGPREDAFFETVTNLACERKLPLIYLAANSGARIGIADEVKSCFRVGWSDEGSPERGFQYIYLTEEDYARISSSVIAHKLELDSGEIRWIIDSVVGKEDGLGVENIHGSAAIASAYSRAYEETFTLTFVTGRTVGIGAYLARLGIRCIQRLDQPIILTGFSALNKLLGREVYSSHMQLGGPKIMATNGVVHLTVPDVLEGVSNILRWLSYVPANIGGPLPITKPLDPPDRPVAYIPENTCDPRAAICGVDDSQGKWLGGMFDKDSFVETFEGWAKTVVTGRAKLGGIPVGVIAVETQTMMQIIPADPGQLDSHERSVPRAGQVWFPDSATKTAQALLDFNREGLPLFILAXNWRGFSGGQRDLFEGILQAGSTIVENLRTYNQPAFVYIPMAGELRGGAWVVVDSKINPDRIECYAERTAKGNVLEPQGLIEIKFRSEELQDCMGRLDPELINLKAKLQDVNHGNGSLPDIEGIRKSIEARTKQLLPLYTQIAIRFAELHDTSLRMAAKGVIKKVVDWEESRSFFYKRLRRRIAEDVLAKEIRQIVGDKFTHQLAMELIKEWYLASQATTGSTGWDDDDAFVAWKDSPENYKGHIQKLRAQKVSHSLSDLADSSSDLQAFSQGLSTLLDKMDPSQRAKFVQEVKKVLD

SEQ ID NO: 13431 - protein, 34 aa, Arabidopsis thaliana
  misc_feature: Ceres HVG ID no. 750
  misc_feature: Useful for making plants with modulated light quality response
MKMDKKTIVWFRRDLRIEDNPALAAAAHEGSVFP

SEQ ID NO: 13432 - protein, 606 aa, Arabidopsis thaliana
  misc_feature: Ceres HVG ID no. 816
  misc_feature: Useful for making plants with modulated heat sensitivity
MAAYYRWKSFEENEDRPEKPRRYGVTEMRGPHYSVLSQNLLQEIFESMGQFVDGLKFSGGSNSLIPKSFIKQAIEMAHEHGVYVSTGDWAEHMLRSGPSAFKDYVEECKQLGFDTIELNANLLEVPEETLLRYVRLIKNGGLRAKPMFAVKFNKSDIPGRNRAFGSYVVPEPRSSEFVEDIDLLIRKAERCLEAGADTIMIDADDVCKYADSLRADIIAKVIGRLGIEKTMFEASDAKLVEWFIKRYGPNVFADTLVLSIIFNLLFEWSPSQDSYLFVLVFQVNLYVDHSQIMDLECLRGRHLECKCFENNVICDFSVITMAAYYRWKSFEENEDRPEKPRRYGVTEMRGPHYSVLSQNLLQEIFESMGQFVDGLKFSGGSNSLIPKSFIKQAIEMAHEHGVYVSTGDWAEHMLRSGPSAFKDYVEECKQLGFDTIELNANLLEVPEETLLRYVRLIKNGGLRAKPMFAVKFNKSDIPGRNRAFGSYVVPEPRSSEFVEDIDLLIRKAERCLEAGADTIMIDADDVCKYADSLRADIIAKVIGRLGIEKTMFEASDAKLVEWFIKRYGPNVNLYVDHSQIMDLECLRGRHLGKDHQSVLSSSYFLF

SEQ ID NO: 13433 - protein, 3407 aa, Arabidopsis thaliana
  misc_feature: Ceres HVG ID no. 94
  misc_feature: Useful for making plants with modulated salt sensitivity
MTTVIDATMAYRFLEEATDSSSSSSSSKLESSPVDAVLFVGMSLVLGIASRHLLRGTRVPYTVALLVIGIALGSLEYGAKHNLGKIGHGIRIWNEIDPELLLAVFLPALLFESSFSMEVHQIKRCLGQMVLLAVPGVLISTACLGSLVKVTFPYEWDWKTSLLLGGLLSATDPVAVVALLKELGASKKLSTIIEGESLMNDGTAIVVFQLFLKMAMGQNSDWSSIIKFLLKVALGAVGIGLAFGIASVIWLKFIFNDTVIEITLTIAVSYFAYYTAQEWAGASGVLTVMTLGMFYAAFARTAFKGDSQKSLHHFWEMVAYIANTLIFILSGVVIAEGILDSDKIAYQGNSWRFLFLLYVYIQLSRVVVVGVLYPLLCRFGYGLDWKESIILVWSGLRGAVALALSLSVKQSSGNSHISKETGTLFLFFTGGIVFLTLIVNGSTTQFVLRLLRMDILPAPKKRILEYTKYEMLNKALRAFQDLGDDEELGPADWPTVESYISSLKGSEGELVHHPHNGSKIGSLDPKSLKDIRMRFLNGVQATYWEMLDEGRISEVTANILMQSVDEALDQVSTTLCDWRGLKPHVNFPNYYNFLHSKVVPRKLVTYFAVERLESACYISAAFLRAHTIARQQLYDFLGESNIGSIVINESEKEGEEAKKFLEKVRSSFPQVLRVVKTKQVTYSVLNHLLGYIENLEKVGLLEEKEIAHLHDAVQTGLKKLLRNPPIVKLPKLSDMITSHPLSVALPPAFCEPLKHSKKEPMKLRGVTLYKEGSKPTGVWLIFDGIVKWKSKILSNNHSLHPTFSHGSTLGLYEVLTGKPYLCDLITDSMVLCFFIDSEKILSLQSDSTIDDFLWQESALVLLKLLRPQIFESVAMQELRALVSTESSKLTTYVTGESIEIDCNSIGLLLEGFVKPVGIKEELISSPAALSPSNGNQSFHNSSEASGIMRVSFSQQATQYIVETRARAIIFNIGAFGADRTLHRRPSSLTPPRSSSSDQLQRSFRKEHRGLMSWPENIYAKQQQEINKTTLSLSERAMQLSIFGSMVNVYRRSVSFGGIYNNKLQDNLLYKKLPLNPAQGLVSAKSESSIVTKKQLETRKHACQLPLKGESSTRQNTMVESSDEEDEDEGIVVRIDSPSKIVFRNDLMAYRFLEEATDSSSSSSSSKLESSPVDAVLFVGMSLVLGIASRHLLRGTRVPYTVALLVIGIALGSLEYGAKHNLGKIGHGIRIWNEIDPELLLAVFLPALLFESSFSMEVHQIKRCLGQMVLLAVPGVLISTACLGSLVKVTFPYEWDWKTSLLLGGLLSATDPVAVVALLKELGASKKLSTIIEGESLMNDGTAIVVFQLFLKMAMGQNSDWSSIIKFLLKVALGAVGIGLAFGIASVIWLKFIFNDTVIEITLTIAVSYFAYYTAQEFYAAFARTAFKGDSQKSLHHFWEMVAYIANTLIFILSGVVIAEGILDSDKIAYQGNSWRFLFLLYVYIQLSRVVVVGVLYPLLCRFGYGLDWKESIILVWSGLRGAVALALSLSVKQSSGNSHISKETGTLFLFFTGGIVFLTLIVNGSTTQFVLRLLRMDILPAPKKRILEYTKYEMLNKALRAFQDLGDDEELGPADWPTVESYISSLKGSEGELVHHPHNGSKIGSLDPKSLKDIRMRFLNGVQATYWEMLDEGRISEVTANILMQSVDEALDQVSTTLCDWRGLKPHVNFPNYYNFLHSKVVPRKLVTYFAVERLESACYISAAFLRAHTIARQQLYDFLGESNIGSIVINESEKEGEEAKKFLEKVRSSFPQVLRVVKTKQVTYSVLNHLLGYIENLEKVGLLEEKEIAHLHDAVQTGLKKLLRNPPIVKLPKLSDMITSHPLSVALPPAFCEPLKHSKKEPMKLRGVTLYKEGSKPTGVWLIFDGIVKWKSKILSNNHSLHPTFSHGSTLGLYEVLTGKPYLCDLITDSMVLCFFIDSEKILSLQSDSTIDDFLWQESALVLLKLLRPQIFESVAMQELRALVSTESSKLTTYVTGESIEIDCNSIGLLLEGFVKPVGIKEELISSPAALSPSNGNQSFHNSSEASGIMRVSFSQQATQYIVETRARAIIFNIGAFGADRTLHRRPSSLTPPRSSSSDQLQRSFRKEHRGLMSWPENIYAKQQQEINKTTLSLSERAMQLSIFGSMVNVYRRSVSFGGIYNNKLQDNLLYKKLPLNPAQGLVSAKSESSIVTKKQLETRKHACQLPLKGESSTRQNTMVESSDEEDEDEGIVVRIDSPSKIVFRNDLMAYRFLEEATDSSSSSSSSKLESSPVDAVLFVGMSLVLGIASRHLLRGTRVPYTVALLVIGIALGSLEYGAKHNLGKIGHGIRIWNEIDPELLLAVFLPALLFESSFSMEVHQIKRCLGQMVLLAVPGVLISTACLGSLVKVTFPYEWDWKTSLLLGGLLSATDPVAVVALLKELGASKKLSTIIEGESLMNDGTAIVVFQLFLKMAMGQNSDWSSIIKFLLKVALGAVGIGLAFGIASVIWLKFIFNDTVIEITLTIAVSYFAYYTAQEWAGASGVLTVMTLGMFYAAFARTAFKGDSQKSLHHFWEMVAYIANTLIFILSGVVIAEGILDSDKIAYQGNSWRFLFLLYVYIQLSRVVVVGVLYPLLCRFGYGLDWKESIILVWSGLRGAVALALSLSVKQSSGNSHISKETGTLFLFFTGGIVFLTLIVNGSTTQFVLRLLRMDILPAPKKRILEYTKYEMLNKALRAFQDLGDDEELGPADWPTVESYISSLKGSEGELVHHPHNGSKIGSLDPKSLKDIRMRFLNGVQATYWEMLDEGRISEVTANILMQSVDEALDQVSTTLCDWRGLKPHVNFPNYYNFLHSKVVPRKLVTYFAVERLESACYISAAFLRAHTIARQQLYDFLGESNIGSIVINESEKEGEEAKKFLEKVRSSFPQVLRVVKTKQVTYSVLNHLLGYIENLEKVGLLEEKEIAHLHDAVQTGLKKLLRNPPIVKLPKLSDMITSHPLSVALPPAFCEPLKHSKKEPMKLRGVTLYKEGSKPTGVWLIFDGIVKWKSKILSNNHSLHPTFSHGSTLGLYEVLTGKPYLCDLITDSMVLCFFIDSEKILSLQSDSTIDDFLWQESALVLLKLLRPQIFESVAMQELRALVSTESSKLTTYVTGESIEIDCNSIGLLLEGFVKPVGIKEELISSPAALSPSNGNQSFHNSSEASGIMRVSFSQQATQYIVETRARAIIFNIGAFGADRTLHRRPSSLTPPRSSSSDQLQRSFRKEHRGLMSWPENIYAKQQQEINKTTLSLSERAMQLSIFGSMVNVYRRSVSFGGIYNNKLQDNLLYKKLPLNPAQGLVSAKSESSIVTKKQLETRKHACQLPLKGESSTRQNTMVESSDEEDEDEGIVVRIDSPSKIVFRNDL

SEQ ID NO: 13434 - protein, 513 aa, Arabidopsis thaliana
  misc_feature: Ceres CDNA ID no. 2032973
  misc_feature: Useful for making plants with modulated biomass
  misc_feature: Useful for making plants with modulated heat sensitivity
  misc_feature: Useful for making plants with modulated seed number
MFETEHHTLLPLLLLPSLLSLLLFLILLKRRNRKTRFNLPPGKSGWPFLGETIGYLKPYTATTLGDFMQQHVSKYGKIYRSNLFGEPTIVSADAGLNRFILQNEGRLFECSYPRSIGGILGKWSMLVLVGDMHRDMRSISLNFLSHARLRTILLKDVERHTLFVLDSWQQNSIFSAQDEAKKFTFNLMAKHIMSMDPGEEETEQLKKEYVTFMKGVVSAPLNLPGTAYHKALQSRATILKFIERKMEERKLDIKEEDQEEEEVKTEDEAEMSKSDHVRKQRTDDDLLGWVLKHSNLSTEQILDLILSLLFAGHETSSVAIALAIFFLQACPKAVEELREEHLEIARAKKELGESELNWDDYKKMDFTQCVINETLRLGNVVRFLHRKALKDVRYKGYDIPSGWKVLPVISAVHLDNSRYDQPNLFNPWRWQQQNNGASSSGSGSFSTWGNNYMPFGGGPRLCAGSELAKLEMAVFIHHLVLKFNWELAEDDKPFAFPFVDFPNGLPIRVSRIL

SEQ ID NO: 13435 - protein, 410 aa, Arabidopsis thaliana
  misc_feature: Ceres CLONE ID no. 28635
  misc_feature: Useful for making plants with altered sterol content
MGSLGTMLRYPDDIYPLLKMKRAIEKAEKQIPPEPHWGFCYSMLHKASRSFSLVIQQLNTELRNAVCVFYLVLRALDTVEDDTSIPTDEKVPILIAFHRHIYDTDWHYSCGTKEYKILMDQFHHVSAAFLELEKGYQEAIEEITRRMGAGMAKFICQEVETVDDYDEYCHYVAGLVGLGLSKLFLAAGSEVLTPDWEVISNSMGLFLQKTNIIRDYLEDINEIPKSRMFWPREIWGKYADKLEDLKYEENTNKSVQCLNEMVTNALMHIEDCLKYMVSLRDPSIFRFCAIPQIMAIGTLALCYNNEQVFRGVVKLRRGLTAKVIDRTKTMADVYGAFYDFSCMLKTKVDKNDPNASKTLNRLEAVQKLCRDAGVLQNRKSYVNDKGQPNSVFIIMVVILLAIVFAYLRAN

SEQ ID NO: 13436 - protein, 431 aa, Arabidopsis thaliana
  misc_feature: Ceres CLONE ID no. 21240
  misc_feature: Useful for making plants with altered Lignin content
  misc_feature: Useful for making plants with altered sterol content
  misc_feature: Useful for making plants with altered terpenoid content
  misc_feature: Useful for making plants with modulated flowering time
MAFHHNHLSQDLSFNHFTDQHQPPPPQPPPPPPQQQQHFQEAPPPNWLNTALLRSSDNNNNFLNLHTATANTTTASSSDSPSSAAAAAAANQWLSLSSSFLQRNNNNNASIVGDGIDDVTGGADTMIQGEMKTGGGENKNDGGGATAADGVVSWQNARHKAEILSHPLYEQLLSAHVACLRIATPVDQLPRIDAQLAQSQHVVAKYSALGAAAQGLVGDDKELDQFMTHYVLLLCSFKEQLQQHVRVHAMEAVMACWEIEQSLQSLTGVSPGEGMGATMSDDEDEQVESDANMFDGGLDVLGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSSSTVLKNKRKSNAGDNSGRERFA

SEQ ID NO: 13437 - protein, 196 aa, Arabidopsis thaliana
  misc_feature: Ceres CLONE ID no. 28780
  misc_feature: Useful for making plants with modulated low light sensitivity
  misc_feature: Useful for making plants with modulated nitrogen use efficiency
MESADSGRSDPVKGDDPGPSFVSSPPATPSRYESQKRRDWNTFLQYLKNHKPPLALSRCSGAHVIEFLKYLDQFGKTKVHVAACPYFGHQQPPSPCSCPLKQAWGSLDALIGRLRAAYEENGGRPDSNPFAARAVRIYLREVRESQAKARGIPYEKKKRKRPPTVTTVRVDVASSRQSDGDPCNVGAPSVAEAVPP

SEQ ID NO: 13438 - protein, 248 aa, Arabidopsis thaliana
  misc_feature: Ceres CLONE ID no. 22339
  misc_feature: Useful for making plants with altered terpenoid content
  misc_feature: Useful for making plants with modulated flowering time
MEEGGSSHDAESSKKLGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 13439 - protein, 210 aa, Glycine max
  misc_feature: Ceres CLONE ID no. 674166
  misc_feature: Useful for making plants with modulated cold sensitivity
MGRGGTAAAAAEVAEPGLRPVYFKEQRYRGVRKRPWGRFAAEIRDPLKKARVWLGTFDTAEEAARAYDTAARTLRGPKAKTNFPLSPPFYHPDPFSDHRHFANTGEDFHDHRRPTSSGMSSTVESFSGPRAAVPATAPVATGRRYPRTPPVIPEDCRSDCDSSSSVVDDGEGDNVASSFPREPLPFDLNALPLDDADVATDDLFCTVLCL

SEQ ID NO: 13440 - protein, 260 aa, Arabidopsis thaliana
  misc_feature: Ceres SEEDLINE ID no. ME11030
  misc_feature: Useful for making plants with modulated flowering time
MLPYIGHNSYQQHQFPLPEMEIPEKWKLSYEQEAITAPACPRCASSNTKFCYYNNYSLSQPRYFCKGCRRYWTKGGSLRNIPVGGGCRKRSRSRQNSHKRFGRNENRPDGLINQDDGFQSSPPGSDIDLAAVFAQYVTDRSPSSTDNTTGSDQDSPITTTTHALESLSWDICQETDVDLGFYGEFNNLTQKTKEDQEVFGQFLQEDREEIFEFQGLLDDKEIQEILECSFSEEPDQLVSQGSFMINGDNWSSTDLTRFGI

SEQ ID NO: 13441 - protein, 311 aa, Zea mays
  misc_feature: Ceres CLONE ID no. 375578
  misc_feature: Useful for making plants with modulated oxidative stress sensitivity
  misc_feature: Useful for making plants with modulated salt sensitivity
  misc_feature: Useful for making plants with modulated salt sensitivity
MTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 13442 - protein, 303 aa, Arabidopsis thaliana
  misc_feature: Ceres CLONE ID no. 105319
  misc_feature: Useful for making plants with modulated salt sensitivity
MEAAITQRIQYPSWVDCRKVECKPQRGSLRYSQQVKVDRRFRGLSLARLQPERRIDQRRAVSPAVSCSDNNSSALLETGSVYPFDEDILKRKAEEVKPYLNGRSMYLVGMMGSGKTTVGKLMSKVLGYTFFDCDTLIEQAMNGTSVAEIFVHHGENFFRGKETDALKKLSSRYQVVVSTGGGAVIRPINWKYMHKGISIWLDVPLEALAHRIAAVGTDSRPLLHDESGDAYSVAFKRLSAIWDERGEAYTNANARVSLENIAAKRGYKNVSDLTPTEICIEAFEQVLSFLEKEETMEIPDGDL

SEQ ID NO: 13443 - protein, 218 aa, Arabidopsis thaliana
  misc_feature: Ceres CLONE ID no. 8161
  misc_feature: Abnormal phyllotaxy, leaf number higher than wild-type
  misc_feature: The plant flowers significantly late compared to wild-type.
  misc_feature: The plant is abnormally large.
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: Useful for making plants with modulated flowering time
  misc_feature: Useful for making plants with modulated drought sensitivity
MENDCTVNIVSLEKDRDVSEASAESQSESTLSNSLDSGVTAETSRSDADSKLDECTAWTNEKHNSYLDYLESSFVRQLYSLLGGGTQRLSRTRDVQSNSHKSADQFTVLQNGCWQKVNFGKKQSCLETSSEFRFHRNSLRNKPENSNGNYTMGTTVQGDVLCHDETKHSEASGQNFREEEEEEEKGEVSKKREREANNDDSSLKEDQVVPVRMVKPRT

SEQ ID NO: 13444 - protein, 52 aa, Arabidopsis thaliana
  misc_feature: Ceres CLONE ID no. 29658
  misc_feature: Useful for making plants with modulated salt sensitivity
MASTKPTDQIKQLKDIFARFDMDKDGSLTQLELAALLRSLGIKPRGDQISLL

SEQ ID NO: 13445 - protein, 516 aa, Arabidopsis thaliana
  misc_feature: Ceres CLONE ID no. 150823
  misc_feature: Useful for biocontainment applications
  misc_feature: Useful for making plants with altered cell wall content and/or composition
  misc_feature: Useful for making plants with modulated nitrogen use efficiency
MALLLVSSSSSYALRVTIFLSFFFFLCNGFSYPTTSSLFNTHHHRHHLAKHNYKDALTKSILFFEGQRSGKLPSNQRMSWRRDSGLSDGSALHVDLVGGYYDAGDNIKFGFPMAFTTTMLSWSVIEFGGLMKSELQNAKIAIRWATDYLLKATSQPDTIYVQVGDANKDHSCWERPEDMDTVRSVFKVDKNTPGSDVAAETAAALAAAAIVFRKSDPSYSKVLLKRAISVFAFADKYRGTYSAGLKPDVCPFYCSYSGYQDELLWGAAWLQNATKNLKYLNYIKINGQILGAAEYDNTFGWDNKHAGARILLTKAFLVQNVKTLHEYKGHADNFICSVIPGAPFSSTQYTPGGLLFKMADANMQYVTSTSFLLLTYAKYLTSAKTVVHCGGSVYTPGRLRSIAKRQVDYLLGDNPLRMSYMVGYGPKFPRRIHHRGSSLPCVASHPAKIQCHQGFAIMNSQSPNPNFLVGVVVGGPDQHDRFPDERSDYEQSEPATYINSPLVGALAYFAHAYGQL

SEQ ID NO: 13446 - protein, 298 aa, Arabidopsis thaliana
  misc_feature: Ceres CLONE ID no. 41573
  misc_feature: Useful for making plants with altered oil content
MDDIVLGYDSVKTYKTDKVYFGATVGRVANRIGKGKFKLNGKEYKTSVNDGKNTLHGGKKGFGDVVWAVAKHQYDGKKPHIVFTHTSPDGDQGFPGELSVTVTYKLVKDNELSVVMEAKPKDKATPVNLAHHSYWNLGGHNSGDILSEEIQILGSGYTPVDGELIPTGKINPVKGTAYDFLQLRPIKDNMKDLKTGYDINYCLDGKAKKMRKIVELVDKKSGRKMELSGNQAGLQFYTGGMLKDVKGKNGAAYQAFGGLCLETQSYPDALNHPKFPSQIVEPGKKYKHTMLFKFSIVS

SEQ ID NO: 13447 - protein, 113 aa, Arabidopsis thaliana
  misc_feature: Ceres CLONE ID no. 25429
  misc_feature: The plant is abnormally small.
  misc_feature: Useful for making plants with altered oil content
  misc_feature: Useful for making plants with modulated biomass
MKVAAAFLLAVLGGNANPSAENIKDIIGAVGADVDGESIELLLKEVSGKDIAELIASGREKLASVPSGGGVAVSAAPSSGGGGAAAAAPAEKKEAKKEEKEESDDDMGFSLFE

SEQ ID NO: 13448 - protein, 454 aa, Zea mays
  misc_feature: Ceres CLONE ID no. 218626
  misc_feature: Useful for making plants with altered oil content
MGTQAPENYPAEKVQDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVLVCGDTGVCEGKDNIKTTYFIMIFASVHFVLSQLPNFNSISGVSLAAAVMSLSYSTIAWGASVHKGRMSGVDYHLRATTTPGKVFGFFGALGDVAFAYAGHNVVLEIQATIPSTPDKPSKKPMWKGVVVAYVVVALCYFPVALIGYWAFGNTVEDNILITLSKPKWLIALANMMVVVHVIGSYQIYAMPVFDMIETVLVKKLRFPPGLTLRLIARTLYVAFTMFIAITFPFFGGLLGFFGGFAFAPTTYFLPCVMWLAIYKPKRFSLSWLTNWMCIILGVLLMILSPIGGLRQIIMDAKTYQFYS

SEQ ID NO: 13449 - protein, 121 aa, Arabidopsis thaliana
  misc_feature: Ceres CLONE ID no. 11852
  misc_feature: Useful for making plants with altered protein content
MASRRSVRYAQLPGDEDDEGYGNGVGERRDFDPRFDYSPKAFDRVPWKSIALAVFLLFLGCLLLLLSFFIFIGHMEGDSSQGYALLVLGILTFLPGFYETRIAYYSWRGAEGYRFAAIPSY

SEQ ID NO: 13450 - protein, 209 aa, Arabidopsis thaliana
  misc_feature: Ceres CLONE ID no. 8166
  misc_feature: Useful for making plants with altered protein content
MKDCENHGHSRRKLIRRIFWSIIFVLFIIFLTILLIWAILQPSKPRFILQDATVYAFNVSGNPPNLLTSNFQITLSSRNPNNKIGIYYDRLDVYATYRSQQITFPTSIPPTYQGHKDVDIWSPFVYGTSVPIAPFNGVSLDTDKDNGVVLLIIRADGRVRWKVGTFITGKYHLHVKCPAYINFGNKANGVIVGDNAVKYTFTTSCSVSV

SEQ ID NO: 13451 - protein, 161 aa, Arabidopsis thaliana
  misc_feature: Ceres CLONE ID no. 40576
  misc_feature: Useful for making plants with modulated salt sensitivity
  misc_feature: Useful for making plants with modulated nitrogen use efficiency
MVAISEIKSTVDVTAANCLMLLSRVGQENVDGGDQKRVFTCKTCLKQFHSFQALGGHRASHKKPNNDALSSGLMKKVKTSSHPCPICGVEFPMGQALGGHMRRHRNESGAAGGALVTRALLPEPTVTTLKKSSSGKRVACLDLSLGMVDNLNLKLELGRTV

SEQ ID NO: 13452 - protein, 283 aa, Arabidopsis thaliana
  misc_feature: Ceres SEEDLINE ID no. ME09573
  misc_feature: Useful for making plants with modulated flowering time
MYKDRSGGGIMGGGGSSRSEILGGAIDRKRINDALDKHLKKSSPSTSRVFTSKDKDSVPSTSTAKSQLHSRSPDVESDTDSEGSDVSGSEGDDTSWISWFCNLRGNEFFCEVDEDYIQDDFNLCGLSGQVPYYDYALDLILDVESSNGDMFTEEQHEMVESAAEMLYGLIHVRYILTTKGMAAMMEKYKNYDFGRCPRVFCCGQSCLPVGQSDIPRSSTVKIYCPKCEDIYYPRSKYQGNIDGAYFGTTFPHLFLMAYGNMKPQKPAQNYVPKIFGFKVHNKQ

SEQ ID NO: 13453 - protein, 235 aa, Arabidopsis thaliana
  misc_feature: Ceres CLONE ID no. 1678
  misc_feature: Useful for making ornamental plants with delayed petal abscission
MSDFSIKPDDKKEEEKPATAMLPPPKPNASSMETQSANTGTAKKLRRKRNCKICICFTILLILLIAIVIVILAFTLFKPKRPTTTIDSVTVDRLQASVNPLLLKVLLNLTLNVDLSLKNPNRIGFSYDSSSALLNYRGQVIGEAPLPANRIAARKTVSLNITLTLMADRLLSETQLLSDVMAGVIPLNTFVKVTGKVTVLKIFKIKVQSSSSCDLSISVSNRNVTSQHCKYSTKL

SEQ ID NO: 13454 - protein, 104 aa, Arabidopsis thaliana
  misc_feature: Ceres SEEDLINE ID no. ME10609
  misc_feature: Useful for making plants with modulated cold sensitivity
MGIQLIGLSQAKQKLQRSLSARIASLLATSGTNNVPKGHVAVYVGETYHRKRFVIPISYLNHPLFQGLLNLAEEEFGFDHPMGGLTIPCTEDYFTALASILSGS

SEQ ID NO: 13455 - protein, 253 aa, Arabidopsis thaliana
  misc_feature: Ceres CLONE ID no. 268310
  misc_feature: Useful for making plants with modulated oxidative stress sensitivity
MATPNEVSALFLIKKYLLDELSPLPTTATTNRWMNDFTSFHQTGFEFSEFETKPEIIDLVTPKPEISDFEVKSEISIESNDSFTFQSNPPRVTVQSNRKPPLKIAPPNRTKWIQFATGNPKPELPEPVVAAEEKRHYRGVRMRPWGKFAAEIRDPTRRGTRVWLGTFETAIEAARAYDKEAFRLRGSKAILNFPLEVDKWNPRAEDGRGLYKRKRDSEEEEVKVVKKVLKKEESYAVSDGENVESGLTAIDDW

SEQ ID NO: 13456 - protein, 209 aa, Brassica napus
  misc_feature: Ceres CLONE ID no. 965405
  misc_feature: Useful for making plants with modulated salt sensitivity
MSADDSSNATDVDGKLGSDLNVNSDGEDAADNDSSKTLTIPAPAVCLVRFAGDAAGGAVMGSIFGYGSGLFKKKGFKGSFADAGQSAKTFAVLSGVHSLVVCLLKQLRGKDDAINVGVAGCCTGLALSFPGAPQALLQSCLTFGAFSFILEGLNKRQTALAHSVSLRHQTGNFGDHQQRPLQLSLALPIHEEIKGFSSFCKSLTKPKKI

SEQ ID NO: 13457 - protein, 221 aa, Arabidopsis thaliana
  misc_feature: Ceres SEEDLINE ID no. ME11278
  misc_feature: Useful for making plants with altered oil content
MEPERLKFGGPRELCGAADLISQFKLVQHHEFFCKKSLPVSLSDSHYLHNVVGDTEIRKGEGMQLDQLIESISQSRETNIRIQPFDIDELQESFQLNDMTPVELPPAEKGAPTIPSKSKSESKDRDRKHKKHKDRDKDKDREHKKHKHKHKDRSKDKDKDKDRDRKKDKNGHHDSGDHSKKHHDKKRKHDGDEDLNDVQRHKKNKHKSSKLDEVGAIRVAG

SEQ ID NO: 13458 - protein, 176 aa, Arabidopsis thaliana
  misc_feature: Ceres SEEDLINE ID no. ME11822
  misc_feature: Useful for making plants with altered oil content
MEEDRENAKRVVFVTVGTTSFDALVKAVVSQNVKDELQKRGFTHLLIQMGRGIFFPTKCDGADGSLVVDYFTFSSSIADYIRSASLVISHAGSGSIFETLKLGKPLIVVVNEDLMDNHQCELAEALEERKHLYYTRPHSLHQTLTKMELGSLVQYTPGDGTPVARIIDRFLGFPDD

SEQ ID NO: 13459 - protein, 434 aa, Zea mays
  misc_feature: Ceres CLONE ID no. 285705
  misc_feature: Useful for making plants with altered protein content
MEDNAVEEPELSGAAEFAPALVAAHPHGNSVAVAIGPELRVFDLRAGHPVSLSDDCGGHSHSDAIRAICFSVSGALFASAGDDKLVKVWKTDSWRCIQTITSEKRVSAVVISNDDLYVSFADKFGVVWLVTLREDSAEQVSVDNKPVPILGHYCSIITSMKFSPDGRFIATADRDFKIRVTLFPKNPLKGAHEIQSFCLGHTDFVSCITFTSISENQSFLISGGGDSTVRLWDYVNGCLLDTFQAKDKMGELLGPNETDDSSLAITDICPSNDGSLVAVAIQSFSGIMLLACDLVGKKLSFLKVITMEKSYIPTSLASSSASELLWTVMGASNMPSQASSHLLTRLRIITCFQKDRLSSSDAGPATLEDGDVPHGEKLLLALQGSLDVAKQEEVLASVLAALKVSMHKMLVKKHYSEERREQRKRGRNDKKMKN

SEQ ID NO: 13460 - protein, 272 aa, Zea mays
  misc_feature: Ceres CLONE ID no. 400568
  misc_feature: Useful for making plants with altered protein content
MWGFASNAWASGLGKRSPPNCTSSSAACSDDEASSCTSREEGLECPICWESFNIVENVPYVLWCGHTLCKNCVLGLQWAVIKVPTVPMQLPFFVCCPWCNLLSLRILYKGNLTFPRKNYFLLWMVEGMNGERARSRPATHSEQHTPWLSSSSRANGNAGCSNPTRRHLPLPPPVDTTSPTNANHANHGVPVPLLNAERVQASLRKSLSFLVHLTAKFPLVFIFLLIVLYAIPASAAVLLLYILITVLFALPSFLILYFAYPSLDWLVREIFA

SEQ ID NO: 13461 - protein, 189 aa, Brassica napus
  misc_feature: Ceres CLONE ID no. 1103471
  misc_feature: Useful for making plants with altered protein content
MALEALNSPRIASPVPTLFEEHWTKGKRSKRSRSDHPHRLTEEEYLAFCLMLLARDGDRHHVEEEKTVYKCGVCDKVFLSYQALGGHKASHRNFSSGGDVKPTTPAAVKSHVCSICHKSFTTGQALGGHKRCHYDGSSNVVSNSEGVGSTSHVSGNSSRGFDLNITPINELSPDDEVMSPLPSKKLRLK

SEQ ID NO: 13462 - protein, 244 aa, Arabidopsis thaliana
  misc_feature: Ceres CLONE ID no. 21863
  misc_feature: Useful for making plants with altered Lignin content
  misc_feature: Useful for making plants with altered alkaloid content
  misc_feature: Useful for making plants with altered lutein content
MPSTPTTPTTTTPITASYWCYSCTRFVSVWADQGTTTVGSVACPHCDGGFIEQINDSSSAATELTIPASTEVRSINNNRRSVIRRRRSGRRPSFNPVIVLQGGAGEREEGEEGDAARDRRAFEFYYDDGSGSGLRPLPDSVSEILMGSGFERLLEQLSQIEASATGIGRSGNPPASKSAIESLPRVEISDCHIGSEANCAVCTEIFETETEAREMPCKHLFHDDCIVPWLSIRNSCPVCRFELP

SEQ ID NO: 13463 - protein, 190 aa, Brassica napus
  misc_feature: Ceres CLONE ID no. 968026
  misc_feature: Useful for making plants with altered Lignin content
  misc_feature: Useful for making plants with altered carotene content
  misc_feature: Useful for making plants with altered terpenoid content
MAEVMLPMKMEMANDPSKFTSPDLLHVLAVDDSHVDRKFIERLLKVSSCKVTVVDSATRALQYLGLDVNEKPIGCKDLKVNLIMTDYSMPGMTGYELLKKIKESSAFRDVPVVVMSSENILSRIDRCLEEGAEDFLLKPVKLSDVRRIRDSLIKVEDLSFTKSINKRELETENVYSLDSSVPLQLKRTKI

SEQ ID NO: 13464 - protein, 349 aa, Arabidopsis thaliana
  misc_feature: Ceres CLONE ID no. 110454
  misc_feature: The plant is abnormally small.
  misc_feature: Useful for making plants with modulated biomass
  misc_feature: Useful for making plants with modulated low light sensitivity
  misc_feature: Useful for making plants with modulated light quality sensitivity
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSSCDHMVPKKETRLKLTIRKKDHEDQPHPLHQNPTKPDSDSDKWLMSPKMRLIKKTITNNKQLTDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKKLQNKKKEIKRRGKIQSLSSNGGQGQKVQDQRGRGEGNGSGNGCRRFRDQQIYNFF

SEQ ID NO: 13465 - protein, 160 aa, Arabidopsis thaliana
  misc_feature: Ceres CLONE ID no. 30081
  misc_feature: Useful for making plants with modulated phosphate use efficiency
MAKTEAPSLVGKLETEVEIKASAGQFHHMFAGKPHHVSKASPGNIQSCDLHEGDWGTVGSIVFWNYVHDGEAKVAKERIEAVEPEKNLITFRVIEGDLMKEYKSFLITIQVTPKHGGPGSIVHWHLEYEKISDEVAHPETLLQFCVEVSQEIDEHLLAEG

SEQ ID NO: 13466 - protein, 331 aa, Arabidopsis thaliana
  misc_feature: Ceres SEEDLINE ID no. ME17254
  misc_feature: Useful for making plants with modulated heat sensitivity
MTAIPNVVDIESSSSSLCQETATETVTVERGSSDSSSKPDDVVLLIKEEEDDAVNLSLGFWKLHEIGLITPFLRKTFEIVDDKVTDPVVSWSPTRKSFIIWDSYEFSENLLPKYFKHKNFSSFIRQLNSYGFKKVDSDRWEFANEGFQGGKKHLLKNIKRRSKNTKCCNKEASTTTTETEVESLKEEQSPMRLEMLKLKQQQEESQHQMVTVQEKIHGVDTEQQHMLSFFAKLAKDQRFVERLVKKRKMKIQRELEAAEFVKKLKLLQDQETQKNLLDVEREFMAMAATEHNPEPDILVNNQSGNTRCQLNSEDLLVDGGSMDVNGRIEIE

SEQ ID NO: 13467 - protein, 164 aa, Arabidopsis thaliana
  misc_feature: Ceres CLONE ID no. 251923
  misc_feature: Useful for making plants with modulated flowering time
MPAGHGVRARTRDLFARPFRKKGYIPLSTYLRTFKVGDYVDVKVNGAIHKGIPHKFYHGRTGRIWNVTKRAVGVEVNKQIGNRIIRKRIHVRVEHVQQSRCAEEFKLRKKQNDVLKADAKARGETISTKRQPKGPKPGFMVEGMTLETVTPIPYDVVNDLKGGY

SEQ ID NO: 13468 - protein, 307 aa, Arabidopsis thaliana
  misc_feature: Ceres CLONE ID no. 19080
  misc_feature: Useful for making plants with modulated flowering time
  misc_feature: Useful for making plants with modulated nitrogen use efficiency
MQDIHDFSMNGVGGGGGGGGRFFGGGIGGGGGGDRRMRAHQNNILNHHQSLKCPRCNSLNTKFCYYNNYNLSQPRHFCKNCRRYWTKGGVLRNVPVGGGCRKAKRSKTKQVPSSSSADKPTTTQDDHHVEEKSSTGSHSSSESSSLTASNSTTVAAVSVTAAAEVASSVIPGFDMPNMKIYGNGIEWSTLLGQGSSAGGVFSEIGGFPAVSAIETTPFGFGGKFVNQDDHLKLEGETVQQQQFGDRTAQVEFQGRSSDPNMGFEPLDWGSGGGDQTLFDLTSTVDHAYWSQSQWTSSDQDQSGLYLP

SEQ ID NO: 13469 - protein, 524 aa, Arabidopsis thaliana
  misc_feature: Ceres CDNA ID no. 23432135
  misc_feature: Useful for making plants with altered lutein content
  misc_feature: Useful for making plants with altered lycopene content
MECVGARNFAAMAVSTFPSWSCRRKFPVVKRYSYRNIRFGLCSARASGGGSSGSESCVAVREDFADEEDFVKAGGSEILFVQMQQNKDMDEQSKLVDKLPPISIGDGALDLVVIGCGPAGLALAAESAKLGLKVGLIGPDLPFTNNYGVWEDEFNDLGLQKCIEHVWRETIVYLDDDKPITIGRAYGRVSRRLLHEELLRRCVESGVSYLSSKVDSITEASDGLRLVACDDNNVIPCRLATVASGAASGKLLQYEVGGPRVCVQTAYGVEVEVENSPYDPDQMVFMDYRDYTNEKVRSLEAEYPTFLYAMPMTKSRLFFEETCLASKDVMPFDLLKKKLMLRLDTLGIRILKTYEEEWSYIPVGGSLPNTEQKNLAFGAAASMVHPATGYSVVRSLSEAPKYASVIAEILTEETTKQINSNISRQAWDTLWPPERKRQRAFFLFGLALIVQFDTEGIRSFFRTFFRLPKWMWQGFLGSTLTSGDLVLFALYMFVISPNNLRKGLINHLISDPTGATMIKTYLKV

SEQ ID NO: 13470 - protein, 138 aa, Arabidopsis thaliana
  misc_feature: Ceres CLONE ID no. 641355
  misc_feature: The plant flowers significantly late compared to wild-type.
  misc_feature: The plant is abnormally small.
  misc_feature: Useful for making plants with altered lutein content
  misc_feature: Useful for making plants with modulated biomass
  misc_feature: Useful for making plants with modulated flowering time
  misc_feature (72)..(72): Xaa is any aa, unknown, or other
  misc_feature (95)..(95): Xaa is any aa, unknown, or other
MEEESKEKKKDTKEEPRYRGVRRRPWGKFAAEIRDPARHGARVWLGTFLTAEEAARAYDRAAYEMRGALAVXNFPNEYPSCSSMNSSSTLAPSSXSSNSMLKSDHGKQVIEFECLDDKLLEDLLDCDDYAYEKDLPKN

SEQ ID NO: 13471 - protein, 436 aa, Arabidopsis thaliana
  misc_feature: Ceres SEEDLINE ID no. ME11961
  misc_feature: Useful for making plants with modulated light quality response
  misc_feature: Useful for making plants with modulated light quality sensitivity
  misc_feature: Useful for making plants with modulated nitrogen use efficiency
MGLEDAGDLVLHIVLSKIGPENTARVACVSKRLKVSASEESLWSIFCSNDLNISTPLDPHGDPAPSFKRAYQLWRESFRMYPWNLVKRVRLCWDNLKQWLTLNFPEAKATLRKGVTEDDLQEFETSLKVKLPLPTRLLYRFVDGQELSSPNGLDGSLGLIGGYSAYSHDVNVYLLPLKEVMRETKESFMRDLGFSSRLDLIVMAASVVASLKIFLLDCTTGQLFTGTSNRQLLPCVPDALVRSVHDTNGDQQQDAMLLWLEEHGRRLQTGTINVRQQNNVKSISLFPEIPPLCSVSVTNGVQVRASSVFIPEISNLRDQPPAYWYAYSIRMSLMPEGCILNGTHHSSCQLYWRHWVIRADNEVIDNVNGEAVIGKYPLLQAGEEEFVYESCSSFPTTAGSIDGSFTFVPGSLRDPKGSQFEVKVVEFPLELPDYIF

SEQ ID NO: 13472 - protein, 119 aa, Arabidopsis thaliana
  misc_feature: Ceres CLONE ID no. 11830
  misc_feature: Useful for making plants with modulated drought sensitivity
  misc_feature: Useful for making plants with modulated water use efficiency
MSTFLIRILLPLLIIAMTLPRRSEAESEQWCIADEQTPDDELQAALDWACGKGGADCSKMQQENQPCFLPNTIRDHASFAFNSYYQTYKNKGGSCYFKGAAMITELDPSHGSCQYEYNP

SEQ ID NO: 13473 - protein, 246 aa, Arabidopsis thaliana
  misc_feature: Ceres CLONE ID no. 156373
  misc_feature: Useful for making plants with altered Lignin content
  misc_feature: Useful for making plants with modulated flowering time
MAAAAVSSNPRTVEEIFKDYSARRAALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKAMKDNKPSSDSGSKSRNGTKRSIDGQTKSSTPKLMEESYEEEEEEDEHGDTLCGSCGGHYTNEEFWICCDVCERWYHGKCVKITPAKAESIKQYKCPPCCAKKGRQ

SEQ ID NO: 13474 - protein, 105 aa, Brassica napus
  misc_feature: Ceres CLONE ID no. 977067
  misc_feature: Useful for making plants with modulated cold sensitivity
  misc_feature: Useful for making plants with modulated salt sensitivity
MEETTTFQGLRHLFMTVFLHGFSAFIVVPVITDVSMAALCPGKDECSLAIYLSGFQQAITGVGSLMMMPLVGSLSDKHGRKSLLTLPMALNILPLVFDVDVECSL

SEQ ID NO: 13475 - protein, 516 aa, Arabidopsis thaliana
  misc_feature: Ceres CLONE ID no. 41610
  misc_feature: Useful for making plants with modulated UV sensitivity
  misc_feature: Useful for making plants with modulated low light sensitivity
  misc_feature: Useful for making plants with modulated oxidative stress sensitivity
MEGVITCFHTKCVSLPIRSFPLSRVSSLPRWRNNKLISSSRSVHLRSLCVSASSSDTLVAGGSPKEDERQSKVSSKKEGDDSEDLKFWMDKNGLPPCKVILKEKPAHDQKHKPIHYVAASEDLQKGDVAFSVPDSLVVTLERVLGNETIAELLTTNKLSELACLALYLMYEKKQGKKSVWYPYIRELDRQRGRGQLDAESPLLWSEAELDYLTGSPTKAEVLERAEGIKREYNELDTVWFMAGSLFQQYPFDIPTEAFSFEIFKQAFVAIQSCVVHLQNVGLARRFALVPLGPPLLAYCSNCKAMLTAVDGAVELVVDRPYKAGDPIVVWCGPQPNAKLLLNYGFVDEDNPYDRVIVEAAFNTEDPQYQDKRMVAQRNGKLSQQVFQVRVGKEREAVQDMLPYLRLGYMSDPSEMQSVISSQGPVCPMSPCMERAVLDQLANYFMRRLSGYPTTPKEDDALLADPSLSPRKRVATRLVQLEKKILVACLTTTVDLLNQLPDTAISPCPAPYAPSLK

SEQ ID NO: 13476 - protein, 124 aa, Arabidopsis thaliana
  misc_feature: Ceres CLONE ID no. 35743
  misc_feature: Useful for making plants with modulated drought sensitivity
MQMLRNLSTRTRSRRGGYERVSDDSTFSLLGAKLRRSTSVPYYAPSIRLGGDFPVILEKLPRQKPTKTVVTSKLSHPIFSLFDGYRRRSKKKATAKPEFSRYHEYLKESGMWDLRSNSPVIYFK

SEQ ID NO: 13477 - protein, 161 aa, Arabidopsis thaliana
  misc_feature: Ceres CLONE ID no. 24255
  misc_feature: Useful for making plants with modulated nitrogen use efficiency
MAEEHRCETPEGHRLCVNNCGFFGSSATMNLCSNCYGDLCLKQQQQASMKSTVESSLSPVIAPVLENYAAELEIPTTKKTEEKKPIQIPTEQPSPPQRPNRCTVCRKRVGLTGFMCRCGTTFCGSHRYPEVHGCTFDFKSAGREEIAKANPLVIAAKLQKI

SEQ ID NO: 13478 - protein, 251 aa, Glycine max
  misc_feature: Ceres CLONE ID no. 531679
  misc_feature: Useful for making plants with altered protein content
MVVLSLSSPSLSTALLAKNLPPREHTVKLATFRNNSFRFRCAVDTPYGGNAQKFPRINVWNPYRRLGISPDASEEEIWGSRNFLLQQYSGHERSEESIEAAFEKILMASFVQRRKTKINLKSKLKKKVEESPPWVKNLLSFVELPPTEVILRRLFLFGFMGGWSIMNSAETGPAFQVAISLAACIYFLNEKTKSLARAFIIGFGALVAGWVSGSLLVPNIPSMLLRPTWTLELLTSLVVYLFLFVACTFLK

SEQ ID NO: 13479 - protein, 622 aa, Arabidopsis thaliana
  misc_feature: Ceres SEEDLINE ID no. ME11388
  misc_feature: Useful for making plants with altered protein content
MAMAVFKAPLKGEFHGARKMEGKQYKHHLLQQQSTGRRRVFVQTDTGCVLGVELDRNDNVHTVKKRLQIAFNFPTEESSLTFGDMVLKNDLSAVRNDSPLLLKRNLMHRSSSTPCLSPTGNDLQRKDRSGPIEILSHSPCFLSLKQTANDIVKAMKMGVEPIPVNGGLGGAYYFRDEKGQSVAIVKPTDEEPFAPNNPKGFVGKALGQPGLKPSVRVGETGFREVAAYLLDYDHFANVPPTALVKITHSVFNVNDGMDGNKSREKKKLVSSKIASFQKFVPHDFDASDHGTSSFPVASVHRIGILDIRILNTDRHGGNLLVKKLDDGGVGRFGQVELIPIDHGLCLPETLEDPYFEWIHWPQASIPFSEEELDYIQSLDPVKDCEMLRRELPMIREACLRVLVLCTVFLKEAAVFGLCLAEIGEMMTREFRAGEEEPSELEMLCIEAKRLTTEQDVLSPKSDGEGETEFQFDIDYNELDSVYGSETETDEFFAKNPFSNGRSSLGELKESIAEEEEDDEEEAKLTLSLSKLSTSMKNNLSNTMGSGYLKPPKDNQTDKALVSHKSANVQLPLSVNFVKLADMKEVEWVVFLERFQELLYSAFAERKTMTLRNTQRLGTSCKF

SEQ ID NO: 13480 - protein, 155 aa, Arabidopsis thaliana
  misc_feature: Ceres CLONE ID no. 251590
  misc_feature: Useful for making plants with modulated nitrogen use efficiency
METLQCRHQHVFILLLVLFHSSLFVLASKIDVSDDARGIRIDGGQKRFLTNSPQHGKEHAACTNEEPDLGPLTRISCNEPEYVITKINFADYGNPTGTCGHFRRDNCGARATMRIVKKNCLGKEKCHLLVTDEMFGPSKCKGAPMLAVETTCTIA

SEQ ID NO: 13481 - protein, 432 aa, Arabidopsis thaliana
  misc_feature: Ceres CLONE ID no. 253162
  misc_feature: Useful for making plants with modulated seed size
  misc_feature: Useful for making plants with modulated nitrogen use efficiency
MWDLNDAPHQTQREEESEEFCYSSPSKRVGSFSNSSSSAVVIEDGSDDDELNRVRPNNPLVTHQFFPEMDSNGGGVASGFPRAHWFGVKFCQSDLATGSSAGKATNVAAAVVEPAQPLKKSRRGPRSRSSQYRGVTFYRRTGRWESHIWDCGKQVYLGGFDTAHAAARAYDRAAIKFRGVEADINFNIDDYDDDLKQMTNLTKEEFVHVLRRQSTGFPRGSSKYRGVTLHKCGRWEARMGQFLGKKYVYLGLFDTEVEAARAYDKAAIKCNGKDAVTNFDPSIYDEELNAESSGNPTTPQDHNLDLSLGNSANSKHKSQDMRLRMNQQQQDSLHSNEVLGLGQTGMLNHTPNSNHQFPGSSNIGSGGGFSLFPAAENHRFDGRASTNQVLTNAAASSGFSPHHHNQIFNSTSTPHQNWLQTNGFQPPLMRPS

SEQ ID NO: 13482 - protein, 263 aa, Arabidopsis thaliana
  misc_feature: Ceres CLONE ID no. 26006
  misc_feature: Useful for making plants with modulated drought sensitivity
  misc_feature: Useful for making plants with modulated water use efficiency
MSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKFASSMTPEGWMGSELETYGSDNSGLSVFFSTDFMKHRLYQLSPVEDLELGLLLKRPSSLFINELSKMENFSEKGYGSVPRAYIVCKEDNIISEDHQRWMIHNYPANLVIEMEETDHMPMFCKPQVLSDHLLAIADNFS

SEQ ID NO: 13483 - protein, 273 aa, Arabidopsis thaliana
  misc_feature: Ceres SEEDLINE ID no. ME17567
  misc_feature: Useful for making plants with modulated nitrogen use efficiency
  misc_feature: Useful for making plants with modulated nitrogen use efficiency
MAFLLSNLSSPSIHLQTGKYPNLKPIFSQSLSSSSSVSYEFVEENLSTLSLLSIQSPPLKDTQVQTRHSSQDKHNNHDRDEFYINLGVAVRTLREDLPLLFTRDLNYDIYRDDITFVDPMNTFTGMDNYKIIFWALRFHGKILFRDISLEIFRVWQPSENMILIRWNLKGVPRVPWEAKGEFQGTSRYKLDRNGKIYEHKVDNLAFNFPQQLKPAASVLDLVTASPASSPNPTFFFSPVDSYSSSWVKFYQAVRGTLETEDMFVTTDCLVTCS

SEQ ID NO: 13484 - protein, 339 aa, Arabidopsis thaliana
  misc_feature: Ceres SEEDLINE ID no. ME11939
  misc_feature: Useful for making plants with modulated low light sensitivity
  misc_feature: Useful for making plants with modulated nitrogen use efficiency
MCSNKASPVVGEEKQSTRSSKRIKKRKNREATTTMEDKSSSNLDASRKIRTKTKKPKFLSLKLELNTSHEINENPRSKKSKKKNNNKKQSKKKEPDTTPFKEKKRAETTTTLGGGEKEEEQYDTVAAYLFNSATDSTISSIHDLLPSSAATDVDCGGERNNLSPYDRQDHGSSSSSLLRTAMRKGASEEEETTEERWVSYSEVVEEVMSRSGTPRCCGGGDGNDGRPSLALKLDYEQIMEAWSDKGTLYVDGEPPQTVPDLHASADGFNDGGEAGNLWAVPEMETTERLWRGHREASLLRYKEKRQNRLFSKRIRYQVRKLNAEKRPRVKGRFVKREDS

SEQ ID NO: 13485 - protein, 216 aa, Arabidopsis thaliana
  misc_feature: Ceres SEEDLINE ID no. ME15935
  misc_feature: Useful for making plants with modulated low light sensitivity
MNSFSAFSEMFGSDYESSVSSGGDYIPTLASSCPKKPAGRKKFRETRHPIYRGVRRRSSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 13486 - protein, 92 aa, Arabidopsis thaliana
  misc_feature: Ceres CLONE ID no. 34419
  misc_feature: Useful for making plants with modulated drought sensitivity
  misc_feature: Useful for making plants with modulated cold sensitivity
  misc_feature: Useful for making plants with modulated water use efficiency
MALFLSPKTITLLFFSLSLALYCSIDPFHTAPFPISPISSLTKLSLHVPTKFHGREIHKIHFRNQRFCFLTKSKVQRASPLILSDVVRTRRC

SEQ ID NO: 13487 - protein, 303 aa, Arabidopsis thaliana
  misc_feature: Ceres SEEDLINE ID no. ME11370
  misc_feature: Useful for making plants with altered protein content
MHALKDKVSQKLSNLFADSPSQSASPRYSNSDSPKARLNSSVGKSLSSYFSFVVPQSGNEEDSELCPPLPIRTESYECIENCKSANGQAKAGTFISIGEDKDCELRVSAKVEESGNDYFDGVKKMRELTESSVFITANLFEFLHASLPNIVRGCKWILLYSTLKHGISLRTLLRRSGELPGPCLLVAGDKQGAVFGALLECPLQPTPKRKYQGTSQTFLFTTIYGEPRIFRPTGANRYYLMCMNEFLAFGGGGNFALCLDEDLLKATSGPSETFGNECLASSTEFELKNVELWGFAHASQYLS

SEQ ID NO: 13488 - protein, 335 aa, Arabidopsis thaliana
  misc_feature: Ceres SEEDLINE ID no. ME11409
  misc_feature: Useful for making plants with altered protein content
MVNSYVPLRFTIFISFSIAAASSFKLHSASHSPSSFPKATGDDLLSVLGPPSAASCLNPIVSREIKSCLKFLVPFKSDKPKPEFGRCSPRTGLCSGKIDAVERRSKFEEENSLIWWPPESVLELARLAVDSGGDPGSIQRTLNPKMIPVPDVERSRKDKCQLTRTPYGRHFIAEEVNSYFEFLFHLIESRGPSVGLNVSLSRYDLFHGHLFLASESGRLGILFHAKEYPAYDKKVFPYNMGYCQRGSDVKYNDSMNLRNILWLAPLPSNSSPDWVAPGVLVVLDAHPDGIIYRDLIPDYVKFVRTIYEDDLGTTAVDVNYLNVGAHEPDYQLFMC

SEQ ID NO: 13489 - protein, 399 aa, Arabidopsis thaliana
  misc_feature: Ceres CLONE ID no. 151087
  misc_feature: Useful for making plants with modulated oxidative stress sensitivity
MATLFNKFQQAVGVLAKSTTFAKNPRQLQFEADVNKLFMYTSYNRLGREAEETDAEEIIEMAGKATLSEQQKQVQENIHYQVEKFCSLMDGILLPDVRRNESGSQSTSPRPPRRGGLTFAIGSNNAFPHADQPLVPETKPLKLADVSQRLMDQMGYTLEIKPSVIPHKDAGQGCFIKGEADVGTVLAFYPGVIYSPAFYRYIPGYPKVDSQNSYLITRYDGTVINAQPWGLGGESREAWNGSYTPAVKTNTKTAENGSDRLWKALSKPLEGSGKGKEVLERRNPLAFGHLANHPAKEMTPNVMICPYDFPLMAKDLRPYIPNISFGDSGEIKMKRFGSFWFKTGSKDGLEAPVLKTLVLVATRSLCNEELLLNYRLSNSKRRPDWYTPVNEEEDRRRWS

SEQ ID NO: 13490 - protein, 184 aa, Arabidopsis thaliana
  misc_feature: Ceres SEEDLINE ID no. ME03047
  misc_feature: Useful for making plants with modulated oxidative stress sensitivity
MQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 13491 - protein, 537 aa, Arabidopsis thaliana
  misc_feature: Ceres SEEDLINE ID no. SR01010
  misc_feature: Useful for making plants with modulated drought sensitivity
MGISKPLLLFSILVLYFSLYTITPTSSLASLQDQFINCVQRNTHVYFPLEKTFFAPTKNVSMFSQVLESTAQNLRFLKKSMPKPGFIFSPIHESHVQASIICSKKLRMHLRVRSGGHDYEGLSYVSQIDKPFILMDLSKMRQVNINIQDNSAWVQSGATVGELYYRIAEKSKVHGFPAGLCSSLGIGGHITGGAYGSMMRKYGLGADNVLDAKIVDANGKLLDRAAMGEDTFWAIRGGAGGSFGIILAWKIKLVPVPKTVTVFTVTKTLQQDVGNKIISKWQRVADKLVEELFIRVLFNVAGTGGNKTVTTSYNALFLGGKGTLMNVMKKSFPELGLTFKDCIEMSWLESIAYISGFPTHTPTNVLLQGKSPFPKVSFKAKSDFVKTPIPESGLQGIFKKLLKEDIPLMIWNPYGGMMAKIPESQIPFPHRKGVLFKVQYVTSWLDSDKRPSRHINWIRDLYSYMTPYVSSNPREAYVNYRDLDLGRNTKDVKTCIKQAQVWGANYFKNNFNRLMMIKAKVDPENFFRHEQSIPPMM

SEQ ID NO: 13492 - protein, 146 aa, Arabidopsis thaliana
  misc_feature: Ceres CLONE ID no. 250899
  misc_feature: Useful for making plants with modulated cold sensitivity
MSLKKRSCSRLRLTDLMEKWRKCKKGHFAVYTREGRRFVLPLDYLKHPIFQVLLEMAEEEFGSTICGPLQVPCDGGLMDHILMLLRNKSLSDHDDDGGDDGVKKTMNQDVSPMSTSCKGASSVSYFFPLFRCNAAHDQSKLQSLVF

SEQ ID NO: 13493 - protein, 174 aa, Arabidopsis thaliana
  misc_feature: Ceres SEEDLINE ID no. ME10870
  misc_feature: Useful for making plants with altered protein content
MLVGENCVHETYYEILSVKEDASYEEIRNSYRSAILHSHPDKLNNTSRSSSDDEKFLKIQKAWEVLSDAELRVVYDNDLRSSRHDGITADEISIEDMSVEITGDVIDLFYQCRCGDYFCVDSSELGTMGFALLRDGDFVYVKRLGAFVASVVLPCGSCSLKTRVWVDSDMKIPI

SEQ ID NO: 13494 - protein, 306 aa, Arabidopsis thaliana
  misc_feature: Ceres SEEDLINE ID no. ME11351
  misc_feature: Useful for making plants with altered protein content
MADKSSRSLILYGDGLARFVDPSNTNIHSLASVATCGFLSLPNAPPETENERIVREFSHLLDASEAYSIASGLKPKGNGNDISTLAERFMGLKAALVTDSSTLTSFGKLIGLDVLQLSEICQESDSFPSDATSSKLLKLLGFEGGKCLDVNLYDLVFVHFGVDEYNNGNNMGILDSLIGSIMGMAQPGSEILSRLHLSVVLSYGSVTDKDVSVFPIKTPQEDINPAFIGLVPRQSYTMRGEKTRDDVRHYCPMLVAQWQHGVTRKDLVDTLSFEALKKLCGNLVIPADRFIHEVAFKLWKAPKYGA

SEQ ID NO: 13495 - protein, 326 aa, Arabidopsis thaliana
  misc_feature: Ceres SEEDLINE ID no. SR01013
  misc_feature: Useful for making plants with modulated drought sensitivity
MSLTTVPTLAIRSGPSGHHSMPVLGFGTAASPLPEPTMLKETVIEAIKLGYRHFDTSPRYQTEEPIGEALAEAVSLGLVRSRSEFFVTTKLWCADAHGGLVVPAIKRSLKNLKLDYLDLYIIHWPVSSKPGKYKFPIDEDDFMPMDFEVVWSEMEECQRLGLAKCIGVSNFSCKKLQHILSIATIPPSVNQVEMSPIWQQRKLRELCRSNDIVVTAYSVLGSRGAFWGTPKIMESDVLKEIAEAKEKTVAQVSMRWAYEQGVSMVVKSFTKERLEENLKIFDWSLTEDETQRISTEIPQFRNVHGEVYTSKKGPIKSVAEMWDGEI

SEQ ID NO: 13496 - protein, 94 aa, Zea mays
  misc_feature: Ceres CLONE ID no. 208995
  misc_feature: Useful for making plants with modulated nitrogen use efficiency
MGSLGPTVSLSIMARPGGQQPAEMERKKDSGVFFGGGCGFRMPLHYPRYKKADYESMPEWRVDCLLREYGLPADGDVDSKRRFAMGAFLWPDQY

SEQ ID NO: 13497 - protein, 143 aa, Triticum aestivum
  misc_feature: Ceres CLONE ID no. 1017441
  misc_feature: Useful for making plants with modulated nitrogen use efficiency
MDEEAAKPRDTTINQQQQYYYGTFQGVANYPPPAPPPLPHQPIVTSPLLPPVHGYQTLQEYTVVEVRPVREHDVPCCGFGMGWFLFIMGFLFGGIPWYLGAVIILFTSVDHREKAGYVACSVASVVYLIAVMLGMAGNINIIW

SEQ ID NO: 13498 - protein, 680 aa, Arabidopsis thaliana
  misc_feature: Ceres SEEDLINE ID no. ME19971
  misc_feature: Useful for making plants with modulated light quality response
  misc_feature: Useful for making plants with modulated low light sensitivity
  misc_feature: Useful for making plants with modulated nitrogen use efficiency
MAAYFHGNPPEISAGSDGGLQTLILMNPTTYVQYTQQDNDSNNNNNSNNSNNNNTNTNTNNNNSSFVFLDSHAPQPNASQQFVGIPLSGHEAASITAADNISVLHGYPPRVQYSLYGSHQVDPTHQQAACETPRAQQGLSLTLSSQQQQQQQHHQQHQPIHVGFGSGHGEDIRVGSGSTGSGVTNGIANLVSSKYLKAAQELLDEVVNADSDDMNAKSQLFSSKKGSCGNDKPVGESSAGAGGEGSGGGAEAAGKRPVELGTAERQEIQMKKAKLSNMLHEVEQRYRQYHQQMQMVISSFEQAAGIGSAKSYTSLALKTISRQFRCLKEAIAGQIKAANKSLGEEDSVSGVGRFEGSRLKFVDHHLRQQRALQQLGMIQHPSNNAWRPQRGLPERAVSVLRAWLFEHFLHPYPKDSDKHMLAKQTGLTRSQVSNWFINARVRLWKPMVEEMYMEEMKEQAKNMGSMEKTPLDQSNEDSASKSTSNQEKSPMADTNYHMNPNHNGDLEGVTGMQGSPKRLRTSDETMMQPINADFSSNEKLTMKILEERQGIRSDGGYPFMGNFGQYQMDEMSRFDVVSDQELMAQRYSGNNNGVSLTLGLPHCDSLSSTHHQGFMQTHHGIPIGRRVKIGETEEYGPATINGGSSTTTAHSSAAAAAAYNGMNIQNQKRYVAQLLPDFVA

SEQ ID NO: 13499 - protein, 612 aa, Arabidopsis thaliana
  misc_feature: Ceres SEEDLINE ID no. ME12006
  misc_feature: Useful for making plants with modulated light quality response
  misc_feature: Useful for making plants with modulated light quality sensitivity
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 13500 - protein, 78 aa, Zea mays
  misc_feature: Ceres CLONE ID no. 210210
  misc_feature: Useful for making plants with modulated salt sensitivity
MGPRYITLCIFLVLVLHGDTTLAETCRQFVKWDPFCFSAMCKASCFIEGKSSDGSYVKGHRCESNGYHAVCVCFLCKN

SEQ ID NO: 13501 - protein, 310 aa, Arabidopsis thaliana
  misc_feature: Ceres CLONE ID no. 125039
  misc_feature: The plant is abnormally small.
  misc_feature: Useful for making plants with modulated biomass
  misc_feature: Useful for making plants with modulated heat sensitivity
MDVAAMARCVGRCYVSPAFGESESHRLSERRFLKLSSSTNSDPAGSKSLKLRGKIHRRMSYFRPIMAKDESISSRSGETKQINGKQKNIVWHDCPVTKSDRQELIKHKGCVIWITGLSGSGKSSLACALSRALHNRGKLSYILDGDNVRHGLNSDLSFEADDRAENIRRVGEVAKLFADSGIICIASLISPYRIERAACRALLPQGDFIEVFMDVPLHVCEARDPKGLYKRARAGKIKGFTGVDDPYEAPLDCEIVIQNSRDKGLSSSSSSSSSPSSSSSSLCEMADIVVSYLDQNGYLKKHSTKSRDCM

SEQ ID NO: 13502 - protein, 157 aa, Arabidopsis thaliana
  misc_feature: Ceres CLONE ID no. 31309
  misc_feature: Useful for making plants with modulated heat sensitivity
MAGTLVNSAGRFSPGNCILPQQRTARFYSGTARFPTGAPSFKASAQTLNAEPAVTESVRRRVSSLYELLKVNETASLTEIKTAYRSLAKVYHPDASESDGRDFMEIHKAYATLADPTTRAIYDSTLRVPRRRVHAGAMGRSGRVYATTRRWETDQCW

SEQ ID NO: 13503 - protein, 395 aa, Arabidopsis thaliana
  misc_feature: Ceres SEEDLINE ID no. ME18314
  misc_feature: Useful for making plants with modulated low light sensitivity
  misc_feature: Useful for making plants with modulated nitrogen use efficiency
MAVIIPRSDPPSRIHPEPPQTLEIDHFDHLPDSILLLVFNKIGDVKALGRCCVVSRRFHSLVPQVDNVVVRVDCVISDDDSSSLSSIKSRSGSSAGSFSAIFRLVVGGIVKPLQALGQFLGTKRSSSSCGGSGSSSSSLSISGDDDGGEIEQGGVTHHSPTQVLKNFDEIRYLRIELPSGELGIDDGVLLKWRAEFGSTLDNCVILGASSVIPPNPMRVSQACDTTTVVEAPGSGSDDNGSIPESFYTNGGLKLRVVWTISSLIAASARHYLLQPIIAEHKTLDSLVLTDSDGQGVLCMNRDQLEELRVKPLAASSASKRTLVPALNMRLWYAPTLELPDGTVLKGATLVAIRPSESKKEVSDISWVSSAFEEPYETAAKMLVKRRTYCLEMNSF

SEQ ID NO: 13504 - protein, 272 aa, Arabidopsis thaliana
  misc_feature: Ceres CLONE ID no. 23439
  misc_feature: Useful for making plants with altered sterol content
MDSLVESGWKYLVTHFSDFQLACIGSFILHESVFFLSGLPYIFLERTGFLSNYKIQTKSNTPEAQGKCIARLLLYHCCVNLPLMMASYPVFRFMGMESSFPLPSWKVVSAQILFYFIIEDFVFYWGHRILHTKWLYKNVHSVHHEYATPFGLTSEYAHPAEILFLGFATIVGPALTGPHLITLWLWMMLRVIETVEAHCGYHFPWSPSNFLPLYGGSLILMWESFAYSADFHDYHHRLLYTKSGNYSSTFVYMDWIFGTDKGYRKLKALKET

SEQ ID NO: 13505 - protein, 723 aa, Arabidopsis thaliana
  misc_feature: Ceres SEEDLINE ID no. ME21508
  misc_feature: Useful for making plants with modulated low light sensitivity
  misc_feature: Useful for making plants with modulated nitrogen use efficiency
MSNTVEDDDDDFQIPPSSQLSIRKPLHPTNANNISHRPPNKKPRLCRYPGKENVTPPPSPDPDLFCSSSTPHCILDCIPSSVDCSLGDFNGPISSLGEEDKEDKDDCIKVNREGYLCNSMEARLLKSRICLGFDSGIHEDDEGFVESNSELDVLINLCSESEGRSGEFSLGKDDSIQCPLCSMDISSLSEEQRQVHSNTCLDKSYNQPSEQDSLRKCENLSSLIKESIDDPVQLPQLVTDLSPVLKWLRSLGLAKYEDVFIREEIDWDTLQSLTEEDLLSIGITSLGPRKKIVNALSGVRDPFASSAEVQAQSHCTSGHVTERQRDKSTTRKASEPKKPTANKLITEFFPGQATEGTKIRTAPKPVAEKSPSDSSSRRAVRRNGNNGKSKVIPHWNCIPGTPFRVDAFKYLTRDCCHWFLTHFHLDHYQGLTKSFSHGKIYCSLVTAKLVNMKIGIPWERLQVLDLGQKVNISGIDVTCFDANHCPGSIMILFEPANGKAVLHTGDFRYSEEMSNWLIGSHISSLILDTTYCNPQYDFPKQEAVIQFVVEAIQAEAFNPKTLFLIGSYTIGKERLFLEVARVLREKIYINPAKLKLLECLGFSKDDIQWFTVKEEESHIHVVPLWTLASFKRLKHVANRYTNRYSLIVAFSPTGWTSGKTKKKSPGRRLQQGTIIRYEVPYSEHSSFTELKEFVQKVSPEVIIPSVNNDGPDSAAAMVSLLVT

SEQ ID NO: 13506 - protein, 164 aa, Arabidopsis thaliana
  misc_feature: Ceres SEEDLINE ID no. ME12596
  misc_feature: Useful for making plants with modulated light quality response
  misc_feature: Useful for making plants with modulated light quality sensitivity
MERSASVGVNDGRFGGNQFYSPSFSSSSSSSSMRHVNYSCGSCGYELNLSSTNRITSTIGSKYGKSMKSGIISFFNIDEGRFSQVDEFQCMPHFSRYSWGLFRHRTKLLCRKCNNYIGNASQEKAPEYALVTQNSDPTSPRIGSVTKYDIRIRSLQPSSAVALL

SEQ ID NO: 13507 - protein, 98 aa, Zea mays
  misc_feature: Ceres CLONE ID no. 296789
  misc_feature: Useful for making plants with modulated salt sensitivity
MMRNKDAKLKDLEISTVDGFQGREKEAIIISMVRSNSKKEVGFLSDHRRMNVAVTRARRQCCLVCDVETVSSDRFLKRLVEYFEENGEYLSASEYQSS

SEQ ID NO: 13508 - protein, 280 aa, Arabidopsis thaliana
  misc_feature: Ceres CLONE ID no. 39378
  misc_feature: Useful for making plants with altered sterol content
MSGSSSPSLWLAPNPSKRWGELFFLFYTPFWLTLCLGIVVPYKLYETFTELEYLLLALVSAVPAFVIPMLLVGKADRSLCWKDRYWVKANLWIIVFSYVGNYFWTHYFFKVLGASYTFPSWKMNNVPHTTFFLTHVCFLFYHVASNITLRRLRHSTADLPDSLKWCFEAAWILALSYFIAYLETIAIANFPYYEFVDRSAMYRVGCLFYAIYFIVSFPMFFRMDEKSTDEWDLSRVAVDTLGAAMLVTIILDLWRLFLGPIVPLPEGQNCLQSGLPWFSN

SEQ ID NO: 13509 - protein, 223 aa, Arabidopsis thaliana
  misc_feature: Ceres CLONE ID no. 2121
  misc_feature: Useful for making plants with altered sterol content
  misc_feature: Useful for making plants with modulated nitrogen use efficiency
MKELAHPYVPRDLNLPGYVPISMSMSSIVSIYLGSSLLVVSLVWLLFGRKKAKLDKLLMCWWTFTGLTHVILEGYFVFSPEFFKDNTSAYLAEVWKEYSKGDSRYVGRDSAVVSVEGITAVIVGPASLLAIYAIAKEKSYSYVLQLAISVCQLYGCLVYFITAILEGDNFATNSFYYYSYYIGANCWWVLIPSLISFRCWKKICAAAAIANNNVETKTKKKTR

SEQ ID NO: 13510 - protein, 267 aa, Arabidopsis thaliana
  misc_feature: Ceres CLONE ID no. 123905
  misc_feature: Abnormal phyllotaxy, leaf number higher than wild-type
  misc_feature: No seed is being produced by the plant
  misc_feature: The plant flowers significantly late compared to wild-type.
  misc_feature: The plant is abnormally small.
  misc_feature: The plant produces a reduced number of seeds.
  misc_feature: Useful for biocontainment applications
  misc_feature: Useful for making plants with altered terpenoid content
  misc_feature: Useful for making plants with modulated biomass
  misc_feature: Useful for making plants with modulated flowering time
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGANASASASVSATDSVEAEQWNGGGGDCNMEWMNMMMMMDFGNGDSSDSGNTIADMFQ

SEQ ID NO: 13511 - protein, 555 aa, Arabidopsis thaliana
  misc_feature: Ceres CLONE ID no. 159499
  misc_feature: Useful for making plants with modulated biomass
  misc_feature: Useful for making plants with altered lignin content
MKSFCDNDDNNHSNTTNLLGFSLSSNMMKMGGRGGREAIYSSSTSSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 13512 - protein, 362 aa, Arabidopsis thaliana
  misc_feature: Ceres CLONE ID no. 2173498
  misc_feature: Useful for making plants with modulated biomass
MDNFLPFPSSNANSVQELSMDPNNNRSHFTTVPTYDHHQAQPHHFLPPFSYPVEQMAAVMNPQPVYLSECYPQIPVTQTGSEFGSLVGNPCLWQERGGFLDPRMTKMARINRKNAMMRSRNNSSPNSSPSELVDSKRQLMMLNLKNNVQISDKKDSYQQSTFDNKKLRVLCEKELKNSDVGSLGRIVLPKRDAEANLPKLSDKEGIVVQMRDVFSMQSWSFKYKFWSNNKSRMYVLENTGEFVKQNGAEIGDFLTIYEDESKNLYFAMNGNSGKQNEGRENESRERNHYEEAMLDYIPRDEEEASIAMLIGNLNDHYPIPNDLMDLTTDLQHHQATSSMTPEDHAYVGSSDDQVSFNDFEWW

SEQ ID NO: 13513 - protein, 369 aa, Arabidopsis thaliana
  misc_feature: Ceres CLONE ID no. 1150438
  misc_feature: Useful for biocontainment applications
  misc_feature: Useful for making plants with modulated seed size
MSKITLGNESIVGSLTPSNKKSYKVTNRIQEGKKPLYAVVFNFLDARFFDVFVTAGGNRITLYNCLGDGAISALQSYADEDKEESFYTVSWACGVNGNPYVAAGGVKGIIRVIDVNSETIHKSLVGHGDSVNEIRTQPLKPQLVITASKDESVRLWNVETGICILIFAGAGGHRYEVLSVDFHPSDIYRFASCGMDTTIKIWSMKEFWTYVEKSFTWTDDPSKFPTKFVQFPVFTASIHTNYVDCNRWFGDFILSKSVDNEILLWEPQLKENSPGEGASDVLLRYPVPMCDIWFIKFSCDLHLSSVAIGNQEGKVYVWDLKSCPPVLITKLSHNQSKSVIRQTAMSVDGSTILACCEDGTIWRWDVITK

SEQ ID NO: 13514 - protein, 104 aa, Arabidopsis thaliana
  misc_feature: Ceres CLONE ID no. 8381
  misc_feature: Useful for making plants with modulated drought sensitivity
  misc_feature: Useful for making plants with modulated water use efficiency
MAARSLSGAVKSLCSAASGSLSCSIVLRRSYVATSQNVTAAGLSKGGSTRVMVGKMEQRGLDQEAESAWGPDPVTGYYRPSNRAAEIDPAELRELLLKNKAKSF

SEQ ID NO: 13515 - protein, 174 aa, Glycine max
  misc_feature: Ceres CLONE ID no. 625627
  misc_feature: Useful for making plants with altered sugar content
  misc_feature: Useful for making plants with altered terpenoid content
  misc_feature: Useful for making plants with modulated cold sensitivity
MTTAEKTSNLDLIRQHLFGENIISDSSSFVSNLHHHPVKLEPPSSPEFDFTSYILDNNTSSNFFTFLEGYDLVADMKFVIDSDNTTTMVIPSKEVIKKCNINSPEEQPMVSSSSEEKPTMKKSEHYDEAKRYRGVRRRPWGKFAAEIRDPTRKGTRVTRRSSSSNASLPASPLR

SEQ ID NO: 13516 - protein, 689 aa, Arabidopsis thaliana
  misc_feature: Ceres CDNA ID no. 4961450
  misc_feature: Useful for biocontainment applications
  misc_feature: Useful for making plants with modulated endosperm cell number
  misc_feature: Useful for making plants with modulated endosperm cell size
  misc_feature: Useful for making plants with modulated seed size
  misc_feature: Useful for making plants with modulated seed content
MEKENHEDDGEGLPPELNQIKEQIEKERFLHIKRKFELRYIPSVATHASHHQSFDLNQPAAEDDNGGDNKSLLSRMQNPLRHFSASSDYNSYEDQGYVLDEDQDYALEEDVPLFLDEDVPLLPSVKLPIVEKLPRSITWVFTKSSQLMAESDSVIGKRQIYYLNGEALELSSEEDEEDEEEDEEEIKKEKCEFSEDVDRFIWTVGQDYGLDDLVVRRALAKYLEVDVSDILERYNELKLKNDGTAGEASDLTSKTITTAFQDFADRRHCRRCMIFDCHMHEKYEPESRSSEDKSSLFEDEDRQPCSEHCYLKVRSVTEADHVMDNDNSISNKIVVSDPNNTMWTPVEKDLYLKGIEIFGRNSCDVALNILRGLKTCLEIYNYMREQDQCTMSLDLNKTTQRHNQVTKKVSRKSSRSVRKKSRLRKYARYPPALKKTTSGEAKFYKHYTPCTCKSKCGQQCPCLTHENCCEKYCGCSKDCNNRFGGCNCAIGQCTNRQCPCFAANRECDPDLCRSCPLSCGDGTLGETPVQIQCKNMQFLLQTNKKILIGKSDVHGWGAFTWDSLKKNEYLGEYTGELITHDEANERGRIEDRIGSSYLFTLNDQLEIDARRKGNEFKFLNHSARPNCYAKLMIVRGDQRIGLFAERAIEEGEELFFDYCYGPEHADWSRGREPRKTGASKRSKEARPAR

SEQ ID NO: 13517 - protein, 130 aa, Arabidopsis thaliana
  misc_feature: Ceres CLONE ID no. 17584
  misc_feature: Useful for making plants with altered glycerol content
MASPKSPTRPTQQNPQPNFHDFLPTMAGNLGGEGLIGELCNGFELLMDREKGVITFESLRRNAAAVLGLGDLTDEDVRCMIKEGDFDCDGALNQMEFCVLMFRLSPDLMEASRCLVTEVIEEEFGFTRRH

SEQ ID NO: 13518 - protein, 159 aa, Arabidopsis thaliana
  misc_feature: Ceres CLONE ID no. 31252
  misc_feature: Useful for making plants with altered sterol content
  misc_feature: Useful for making plants with altered terpenoid content
MKRIVRISFTDMEATDSSSSEDESPPSSRRRGKKLVKEIVIDHSDPPEVGKTRFKIRIPASLLAARNTTANKKKFRGVRQRPWGKWAAEIRCGRVKGRPERIWLGTFETAEEAALAYDNAAIQLIGPDAPTNFGRPDVDSAVVKKQDSDASGGASEEVV

SEQ ID NO: 13519 - protein, 1729 aa, Arabidopsis thaliana
  misc_feature: Ceres CDNA ID no. 11034997
  misc_feature: Useful for making plants with modulated endosperm cell number
  misc_feature: Useful for making plants with modulated endosperm cell size
  misc_feature: Useful for making plants with modulated seed quality
MQSIMDSSAVNATEATEQNDGSRQDVLEFDLNKTPQQKPSKRKRKFMPKVVVEGKPKRKPRKPAELPKVVVEGKPKRKPRKAATQEKVKSKETGSAKKKNLKESATKKPANVGDMSNKSPEVTLKSCRKALNFDLENPGDARQGDSESEIVQNSSGANSFSEIRDAIGGTNGSFLDSVSQIDKTNGLGAMNQPLEVSMGNQPDKLSTGAKLARDQQPDLLTRNQQCQFPVATQNTQFPMENQQAWLQMKNQLIGFPFGNQQPRMTIRNQQPCLAMGNQQPMYLIGTPRPALVSGNQQLGGPQGNKRPIFLNHQTCLPAGNQLYGSPTDMHQLVMSTGGQQHGLLIKNQQPGSLIRGQQPCVPLIDQQPATPKGFTHLNQMVATSMSSPGLRPHSQSQVPTTYLHVESVSRILNGTTGTCQRSRAPAYDSLQQDIHQGNKYILSHEISNGNGCKKALPQNSSLPTPIMAKLEEARGSKRQYHRAMGQTEKHDLNLAQQIAQSQDVERHNSSTCVEYLDAAKKTKIQKVVQENLHGMPPEVIEIEDDPTDGARKGKNTASISKGASKGNSSPVKKTAEKEKCIVPKTPAKKGRAGRKKSVPPPAHASEIQLWQPTPPKTPLSRSKPKGKGRKSIQDSGKARGPSGELLCQDSIAEIIYRMQNLYLGDKEREQEQNAMVLYKGDGALVPYESKKRKPRPKVDIDDETTRIWNLLMGKGDEKEGDEEKDKKKEKWWEEERRVFRGRADSFIARMHLVQGDRRFSPWKGSVVDSVIGVFLTQNVSDHLSSSAFMSLAARFPPKLSSSREDERNVRSVVVEDPEGCILNLNEIPSWQEKVQHPSDMEVSGVDSGSKEQLRDCSNSGIERFNFLEKSIQNLEEEVLSSQDSFDPAIFQSCGRVGSCSCSKSDAEFPTTRCETKTVSGTSQSVQTGSPNLSDEICLQGNERPHLYEGSGDVQKQETTNVAQKKPDLEKTMNWKDSVCFGQPRNDTNWQTTPSSSYEQCATRQPHVLDIEDFGMQGEGLGYSWMSISPRVDRVKNKNVPRRFFRQGGSVPREFTGQIIPSTPHELPGMGLSGSSSAVQEHQDDTQHNQQDEMNKASHLQKTFLDLLNSSEECLTRQSSTKQNITDGCLPRDRTAEDVVDPLSNNSSLQNILVESNSSNKEQTAVEYKETNATILREMKGTLADGKKPTSQWDSLRKDVEGNEGRQERNKNNMDSIDYEAIRRASISEISEAIKERGMNNMLAVRIKDFLERIVKDHGGIDLEWLRESPPDKAKDYLLSIRGLGLKSVECVRLLTLHNLAFPVDTNVGRIAVRMGWVPLQPLPESLQLHLLELYPVLESIQKFLWPRLCKLDQRTLYELHYQLITFGKVFCTKSRPNCNACPMRGECRHFASAYASARLALPAPEERSLTSATIPVPPESYPPVAIPMIELPLPLEKSLASGAPSNRENCEPIIEEPASPGQECTEITESDIEDAYYNEDPDEIPTIKLNIEQFGMTLREHMERNMELQEGDMSKALVALHPTTTSIPTPKLKNISRLRTEHQVYELPDSHRLLDGMDKREPDDPSPYLLAIWTPGETANSAQPPEQKCGGKASGKMCFDETCSECNSLREANSQTVRGTLLIPCRTAMRGSFPLNGTYFQVNELFADHESSLKPIDVPRDWIWDLPRRTVYFGTSVTSIFRGLSTEQIQFCFWKGFVCVRGFEQKTRAPRPLMARLHFPASKLKNNKT

SEQ ID NO: 13520 - protein, 78 aa, Arabidopsis thaliana
  misc_feature: Ceres CLONE ID no. 30469
  misc_feature: Useful for making plants with modulated cold sensitivity
  misc_feature: Useful for making plants with modulated salt sensitivity
MESEGKIVFTEEQEALVVKSWSVMKKNSAELGLKLFIKIFEIAPTTKKMFSFLRDSPIPAEQNPKLKPHAMSVFVMYN

SEQ ID NO: 13521 - protein, 33 aa, Arabidopsis thaliana
  misc_feature: Ceres CLONE ID no. 2403
  misc_feature: Useful for making plants with modulated cold sensitivity
MQIFVKTLTGKTITLEVESSDTIDNVKAKIQDK

SEQ ID NO: 13522 - protein, 329 aa, Arabidopsis thaliana
  misc_feature: Ceres CLONE ID no. 34553
  misc_feature: Useful for making plants with altered carotene content
MAQLPPKIPTMTTPNWPDFSSQKLPSIAATAAAAATAGPQQQNPSWMDEFLDFSATRRGTHRRSISDSIAFLEPPSSGVGNHHFDRFDDEQFMSMFNDDVHNNNHNHHHHHSINGNVGPTRSSSNTSTPSDHNSLSDDDNNKEAPPSDHDHHMDNNVANQNNAAGNNYNESDEVQSQCKTEPQDGPSANQNSGGSSGNRIHDPKRVKRILANRQSAQRSRVRKLQYISELERSVTSLQTEVSVLSPRVAFLDHQRLLLNVDNSAIKQRIAALAQDKIFKDAHQEALKREIERLRQVYHQQSLKKMENNVSDQSPADIKPSVEKEQLLNV

SEQ ID NO: 13523 - protein, 1534 aa, Arabidopsis thaliana
  misc_feature: Ceres CDNA ID no. 7087648
  misc_feature: Useful for making plants with modulated endosperm cell number
  misc_feature: Useful for making plants with modulated endosperm cell size
  misc_feature: Useful for making plants with modulated seed quality
MVENGAKAAKRKKRPLPEIQEVEDVPRTRRPRRAAACTSFKEKSIRVCEKSATIEVKKQQIVEEEFLALRLTALETDVEDRPTRRLNDFVLFDSDGVPQPLEMLEIHDIFVSGAILPSDVCTDKEKEKGVRCTSFGRVEHWSISGYEDGSPVIWISTELADYDCRKPAASYRKVYDYFYEKARASVAVYKKLSKSSGGDPDIGLEELLAAVVRSMSSGSKYFSSGAAIIDFVISQGDFIYNQLAGLDETAKKHESSYVEIPVLVALREKSSKIDKPLQRERNPSNGVRIKEVSQVAESEALTSDQLVDGTDDDRRYAILLQDEENRKSMQQPRKNSSSGSASNMFYIKINEDEIANDYPLPSYYKTSEEETDELILYDASYEVQSEHLPHRMLHNWALYNSDLRFISLELLPMKQCDDIDVNIFGSGVVTDDNGSWISLNDPDSGSQSHDPDGMCIFLSQIKEWMIEFGSDDIISISIRTDVAWYRLGKPSKLYAPWWKPVLKTARVGISILTFLRVESRVARLSFADVTKRLSGLQANDKAYISSDPLAVERYLVVHGQIILQLFAVYPDDNVKRCPFVVGLASKLEDRHHTKWIIKKKKISLKELNLNPRAGMAPVASKRKAMQATTTRLVNRIWGEFYSNYSPEDPLQATAAENGEDEVEEEGGNGEEEVEEEGENGLTEDTVPEPVEVQKPHTPKKIRGSSGKREIKWDGESLGKTSAGEPLYQQALVGGEMVAVGGAVTLEVDDPDEMPAIYFVEYMFESTDHCKMLHGRFLQRGSMTVLGNAANERELFLTNECMTTQLKDIKGVASFEIRSRPWGHQYRKKNITADKLDWARALERKVKDLPTEYYCKSLYSPERGGFFSLPLSDIGRSSGFCTSCKIREDEEKRSTIKLNVSKTGFFINGIEYSVEDFVYVNPDSIGGLKEGSKTSFKSGRNIGLRAYVVCQLLEIVPKESRKADLGSFDVKVRRFYRPEDVSAEKAYASDIQELYFSQDTVVLPPGALEGKCEVRKKSDMPLSREYPISDHIFFCDLFFDTSKGSLKQLPANMKPKFSTIKDDTLLRKKKGKGVESEIESEIVKPVEPPKEIRLATLDIFAGCGGLSHGLKKAGVSDAKWAIEYEEPAGQAFKQNHPESTVFVDNCNVILRAIMEKGGDQDDCVSTTEANELAAKLTEEQKSTLPLPGQVDFINGGPPCQGFSGMNRFNQSSWSKVQCEMILAFLSFADYFRPRYFLLENVRTFVSFNKGQTFQLTLASLLEMGYQVRFGILEAGAYGVSQSRKRAFIWAAAPEEVLPEWPEPMHVFGVPKLKISLSQGLHYAAVRSTALGAPFRPITVRDTIGDLPSVENGDSRTNKEYKEVAVSWFQKEIRGNTIALTDHICKAMNELNLIRCKLIPTRPGADWHDLPKRKVTLSDGRVEEMIPFCLPNTAERHNGWKGLYGRLDWQGNFPTSVTDPQPMGKVGMCFHPEQHRILTVRECARSQGFPDSYEFAGNINHKHRQIGNAVPPPLAFALGRKLKEALHLKKSPQHQP

SEQ ID NO: 13524 - protein, 256 aa, Zea mays
  misc_feature: Ceres CLONE ID no. 241491
  misc_feature: Useful for making plants with modulated flowering time
MGRGRVELKRIENKINRQVTFSKRRNGLLKKAYELSVLCDAEVALIIFSGRGKLYEFGSAGVTKTLERYQHFCYNAQDSNNGALSESQSWYQEISKLRAKFEALQRTQRHLLGEDLGPLSTVKELQQLEKQLECALSQARQRKTQLMMEQVEELRRTERHLGEMNRQLKHKLEAEGCSNYTTLQHAACWPAPGGTIVEHDGATYQVHPPAHSVAMDCEPTLQIGYPHHQFPPPEAANNIPRSAATGENNFMLGWVL

SEQ ID NO: 13525 - protein, 251 aa, Zea mays
  misc_feature: Ceres CLONE ID no. 246416
  misc_feature: Useful for making plants with altered alkaloid content
  misc_feature: Useful for making plants with modulated flowering time
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVK

SEQ ID NO: 13526 - protein, 137 aa, Arabidopsis thaliana
  misc_feature: Ceres CLONE ID no. 15450
  misc_feature: Useful for making plants with modulated drought sensitivity
  misc_feature: Useful for making plants with modulated water use efficiency
MADSTKAGLKKPAFTKVDQLRPGTSGHNVNVKIVSTKMVLQKGRADGPQARQLRISECIVGDETGVIVFTARNDQVDLMKEGSTVTLRNAKIDMYKGSMRLAVDKWGRVEVTEPASFKVKEDTNMSLIEYELVNVVE

SEQ ID NO: 13527 - protein, 275 aa, Arabidopsis thaliana
  misc_feature: Ceres CLONE ID no. 26369
  misc_feature: Useful for making plants with modulated biomass
  misc_feature: Useful for making plants with modulated drought sensitivity
  misc_feature: Useful for making plants with modulated phosphate use efficiency
MATTTAAAAGIFGIRIQDPRPGTGRVQARFGFSFGKKKPAPPPKKSRQVQDDGDRLVWFPGANPPEWLDGSMIGDRGFDPFGLGKPAEYLQYDFDGLDQNLAKNVAGDIIGIIQESSEIKPTPFQPYTEVFGIQRFRECELIHGRWAMLGTLGAIAVEALTGIAWQDAGKVELVEGSSYLGQPLPFSLTTLIWIEVLVVGYIELQRNSELDPEKRIYPGGYFDPLGLAADPGKLDTLKLAEIKHSRLAMVAFLIFALQAAFTGKGPVSFLATFNN

SEQ ID NO: 13528 - protein, 256 aa, Arabidopsis thaliana
  misc_feature: Ceres CLONE ID no. 1010174
  misc_feature: No seed is being produced by the plant
  misc_feature: The plant flowers significantly earllier than wild-type.
  misc_feature: The plant flowers significantly late compared to wild-type.
  misc_feature: The plant is abnormally small.
  misc_feature: The plant is abnormally small.
  misc_feature: The plant produces a reduced number of seeds.
  misc_feature: Useful for biocontainment applications
  misc_feature: Useful for making plants with altered Lignin content
  misc_feature: Useful for making plants with altered alkaloid content
  misc_feature: Useful for making plants with modulated biomass
  misc_feature: Useful for making plants with modulated biomass
  misc_feature: Useful for making plants with modulated flowering time
  misc_feature: Useful for making plants with modulated flowering time
MLFPHERKKEKERSQGFYLVTRLRIRMGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 13529 - protein, 442 aa, Arabidopsis thaliana
  misc_feature: Ceres SEEDLINE ID no. ME06182
  misc_feature: Useful for making plants with altered carbon content
  misc_feature: Useful for making plants with altered nitrogen content
  misc_feature: Useful for making plants with modulated nitrogen use efficiency
  misc_feature: Useful for making plants with modulated carbon-nitrogen partitioning
MTATEAKNRKINVGDGDDVVDIEIPDTAHQISSDSWFQVAFVLTTGINSAYVLGYSGTIMVPLGWIGGVVGLLIATAISLYANTLIAKLHEFGGRRHIRYRDLAGFIYGRKAYHLTWGLQYVNLFMINCGFIILAGSALKAVYVLFRDDHTMKLPHFIAIAGLICAIFAIGIPHLSALGVWLGVSTFLSLIYIVVAIVLSVRDGVKTPSRDYEIQGSSLSKLFTITGAAANLVFAFNTGMLPEIQATVRQPVVKNMMKALYFQFTAGVLPMYAVTFIGYWAYGSSTSTYLLNSVNGPLWVKALANVSAILQSVISLHIFASPTYEYMDTKYGIKGNPFAIKNLLFRIMARGGYIAVSTLISALLPFLGDFMSLTGAVSTFPLTFILANHMYYKAKNNKLNAMQKLWHWLNVVFFSLMSVAAAIAAVRLIAVDSKNFHVFADL

SEQ ID NO: 13530 - protein, 255 aa, Arabidopsis thaliana
  misc_feature: Ceres SEEDLINE ID no. ME09546
  misc_feature: The plant is abnormally small.
  misc_feature: Useful for making plants with modulated biomass
MAGRSSPGKCSTWLDLNREETVEKNNEEESSVEDEDQITNNVRQYIRSNMPRLRWTPDLHLSFVRAVQRLGGPDRATPKLVLEMMNLKGLSIAHVKSHLQMYRSKKLEPSSRPGFGAFMSGQRSYLMDMIDSRCIPHSDLRHAYNSKTVPSRVLNQDAVVTNLGGNFLMRPSSWFSGLCRNDRDSTENKTLPLLEIRKKNNEKRVRDEEVSSVKRLKSMSGGGIQLPEFGNCRQKPTDDINTMLSLSLLSTSSEP

SEQ ID NO: 13531 - protein, 368 aa, Arabidopsis thaliana
  misc_feature: Ceres SEEDLINE ID no. ME09881
  misc_feature: The plant is abnormally small.
  misc_feature: Useful for making plants with modulated biomass
MCAKKEEEEEEEEDSSEAMNNIQNYQNDLFFHQLISHHHHHHHDPSQSETLGASGNVGSGFTIFSQDSVSPIWSLPPPTSIQPPFDQFPPPSSSPASFYGSFFNRSRAHHQGLQFGYEGFGGATSAAHHHHEQLRILSEALGPVVQAGSGPFGLQAELGKMTAQEIMDAKALAASKSHSEAERRRRERINNHLAKLRSILPNTTKTDKASLLAEVIQHVKELKRETSVISETNLVPTESDELTVAFTEEEETGDGRFVIKASLCCEDRSDLLPDMIKTLKAMRLKTLKAEITTVGGRVKNVLFVTGEESSGEEVEEEYCIGTIEEALKAVMEKSNVEESSSSGNAKRQRMSSHNTITIVEQQQQYNQR

SEQ ID NO: 13532 - protein, 280 aa, Arabidopsis thaliana
  misc_feature: Ceres SEEDLINE ID no. ME10335
  misc_feature: The plant produces a reduced number of seeds.
  misc_feature: The plant senesces significantly earlier than wild-type.
  misc_feature: Useful for biocontainment applications
  misc_feature: Useful for making plants with modulated time to senescence
MEKKKAMQIEGYPIEGLSIGGHETCIIFPSLRIAFDIGRCPHRAISQDFLFISHSHMDHIGGLPMYVATRGLYKMKPPTIIVPASIKETVESLFEVHRKLDSSELKHNLVGLDIGEEFIIRKDLKVKAFKTFHVIQSQGYVVYSTKYKLKKEYIGLSGNEIKNLKVSGVEITDSIITPEVAFTGDTTSDFVVDETNADALKAKVLVMESTFLDDSVSVEHARDYGHIHISEIVNHAEKFENKAILLIHFSARYTVKEIEDAVSALPPPLEGRVFALTQGF

SEQ ID NO: 13533 - protein, 244 aa, Arabidopsis thaliana
  misc_feature: Ceres SEEDLINE ID no. ME10988
  misc_feature: The plant flowers significantly late compared to wild-type.
  misc_feature: Useful for making plants with modulated flowering time
MEELDFSSKTTTSRLKLFGFSVDGEEDFSDQSVKTNLSSVSPERGEFPAGSSGRSGGGVRSRGGGGGGGERKYECQYCCREFGNSQALGGHQNAHKKERQQLKRAQLQATRNAAANFSNAGSASQFLRNPIVSAFAPPPHLLSSSAVPQPMGGPWMYLPRVSPSQLHVSHGCVIQDGSGGAGAGGFSYEYGARDSGFGVVGAQMRHVQAHGPRPSVNGFSREVGTTFDDGLGLDLHLSLAPAGH

SEQ ID NO: 13534 - protein, 328 aa, Arabidopsis thaliana
  misc_feature: Ceres SEEDLINE ID no. ME11116
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MEKALRNFTESTHSPDPNPLTKFFTEPTASPVSRNRKLSSKDTTVTIAGAGSSTTRYRGVRRRPWGRYAAEIRDPMSKERRWLGTFDTAEQAACAYDSAARAFRGAKARTNFTYPTAVIMPEPRFSFSNKKSSPSARCPLPSLPLDSSTQNFYGAPAAQRIYNTQSIFLRDASCSSRKTTPYNNSFNGSSSSYSASKTACVSYSENENNESFFPEESSDTGLLQEVVQEFLKKNRGVPPSPPTPPPVTSHHDNSGYFSNLTIYSENMVQETKETLSSKLDRYGNFQANDDGVRAVADGGLSLGSNEWGYQEMLMYGTQLGCTCRRSWG

SEQ ID NO: 13535 - protein, 334 aa, Arabidopsis thaliana
  misc_feature: Ceres SEEDLINE ID no. ME11122
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MESLINPSHGGGNYDSHSSSLDSLKPSVLVIILILLMTLLISVSICFLLRCLNRCSHRSVLPLSSSSSVATVTSDSRRFSGHRVSPETERSSVLDSLPIFKFSSVTRRSSSMNSGDCAVCLSKFEPEDQLRLLPLCCHAFHADCIDIWLVSNQTCPLCRSPLFASESDLMKSLAVVGSNNGGGENSFRLEIGSISRRRQTPIPESVEQHRTYSIGSFDYIVDDVDSEISESNFNRGKQEDATTTTATATAVTTNPTSFEASLAADIGNDGSRSWLKDYVDRLSRGISSRAMSFRSSGRFFTGSSRRSEELTVMDLEANHAGEEISELFRWLSGV

SEQ ID NO: 13536 - protein, 518 aa, Arabidopsis thaliana
  misc_feature: Ceres SEEDLINE ID no. ME11543
  misc_feature: The plant is abnormally small.
  misc_feature: Useful for making plants with modulated biomass
MEEEDPTASNVITNSNSSSMRNLSPAMNTPVVSLESRINRLINANQSQSPSPSSLSRSIYSDRFIPSRSGSNFALFDLSPSPSKDGKEDGAGSYATLLRAAMFGPETPEKRDITGFSSSRNIFRFKTETHRSLNSFSPFGVDDDSPGVSHSGPVKAPRKVPRSPYKILDLVDFRSLVSIMHETICDLCDVLVSEGLEFESEVLDAPALQDDFYLNLVDWSAQNVLAVGLGNCVYLWNACSSKVTKLCDLGAEDSVCSVGWALRGTHLAVGTSTGKVQIWDASRCKRTRTMEGHRLRVGALAWGSSVLSSGSRDKSILQRDIRCQEDHVSKLAGHKSEVCGLKWSYDNRELASGGNDNRLFVWNQHSTQPVLKYSEHTAAVKAIAWSPHVHGLLASGGGTADRCIRFWNTTTNTHLSSIDTCSQVCNLAWSKNVNELVSTHGYSQNQIIVWKYPTMSKIATLTGHTYRVLYLAVSPDGQTIVTGAGDETLRFWNVFPSPKSQNTDSEIGSSFFGRTTIR

SEQ ID NO: 13537 - protein, 209 aa, Arabidopsis thaliana
  misc_feature: Ceres SEEDLINE ID no. ME11780
  misc_feature: The plant flowers significantly late compared to wild-type.
  misc_feature: Useful for making plants with modulated flowering time
MENGKRDRQDMEVNTTPRKPRVLLAASGSVAAIKFGNLCHCFTEWAEVRAVVTKSSLHFLDKLSLPQEVTLYTDEDEWSSWNKIGDPVLHIELRRWADVLVIAPLSANTLGKIAGGLCDNLLTCIIRAWDYTKPLFVAPAMNTLMWNNPFTERHLLSLDELGITLIPPIKKRLACGDYGNGAMAEPSLIYSTVRLFWESQAHQQTGGTS

SEQ ID NO: 13538 - protein, 361 aa, Arabidopsis thaliana
  misc_feature: Ceres SEEDLINE ID no. ME12040
  misc_feature: The plant produces a reduced number of seeds.
  misc_feature: Useful for biocontainment applications
MLQLVVVAWLLIFTAETVVPHQESGEWSCESDSEIQVLADFRPGIITLDGHNDDWKDIDGSEFPLRPALDPDSDHEYDAGKMTVKALHDGRDIYFLLEIDGNYAYDKGENNKCPSVALMFQIGDQATYHNMGGCKEGTDSCTSKACRGFEVDIMHFSIGNAIPGRLYGGNPIDNGEGNGGDRFGHLVDIYAWNPHCRYLDGLGPSGNDSSAQNDWHGAWWHSSFTTLSGYVEEDSPYTPDGKKGTYYFEFSRPLRTMDRLQQDVQFTLGSPAKMSVAFWYPVDSKPWHGSGHYTINCDWTPLDISSGSSSGLTASTVKGSSDGASITAILLSMISLVFSGFIAYRLFSPRNVPFTPMENNL

SEQ ID NO: 13539 - protein, 351 aa, Arabidopsis thaliana
  misc_feature: Ceres SEEDLINE ID no. ME12353
  misc_feature: The plant flowers significantly late compared to wild-type.
  misc_feature: Useful for making plants with modulated flowering time
MGSPLCEHLARLCLQCDLKLHSKSSTALVESLEQGLCLCQSCFSNPNVISRFLLLLRNDASDYSAYNFPLDLDSSSSSCSSSFIDRNWEFSLGSLPLNNEDSSSSFEILQIFEDHTKNYSDQQVLTLQPDYLDIIPKDSSCSGFKSYETKEDIENVLMNTFDGAEAAVLDLKQYNPEEDLILTELIDELARDNSETTPTNTLPTSASGMSSDIHKDYNTEALANASSQDYFINQMIGSKAKEETNDLAILPNALVQLDCGQSQLILTDEMLPWENQTFVPVKGFSPKDREEAKKRYFEKKKKRKFGKQIRYESRKSTADTKKRMKGRFTKAGADYDYDPRANDINKGKIQT

SEQ ID NO: 13540 - protein, 77 aa, Arabidopsis thaliana
  misc_feature: Ceres SEEDLINE ID no. ME12463
  misc_feature: The plant flowers significantly late compared to wild-type.
  misc_feature: Useful for making plants with modulated flowering time
MAAKSTLKIKGKAKPSKGSSSSSSSSASSKYKVFKDWTNWSLQKAKVATHYGFIPLIIIIGMNSDPKPHLFHLLSPV

SEQ ID NO: 13541 - protein, 396 aa, Arabidopsis thaliana
  misc_feature: Ceres SEEDLINE ID no. ME12903
  misc_feature: The plant flowers significantly late compared to wild-type.
  misc_feature: Useful for making plants with modulated flowering time
MWLSHLFMSLSKLTCNFSIFSVFMACGSIGMSQVRDTPVKLFGWTITPVSHDPYSSSSHVLPDSSSSSSSSSLSLRPHMMNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSLLLESQSIKNETSMATNNHVWYPVPMTREKTQEFSFFSNGAETKSSNNRFVPETYLNLQANPAAMARSMNFRESI

SEQ ID NO: 13542 - protein, 72 aa, Arabidopsis thaliana
  misc_feature: Ceres SEEDLINE ID no. ME13441
  misc_feature: The plant senesces significantly earlier than wild-type.
  misc_feature: Useful for making plants with modulated time to senescence
MAKPLGTTGEFFRRRDEWRKHPMLSNQMRHALPGIGIGVGAFCVYLVGEQIYSKLMAPSSQSSHQKQPAPSH

SEQ ID NO: 13543 - protein, 115 aa, Arabidopsis thaliana
  misc_feature: Ceres SEEDLINE ID no. ME14011
  misc_feature: Abnormal phyllotaxy, leaf number higher than wild-type
  misc_feature: Useful for making plants with modulated biomass
MEEKWKLSKKDTTASSSSSKSKFSRSFSTSASSTKSPIFVRSSSTKCSVPSSSSSSSSSSSISRSFSRKERRSSSSSSSSITQKYSSLAKEQKARFYIMRRCVAMLVCWHKHGDS

SEQ ID NO: 13544 - protein, 315 aa, Arabidopsis thaliana
  misc_feature: Ceres SEEDLINE ID no. ME14812
  misc_feature: The plant flowers significantly late compared to wild-type.
  misc_feature: The plant is abnormally small.
  misc_feature: Useful for biocontainment applications
  misc_feature: Useful for making plants with modulated biomass
  misc_feature: Useful for making plants with modulated flowering time
MSERDDGLGLSLSLSLGFNQKDPSSRLNPMPLASYASSSHMQHMQQSNYNHPQKIQNTWINMFQSSERNSDMRSFLRGIDVNRAPSTVVVDVEDEGAGVSSPNSTVSSVMSGKKSERELMAAAGAVGGGRVEDNEIERASCSLGGGSDDEDGSGNGDDSSRKKLRLSKEQALVLEETFKEHSTLNPKQKMALAKQLNLRTRQVEVWFQNRRARTKLKQTEVDCEYLKRCCENLTDENRRLQKEVSELRALKLSPHLYMHMKPPTTLTMCPSCERVAVTSSSSSVAPPVMNSSSPMGPMSPWAAMPLRQRPAAGSH

SEQ ID NO: 13545 - protein, 218 aa, Arabidopsis thaliana
  misc_feature: Ceres SEEDLINE ID no. ME17026
  misc_feature: The plant produces a reduced number of seeds.
  misc_feature: Useful for biocontainment applications
MTSSSSSSGSPCGACKFLRRKCAKGCVFAPYFCHEQGASHFAAIHKVFGASNASKLLSHLPISDRCEAAITISYEAQARLQDPIYGCVSHIFALQQQVVNLQAELEILKQQAAQSMIFADSPTSENPNSYYGDTTKAPYHHDHQNIYHHHDQTHLVYQTGSSGTVQHGDATESSYHNETSSGMGEFSIYSDLEQHLNTFNQDHLKELQSANFGYISFS

SEQ ID NO: 13546 - protein, 245 aa, Arabidopsis thaliana
  misc_feature: Ceres SEEDLINE ID no. ME17122
  misc_feature: The plants are small.
  misc_feature: Useful for making plants with modulated biomass
MASSGNGTTAGTGSPCGACKFLRRKCASDCIFAPYFSSEQGAARFAAIHKVFGASNVSKLLLNVPIHDRCEAVVTIAYEAQARLHDPVYGCVSHIFALQQQVAFLQSQVMQMKAQIAGHQTSAAGDLRHSSESTNQFMTWQQTSVSPIGSAYSTPYNHHQPYYGHVNPNNPVSPQSSLEESFSNTSSDVTTTANVRETHHQTGGGVYGHDGIGFHEGYPNKKRSVSYCSSDLGELQALALRMMKN

SEQ ID NO: 13547 - protein, 224 aa, Arabidopsis thaliana
  misc_feature: Ceres SEEDLINE ID no. ME17933
  misc_feature: The plant flowers significantly late compared to wild-type.
  misc_feature: Useful for making plants with modulated flowering time
IFNFESITLISHRRARERAKAVSSGNLRMSRVYVGNLDPRVTERELEDEFRSFGVIRSVWVARRPPGYAFLDFEDSRDARDAIREVDGKNGWRVEQSHNRGGGGGRGGGRGGGDGGRGRGGSDLKCYECGESGHFARECRSRGGSGGRRRSRSRSRSPPRYRKSPTYGGRRSYSPRARSPPPPRRRSPSPRGRNYSRSPPPYRARDEVPYANGNGLKDVRRSRS

SEQ ID NO: 13548 - protein, 483 aa, Arabidopsis thaliana
  misc_feature: Ceres SEEDLINE ID no. ME18129
  misc_feature: The plant is abnormally small.
  misc_feature: Useful for making plants with modulated biomass
MERKVLNTLAFSVFAVLFFTSSASSQYQTLVVNTLPSSATLSWPESESLTDESLSESTTSLSVHLSHVDALSSFSDASPADLFNLRLQRDSLRVKSITSLAAVSTGRNATKRTPRTAGGFSGAVISGLSQGSGEYFMRLGVGTPATNVYMVLDTGSDVVWLQCSPCKACYNQTDAIFDPKKSKTFATVPCGSRLCRRLDDSSECVTRRSKTCLYQVSYGDGSFTEGDFSTETLTFHGARVDHVPLGCGHDNEGLFVGAAGLLGLGRGGLSFPSQTKNRYNGKFSYCLVDRTSSGSSSKPPSTIVFGNAAVPKTSVFTPLLTNPKLDTFYYLQLLGISVGGSRVPGVSESQFKLDATGNGGVIIDSGTSVTRLTQPAYVALRDAFRLGATKLKRAPSYSLFDTCFDLSGMTTVKVPTVVFHFGGGEVSLPASNYLIPVNTEGRFCFAFAGTMGSLSIIGNIQQQGFRVAYDLVGSRVGFLSRAC

SEQ ID NO: 13549 - protein, 158 aa, Arabidopsis thaliana
  misc_feature: Ceres SEEDLINE ID no. ME18235
  misc_feature: The plant is abnormally small.
  misc_feature: Useful for making plants with modulated biomass
MVSREQKRGSLQEKFQLLRSITNSHAENDTSIIMDASKYIQKLKQKVERFNQDPTAEQSSSEPTDPKTPMVTVETLDKGFMINVFSGKNQPGMLVSVLEAFEDIGLNVLEARASCTDSFSLHAMGLENEDGENMDAEAVKQAVTDAIRSWGEINDPQN

SEQ ID NO: 13550 - protein, 359 aa, Arabidopsis thaliana
  misc_feature: Ceres SEEDLINE ID no. ME18236
  misc_feature: The plant is abnormally small.
  misc_feature: The plant produces a reduced number of seeds.
  misc_feature: Useful for biocontainment applications
  misc_feature: Useful for making plants with modulated biomass
MYHQNLISSTPNQNSNPHDWDIQNPLFSIHPSAEIPSKYPFMGITSCPNTNVFEEFQYKITNDQNFPTTYNTPFPVISEGISYNMHDVQENTMCGYTAHNQGLIIGCHEPVLVHAVVESQQFNVPQSEDINLVSQSERVTEDKVMFKTDHKKKDIIGKGQWTPTEDELLVRMVKSKGTKNWTSIAKMFQGRVGKQCRERWHNHLRPNIKKNDWSEEEDQILIEVHKIVGNKWTEIAKRLPGRSENIVKNHWNATKRRLHSVRTKRSDAFSPRNNALENYIRSITINNNALMNREVDSITANSEIDSTRCENIVDEVMNLNLHATTSVYVPEQAVLTWGYDFTKCYEPMDDTWMLMNGWN

SEQ ID NO: 13551 - protein, 572 aa, Arabidopsis thaliana
  misc_feature: Ceres SEEDLINE ID no. ME19267
  misc_feature: Abnormal phyllotaxy, leaf number higher than wild-type
  misc_feature: Useful for making plants with modulated biomass
MADEIVPPATQLAAVSLENDGSTVQRAQFSNRVLIRTILDRPDGGAGLAGQTVRIGGWVKSGRDQGKRTFSFLAVNDGSCPANLQVMVDPSLYDVSNLVATGTCVTVDGVLKVPPKGKGTQQQIELNVVKVIDVGTVDASKYPLPKTKLTLETLRDVLHLRSRTNSISAVARIRNALAFATHSFFQEHSFLYIHTPIITTSDCEGAGEMFQATTLINYTERLEQDLIDNPPPTEADVEAARLIVIERGNVVAELKAAKASKEAITAAVAELKIAKETFAHIDERSRLRPGLPKKDGNIDYSKDFFGRQAFLTVSGQLQVETYACALSNVYTFGPTFRAENSHTSRHLAEFWMVEPEIAFADLEDDMNCAEAYVKYMCNWLLEKCYADMELMAKNFDSGCIDRLKLVASTPFGRITYTKAIELLEEAVAKGKEFDNNVEWGIDLASEHERYLTEVLFQKPLIVYNYPKGIKAFYMRLNDDEKTVAAMDVLVPKVGELIGGSQREERYDVIKKRIEEMGLPIEPYEWYLDLRRYGTVKHCGFGLGFERMILFATGLDNIRDVIPFPRYPGKADL

SEQ ID NO: 13552 - protein, 613 aa, Arabidopsis thaliana
  misc_feature: Ceres SEEDLINE ID no. ME19303
  misc_feature: Abnormal phyllotaxy, leaf number higher than wild-type
  misc_feature: The plant flowers significantly late compared to wild-type.
  misc_feature: Useful for making plants with modulated biomass
  misc_feature: Useful for making plants with modulated flowering time
MKSLNDLPAPKSTTTTYYDHSNDAWFKNRVTESETVKSSSIKFKVVPAYLNRQGLRPKNPEDFGDGGAFPEIHLPQYPLLMGKNKSNKPGAKTLPVTVDAQGNVVFDAIVRQNENSRKIVYSQHKDIIPKFLKNEGDLGTVVDEEEELQKEIQETAEETKAAIEKIVNVRLSAAQPSNIARQSGDSQYIKYKPSQQSSAFNSGAKERIIRMVEMPVDPLDPPKFKHKRVPRASGSPPVPVMHSPPRPVTVKDQQDWKIPPCISNWKNPKGYTIPLDKRLAADGRGLQDVQINDNFAKLSEALYVAEQKAREAVSMRSKVQKEMVMKDKERKEQELRALAQKARSERTGAAMSMPVSSDRGRSESVDPRGDYDNYDQDRGREREREEPQETREEREKRIQREKIREERRRERERERRLDAKDAAMGKKSKITRDRDRDISEKVALGMASTGGKGGGEVMYDQRLFNQDKGMDSGFAADDQYNLYDKGLFTAQPTLSTLYKPKKDNDEEMYGNADEQLDKIKNTERFKPDKAFTGASERVGSKRDRPVEFEKEEEQDPFGLEKWVSDLKKGKKPLDKIGSGGTMRASGGGGSSSRDDDHGGSGRTKINFERSDRR

SEQ ID NO: 13553 - protein, 295 aa, Arabidopsis thaliana
  misc_feature: Ceres SEEDLINE ID no. ME19313
  misc_feature: Abnormal phyllotaxy, leaf number higher than wild-type
  misc_feature: Useful for making plants with modulated biomass
MDSSPVSARFDIFEIYRRFCAIRSGQQLCNKKPCDGEESQRFNLSKEAITQLLYLVENKFQARNSIFDELFKLMSRLDLMVDFTEFTCFYDFVFFMCRENGQKNITISRAITAWKLVLAGRFRLLNRWCDFIEKNQRHNISEDTWQQVLAFSRCVHENLEGYDSEGAWPVLIDDFVEHMYSILGPNKDTSLFCKCGDTESESCLYQEDEHHKDYRRPHTGLRNIPGLKRKTSKKNDEEEEDEDEEVLETQNSSSLLNFKRIKTSNSPRCSSKSPCSIERSLSQGFASLLSTGDKP

SEQ ID NO: 13554 - protein, 298 aa, Arabidopsis thaliana
  misc_feature: Ceres SEEDLINE ID no. ME19335
  misc_feature: Abnormal phyllotaxy, leaf number higher than wild-type
  misc_feature: Useful for making plants with modulated biomass
MNSHDIDDQLEADVYSNLPSRNDSSTGRRNRNSCRSKHSETEQRRRSKINERFQSLMDIIPQNQNDQKRDKASFLLEVIEYIHFLQEKVHMYEDSHQMWYQSPTKLIPWRNSHGSVAEENDHPQIVKSFSSNDKVAASSGFLLDTYNSVNPDIDSAVSTKIPEHSPVSAVSSYLRTEPSLQFVQHDFWQPKTSCGTINCFTNELLTSDEKTSASLSTVCSQRVLNTLTEALKSSGVNMSETMISVQLSLRKREDREYSVAAFASEDNGNSIADEEGDSPTETRSFCNDIDHSQKRIRR

SEQ ID NO: 13555 - protein, 541 aa, Arabidopsis thaliana
  misc_feature: Ceres SEEDLINE ID no. ME19541
  misc_feature: Abnormal phyllotaxy, leaf number higher than wild-type
  misc_feature: Useful for making plants with modulated biomass
MLCFRSQRVFILVSLCLLSSFLVVVTGTTSITGVGNEEERGVEEEWRTSVIERVIAEESGENSSLILAAKRTRRKDPADNFKLYTGGWNISNSHYLTSVGYTAAPFIIIALVWFVFFGLSLSLICLCYCCCARQSYGYSRVAYALSLILLISFTIAAIIGCVFLYTGQGKFHASTTDTLDYVVSQANLTSENLRNVSDYLNAAKKVDVQSSILPQDVLSSIDNIQGKINSSATTLSVKTMENQDKIQNVLDIMRLALVIIAAVMLFLAFIGFLLSIFGLQCLVYTLVILGWILVTVTFVLCGGFLLLHNVVGDTCVAMDQWVQNPTAHTALDDILPCVDNATARETLTRTKLVTYQLVNLLDNAISNMTNRNFPPQFRPLYYNQSGPLMPLLCNPFNADLSDRQCQPGQVHLNNATEVWKNFTCQIVTPGTCSTPGRLTPKLYSQMAAAVNVSYGLYKYGPFLADLQGCDFVRSTFTDIERDHCPGLKRYTQWIYVGLVVVSASVMSSLVFWVIYARERRHRVYTKDYNAMHSEDPRSKGH

SEQ ID NO: 13556 - protein, 802 aa, Arabidopsis thaliana
  misc_feature: Ceres SEEDLINE ID no. ME19679
  misc_feature: The plant flowers significantly late compared to wild-type.
  misc_feature: Useful for making plants with modulated flowering time
MTTRGSRSEKVKRIFQQFDGNLDGGLSREEMSALVVAVNPRVKFSDEQISAILDEVFRTYAEFIDGDKGLTFDGLLRTYDDGAGDVDRDFDALGIEFNEETKGASEASSSSITDERAVEAQKQQRTAAWAVSPNHGIVFDETWKLVDDLEILVKRLKSKQEKDGKLKVDNNNVDAFSEAGWSRELGPSSDISDKRIYWEESSHDYGVFVKELGVLRSKADGARSREEAFDGHMAIGKVLYEHQLFKEALVSFKRACELQPTDVRPHFKAGNCLYVLGKYKESKDEFLLALEAAESGGNQWAYLLPQIYVNLGISLEGEGMVLSACEYYREAAILCPTHYRALKLLGSALFGVGEYRAAVKALEEAIYLKPDYADAHCDLASSLHAMGEDERAIEVFQRAIDLKPGHVDALYNLGGLYMDLGRFQRASEMYTRVLAVWPNHWRAQLNKAVSLLGAGETEEAKRALKEALKMTNRVELHDAVSHLKQLQKKKKVKKGNSANEEGPFIVVESSKFKTVGEKTTLRPDLAIALQVRAFQRVTRLWKCDVEALRREMRDNNVPVSYSGNGIPTKSIRRPNLEEILRRLLNVLKPETFQGAIKAINEKILSVLDDSGSGRVDLGMFYAVIAPLCGGHPDKRKRVAFDALLWKPVNEGSSQITKMEAVKYIKLLRAIYIPSQGMSEMLEVHGESDDTSTVTFNQFLEMYDDSEWGFGIMSTVFKLETRDRNRHGNQVCSVCRYPIIGSRFKEVKTGFSLCNQCYSEGKIPPTFKQQEEYKFREYASEVEAMKAKCVCFSMQSHKKTIAT

SEQ ID NO: 13557 - protein, 497 aa, Arabidopsis thaliana
  misc_feature: Ceres SEEDLINE ID no. ME19754
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MRPIIRLSSLSRIRWALRNNQERYSSTFYSKSRKLLIGVNQNQALLNTNTDNSSLYSRSSIFRGLSAEAVEAADPATTRVTVSDVNRTGPLVEYERRISNGELMTGDICQISALRELQRLYDELVDSVDTCRLDRYNTSDKSSRSRWFWSRLMPQTSYSPVKGLYLYGGVGTGKTMLMDLFFDQLPCTWKKQRIHFHDFMLSVHSRLQKHKGLSDPLEVVAQEIAHDAILLCLDEFMVTDVADALILNRLFGHLFSNGVILVATSNRNPDKLYEGGLQRDLFLPFISSLKERSVVHEIGSAVDYRKLTSAEQGFYFIGKDLSTLLKQKFRQLIGDNVVARPQVVEVVMGRKLQIPLGANGCAYFPFEELCDRPLGAADYFGLFKKFHTLALDEIPVFGLHNRTAAYRFVTLVDVMYENRARLLCTAEANPQELLEKIITISEAKSMGPRTSSRSRKNDVTELCVDNELGFAKDRTISRLTEMNSKEYLEHHAITHNL

SEQ ID NO: 13558 - protein, 359 aa, Arabidopsis thaliana
  misc_feature: Ceres SEEDLINE ID no. ME19773
  misc_feature: The plant flowers significantly late compared to wild-type.
  misc_feature: Useful for making plants with modulated flowering time
MDWNFKLSSGYLSGFDQEPDLSPMDGSISFGGSSQSKADFSFDLKLGRNIGNSSSVFGDTEQVISLSKWKDSALAKPEGSRSSSSKRTRGNGVGTNQMPICLVDGCDSDFSNCREYHKRHKVCDVHSKTPVVTINGHKQRFCQQCSRFHALEEFDEGKRSCRKRLDGHNRRRRKPQPEHIGRPANFFTGFQGSKLLEFSGGSHVFPTTSVLNPSWGNSLVSVAVAANGSSYGQSQSYVVGSSPAKTGIMFPISSSPNSTRSIAKQFPFLQEEESSRTASLCERMTSCIHDSDCALSLLSSSSSSVPHLLQPPLSLSQEAVETVFYGSGLFENASAVSDGSVISGNEAVRLPQTFPFHWE

SEQ ID NO: 13559 - protein, 364 aa, Arabidopsis thaliana
  misc_feature: Ceres SEEDLINE ID no. ME20342
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MNTTSTHFVPPRRFEVYEPLNQIGMWEESFKNNGDMYTPGSIIIPTNEKPDSLSEDTSHGTEGTPHKFDQEASTSRHPDKIQRRLAQNREAARKSRLRKKAYVQQLETSRLKLIHLEQELDRARQQGFYVGNGVDTNALSFSDNMSSGIVAFEMEYGHWVEEQNRQICELRTVLHGQVSDIELRSLVENAMKHYFQLFRMKSAAAKIDVFYVMSGMWKTSAERFFLWIGGFRPSELLKVLLPHFDPLTDQQLLDVCNLRQSCQQAEDALSQGMEKLQHTLAESVAAGKLGEGSYIPQMTCAMERLEALVSFVNQADHLRHETLQQMHRILTTRQAARGLLALGEYFQRLRALSSSWAARQREPT

SEQ ID NO: 13560 - protein, 106 aa, Arabidopsis thaliana
  misc_feature: Ceres SEEDLINE ID no. ME21076
  misc_feature: The plant is abnormally small.
  misc_feature: Useful for making plants with modulated biomass
MDNTDRRRRRKQHKIALHDSEEVSSIEWEFINMTEQEEDLIFRMYRLVGDRWDLIAGRVPGRQPEEIERYWIMRNSEGFADKRRQLHSSSHKHTKPHRPRFSIYPS

SEQ ID NO: 13561 - protein, 462 aa, Arabidopsis thaliana
  misc_feature: Ceres SEEDLINE ID no. ME21113
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MAPAQNQITSKHVAVIGAGPAGLITSRELRREGHSVVVFEREKQVGGLWVYTPKSDSDPLSLDPTRSKVHSSIYESLRTNVPRESMGVRDFPFLPRFDDESRDARRYPNHREVLAYIQDFAREFKIEEMIRFETEVVRVEPVDNGNWRVQSKNSGGFLEDEIYDAVVVCNGHYTEPNIAHIPGIKSWPGKQIHSHNYRVPDPFENEVVVVIGNFASGADISRDIAKVAKEVHIASRAREPHTYEKISVPQNNLWMHSEIDTTHEDGSIVFKNGKVIFADSIVYCTGYKYNFPFLETNGYLRIDEKRVEPLYKHVFPPALAPGLAFVGLPAMGIVFVMFEIQSKWVAAVLSGRVTLPSTDKMMEDINAWYASLDALGIPKRHTHTIGRIQSEYLNWVAKESGCELVERWRGQEVDGGYLRLVAHPETYRDEWDDDELIEEAYNDFSRKKLISVDPSYYLENGR

SEQ ID NO: 13562 - protein, 270 aa, Arabidopsis thaliana
  misc_feature: Ceres SEEDLINE ID no. ME21117
  misc_feature: The plant flowers significantly late compared to wild-type.
  misc_feature: Useful for making plants with modulated flowering time
MKILSLSLLLLLAATVSHVQSSASVPGLIELLESNTIFGNEAELLEKEGLSINYPNCRSWHLGVETSNIINFDTVPANCKAYVEDYLITSKQYQYDSKTVNKEAYFYAKGLALKNDTVNVWIFDLDDTLLSSIPYYAKYGYGTENTAPGAYWSWLESGESTPGLPETLHLYENLLELGIEPIIISDRWKKLSEVTVENLKAVGVTKWKHLILKPNGSKLTQVVYKSKVRNSLVKKGYNIVGNIGDQWADLVEDTPGRVFKLPNPLYYVPS

SEQ ID NO: 13563 - protein, 254 aa, Arabidopsis thaliana
  misc_feature: Ceres SEEDLINE ID no. ME21688
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MEDLDHEYKNYWETTMFFQNQELEFDSWPMEEAFSGSGESSSPDGAATSPASSKNVVSERNRRQKLNQRLFALRSVVPNISKLDKASVIKDSIDYMQELIDQEKTLEAEIRELESRSTLLENPVRDYDCNFAETHLQDFSDNNDMRSKKFKQMDYSTRVQHYPIEVLEMKVTWMGEKTVVVCITCSKKRETMVQLCKVLESLNLNILTTNFSSFTSRLSTTLFLQADEEESSAVEAKIQMAIAAYNDPNCLINF

SEQ ID NO: 13564 - protein, 182 aa, Arabidopsis thaliana
  misc_feature: Ceres SEEDLINE ID no. ME22408
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
MGRKKVEIKRIENKSSRQVTFSKRRNGLIEKARQLSILCESSIAVLVVSGSGKLYKSASGDNMSKIIDRYEIHHADELEALDLAEKTRNYLPLKELLEIVQSKLEESNVDNASVDTLISLEEQLETALSVTRARKTELMMGEVKSLQKTVGKKTFLVIEGDRGMSWENGSGNKVRETLPLLK

SEQ ID NO: 13565 - protein, 782 aa, Arabidopsis thaliana
  misc_feature: Ceres SEEDLINE ID no. ME22685
  misc_feature: The plants are small.
  misc_feature: Useful for making plants with modulated biomass
MEIESGSYQNAKKESWRTVLTLAYQSLGVVYGDLSISPLYVYKSTFAEDIHHSESNEEIFGVLSFIFWTITLVPLLKYVFIVLRADDNGEGGTFALYSLLCRHARVNSLPSCQLADEQLIEYKTDSIGSSSMPQSGFAASLKSTLEKHGVLQKILLVLALIGTCMVIGDGVLTPAISVFSAVSGVELSMSKEHHKYIELPAACVILIGLFALQHYGTHRVGFLFAPVILLWLMCISAIGVYNIFHWNPHVYQALSPYYMYKFLKKTQSRGWMSLGGILLCITGSEAMFADLGHFSQLSIKIAFTSLVYPSLILAYMGQAAYLSQHHIIESEYNIGFYVSVPERLRWPVLVIAILAAVVGSQAIITGTFSIIKQCSALGCFPKVKIVHTSSKIHGQIYIPEINWILMVLCLAVTIGFRDTKRLGNASGLAVITVMLVTTCLMSLVIVLCWHKSVIFAIVFVVFFGTIESLYFSASLIKFLEGAWVPIALAFCFLLAMCTWHYGTLKRYEYDVQNKVSVNWLLSLSQTLGIARVRGLGLIHTELVSGVPAIFSHFVTNLPAFHQVLVFLCVKSVPVPHVRPQERFLVGRIGPKEFRIYRCIVRFGYRDVHKDDFEFEGDLVCSIAEFIRTEAETAATAAETNGEDDDRMSVVGTCSTYMQGIEDHYESDIDDPDKPGTSEIRSPKPKKKSKSKVKKRVRFVVPETPKIEKETRQELMELTEAREGGVAYIMGNAYMKAKPGSGLLKRLAINIGYEFLRRNTRGPRNMLTSPHASTLEVGMIYNV

SEQ ID NO: 13566 - protein, 126 aa, Arabidopsis thaliana
  misc_feature: Ceres SEEDLINE ID no. ME23432
  misc_feature: The plant flowers significantly late compared to wild-type.
  misc_feature: Useful for making plants with modulated flowering time
MASNSRSSISPWTFSQNKMFERALAVYDKDTPDRWHNVAKAVGGKTVEEVKRHYDILVEDLINIETGRVPLPNYKTFESNSRSINDFDTRYITKYLYMMLSIYFDNHSSDFEKFSQKVLVSYISLV

SEQ ID NO: 13567 - protein, 638 aa, Arabidopsis thaliana
  misc_feature: Ceres SEEDLINE ID no. ME24000
  misc_feature: The plant is abnormally small.
  misc_feature: Useful for making plants with modulated biomass
MGITKTSPNTTILLKTFHNNSMSQDYHHHHHHNQHQGGIFNFSNGFDRSDSPNLTTQQKQEHQRVEMDEESSVAGGRIPVYESAGMLSEMFNFPGSSGGGRDLDLGQSFRSNRQLLEEQHQNIPAMNATDSATATAAAMQLFLMNPPPPQQPPSPSSTTSPRSHHNSSTLHMLLPSPSTNTTHHQNYTNHMSMHQLPHQHHQQISTWQSSPDHHHHHHNSQTEIGTVHVENSGGHGGQGLSLSLSSSLEAAAKAEEYRNIYYGANSSNASPHHQYNQFKTLLANSSQHHHQVLNQFRSSPAASSSSMAAVNILRNSRYTTAAQELLEEFCSVGRGFLKKNKLGNSSNPNTCGGDGGGSSPSSAGANKEHPPLSASDRIEHQRRKVKLLTMLEEVDRRYNHYCEQMQMVVNSFDIVMGHGAALPYTALAQKAMSRHFRCLKDAVAAQLKQSCELLGDKDAAGISSSGLTKGETPRLRLLEQSLRQNRAFHQMGMEQEAWRPQRGLPERSVNILRAWLFEHFLHPYPSDADKHLLARQTGLSRNQVSNWFINARVRLWKPMVEEMYQQESKEREREEELEENEEDQETKNSNDDKSTKSNNNESNFTAVRTTSQTPTTTAPDASDADAAVATGHPSKIQH

SEQ ID NO: 13568 - protein, 626 aa, Arabidopsis thaliana
  misc_feature: Ceres SEEDLINE ID no. ME24015
  misc_feature: The plant is abnormally small.
  misc_feature: Useful for making plants with modulated biomass
MGKSSGRNGNGSFNGNKFHGVRPYVRSPVPRLRWTPDLHRCFVHAVEILGGQHRATPKLVLKMMDVKGLTISHVKSHLQMYRGGSKLTLEKPEESSSSSIRRRQDSEEDYYLHDNLSLHTRNDCLLGFHSFPLSSHSSFRGGGGGRTKEQQTSESGGYDDDADFLHIKKMNDTTTFLSHHFPKGTEEWREQEHEEEEEDLSLSLSLNHHHWRSNGSSVMNLSNRFGSNSKTAILNDSYSDENHSSSAAAAVTSVVIPPCSGNVLRAVLLLFFICFCFSLYRTSGYLRIVSDSSSTLSRIFPSVNDSSSSPSPSPSLSPEEIEEPKLEEVLRRAATKDGTVILTTLNEAWAAPGSVIDLFFESFRIGKGTRRLLKHLVIIALDAKAYSRCQELHKHCFRLETEGVDFSGGEAYFMTPSYLTMMWRRISFLRSVLEKGYNFVFTDADVMWFRNPFRRFYEDGDFQIACDHYIGRPNDFRNRPNGGFTFVRANNRSIGFYKFWYDSRTKYPKNHDQDVLNFIKTDPFLWKLRIRIRFLNTVYFGGFCEPSKDLNLVCTMHANCCFGLDSKLHDLRIMLQDWRDFKSLPLHSNQSSGFTWSVPQNCSLDSLRPVDSKDEEESEPPGESTQ

SEQ ID NO: 13569 - protein, 251 aa, Arabidopsis thaliana
  misc_feature: Ceres SEEDLINE ID no. ME24044
  misc_feature: The plant flowers significantly earllier than wild-type.
  misc_feature: The plant is abnormally small.
  misc_feature: Useful for making plants with modulated biomass
  misc_feature: Useful for making plants with modulated flowering time
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGGGWEGGEQNVTYAHHQAQSQGLYQPLECNPTLQMGYDNPVCSEQITATTQAQAQQGNGYIPGWML

SEQ ID NO: 13570 - protein, 209 aa, Arabidopsis thaliana
  misc_feature: Ceres SEEDLINE ID no. ME24107
  misc_feature: The plant is abnormally small.
  misc_feature: Useful for making plants with modulated biomass
MNNDDIILAEMRPKKRAGRRVFKETRHPVYRGIRRRNGDKWVCEVREPTHQRRIWLGTYPTADMAARAHDVAVLALRGRSACLNFADSAWRLPVPESNDPDVIRRVAAEAAEMFRPVDLESGITVLPCAGDDVDLGFGSGSGSGSGSEERNSSSYGFGDYEEVSTTMMRLAEGPLMSPPRSYMEDMTPTNVYTEEEMCYEDMSLWSYRY

SEQ ID NO: 13571 - protein, 500 aa, Arabidopsis thaliana
  misc_feature: Ceres SEEDLINE ID no. ME24339
  misc_feature: The plant is abnormally small.
  misc_feature: Useful for making plants with modulated biomass
MPVDLDNSSTVSGDASVSSTGNQNLTPKSVGKKKRNLPGMPDPDAEVIALSPKTLMATNRFVCEICNKGFQRDQNLQLHRRGHNLPWKLRQRSTKEVRKKVYVCPVSGCVHHDPSRALGDLTGIKKHFCRKHGEKKWKCEKCSKKYAVQSDWKAHSKICGTKEYKCDCGTLFSRRDSFITHRAFCDALAEESAKNHTQSKKLYPETVTRKNPEIEQKSPAAVESSPSLPPSSPPSVAIAPAPAISVETESVKIISSSVLPIQNSPESQENNNHPEVIIEEASRTIGFNVSSSDLSNDHSNNNGGYAGLFVSSTASPSLYASSTASPSLFAPSSSMEPISLCLSTNPSLFGPTIRDPPHFLTPLPPQPAMSATALLQKAAQMGSTGSGGSLLRGLGIVSTTSSSMELSNHDALSLAPGLGLGLPCSSGGSGSGLKELMMGNSSVFGPKQTTLDFLGLGRAVGNGGNTGGGLSALLTSIGGGGGIDLFGSGEFSGKDIGRSS

SEQ ID NO: 13572 - protein, 598 aa, Arabidopsis thaliana
  misc_feature: Ceres SEEDLINE ID no. ME24382
  misc_feature: The plant is abnormally small.
  misc_feature: Useful for making plants with modulated biomass
METGNVVNAQPELSGIIDRSKSYMYEQLWKLCAGPLCDIPKLGEKVYYFPQGNIELVEASTREELNELQPICDLPSKLQCRVIAIHLKVENNSDETYAKITLMPDTTVSENLQVVIPTQNENQFRPLVNSFTKVLTASDISANGVFSVPKKHAIECLPPLDMSQPLPAQELLAIDLHGNQWSFRHSYRGTPQRHLLTTGWNEFTTSKKLVKGDVIVFVRGETGELRVGIRRARHQQGNIPSSIVSIDCMRHGVIASAKHAFDNQCMFIVVYKPRSSQFIVSYDKFLDAVNNKFNVGSRFTMRFEGDDLSERRYFGTIIGVSNFSPHWKCSDWRSLEVQWDEFASFLRPNKVSPWEIEHLMPALNVPRSSFLKNKRLREVNEFGSSSSHLLPPILTQGQEIGQLSVASPMNISLLYRETTEDAMNPSRLLMSYPVQPMPKRNYNNQMVTQIEENITTKAGTNFRLFGVSLATPPVIKDPIEQIGSDISKLTEGKKFGQSQTLRSPTKIQSKQFSSTRTCTKVQMQGVTIGRAVDLSVLNGYDQLILELEKLFDLKGQLQTRNQWKIIFTGSDEDEMLVGDDPWPEFCNMVKRIYIQKRR

SEQ ID NO: 13573 - protein, 398 aa, Arabidopsis thaliana
  misc_feature: Ceres SEEDLINE ID no. ME24390
  misc_feature: The plant is abnormally small.
  misc_feature: There is no branching.
  misc_feature: Useful for making plants with modulated biomass
MEEYQHDNSTTPQRVSFLYSPISSSNKNDNTSDTNNNNNNNNSSNYGPGYNNTNNNNHHHQHMLFPHMSSLLPQTTENCFRSDHDQPNNNNNPSVKSEASSSRINHYSMLMRAIHNTQEANNNNNDNVSDVEAMKAKIIAHPHYSTLLQAYLDCQKIGAPPDVVDRITAARQDFEARQQRSTPSVSASSRDPELDQFMEAYCDMLVKYREELTRPIQEAMEFIRRIESQLSMLCQSPIHILNNPDGKSDNMGSSDEEQENNSGGETELPEIDPRAEDRELKNHLLKKYSGYLSSLKQELSKKKKKGKLPKEARQKLLTWWELHYKWPYPSESEKVALAESTGLDQKQINNWFINQRKRHWKPSEDMQFMVMDGLQHPHHAALYMDGHYMGDGPYRLGP

SEQ ID NO: 13574 - protein, 181 aa, Arabidopsis thaliana
  misc_feature: Ceres SEEDLINE ID no. ME24601
  misc_feature: The plant flowers significantly late compared to wild-type.
  misc_feature: Useful for making plants with modulated biomass
  misc_feature: Useful for making plants with modulated flowering time
MENDDITVAEMKPKKRAGRRIFKETRHPIYRGVRRRDGDKWVCEVREPIHQRRVWLGTYPTADMAARAHDVAVLALRGRSACLNFSDSAWRLPVPASTDPDTIRRTAAEAAEMFRPPEFSTGITVLPSASEFDTSDEGVAGMMMRLAEEPLMSPPRSYIDMNTSVYVDEEMCYEDLSLWSY

SEQ ID NO: 13575 - protein, 529 aa, Arabidopsis thaliana
  misc_feature: Ceres SEEDLINE ID no. ME24743
  misc_feature: The plant produces a reduced number of seeds.
  misc_feature: Useful for biocontainment applications
MINPHGGGGDEGGEVPKVADFLGVSKPDENQSNHLVAYNDSDYYFHTNSLMPSVQSNDVVVAACDSNTPNNSSYHELQESAHNLQSLTLSMGTTAGNNVVDKASPSETTGDNASGGALAVVETATPRRALDTFGQRTSIYRGVTRHRWTGRYEAHLWDNSCRREGQSRKGRQGGYDKEDKAARSYDLAALKYWGPSTTTNFPITNYEKEVEEMKHMTRQEFVAAIRRKSSGFSRGASMYRGVTRHHQHGRWQARIGRVAGNKDLYLGTFSTEEEAAEAYDIAAIKFRGLNAVTNFEINRYDVKAILESSTLPIGGGAAKRLKEAQALESSRKREAEMIALGSSFQYGGGSSTGSGSTSSRLQLQPYPLSIQQPLEPFLSLQNNDISHYNNNNAHDSSSFNHHSYIQTQLHLHQQTNNYLQQQSSQNSQQLYNAYLHSNPALLHGLVSTSIVDNNNNNGGSSGSYNTAAFLGNHGIGIGSSSTVGSTEEFPTVKTDYDMPSSDGTGGYSGWTSESVQGSNPGGVFTMWNE

SEQ ID NO: 13576 - protein, 488 aa, Arabidopsis thaliana
  misc_feature: Ceres SEEDLINE ID no. ME24874
  misc_feature: The plant produces a reduced number of seeds.
  misc_feature: Useful for biocontainment applications
MSFRDDNTEEGRNDLRRPFLHTGSWYRMGSRQSSMLESSQVIRDSSISVLACVLIVALGPIQFGFTCGYSSPTQAAITKDLGLTVSEYSVFGSLSNVGAMVGAIASGQIAEYVGRKGSLMIAAIPNIIGWLSISFAKDTSFLYMGRLLEGFGVGIISYTVPVYIAEIAPQTMRGALGSVNQLSVTIGIMLAYLLGLFVPWRILAVLGVLPCTLLIPGLFFIPESPRWLAKMGLTDDFETSLQVLRGFETDITVEVNEIKRSVASSSKRSAVRFVDLKRRRYYFPLMVGIGLLALQQLGGINGVLFYSSTIFESAGVTSSNVATFGVGVVQVVATGIATWLVDKAGRRLLLMISSIGMTISLVIVAVAFYLKEFVSPDSNMYNILSMVSVVGVVAMVISCSLGMGPIPWLIMSEILPVNIKGLAGSIATLLNWFVSWLVTMTANMLLAWSSGGTFTLYALVCGFTVVFVSLWVPETKGKTLEEIQALFR

SEQ ID NO: 13577 - protein, 711 aa, Arabidopsis thaliana
  misc_feature: Ceres SEEDLINE ID no. ME25029
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MTSYGDRLKSTSINGVKLYNVSSAPNVPTWLNPKKQRALRKNPHYMQRVELIQELKFETATTRIKATPDGEYLIASGIYPPQVKVYELNQLALKFERHLDSEIVDFEILDDDFSKLAFLCADRSINLHAKYGKHHTLRIPRMGRDMTYDSWSCDLLCAASSPDLYRINLEQGRFLSPLSTQSPALNVVSRSNLHGLVACGGEDGAVEFFDMRMKSSAARINAVTHGGDAAAEVTAIEFDDSEGLQVAVGSSAGKVFIYDLRTSTPIRVKDHMYESPILNIKWQRTLNTQQPKLITTNKHIVRIWDPNTGEGMTSIEPTQGGINDICVFRGSGLMLLALDSSLIPSYFIPELGPAPKWCSPLENLTEELEESAQTTIYDNYKFLAMEDLEKLQLTHLIGTDLLKASMHGYFINYHLYKKALAVIEPFAFDDYLERRKQEKLEEQRTQRITKKRRLPKVNRDLAARLHGDESEEENKTAEDGEATKKVLKKKKPILTDEHFVDGRFGSMFQNPDFQIDKDSYEYGVLHPVASSKKQPSLLDEHFEAVSDDDENSDSDASQPSDDEADDGDATRPSKKARTPKLYEVKDERHAAAYHNRTSLAKEDSLPMGERVKAIENRRGNFGGSKDIKFGPGGSREFSFKARGSSKYKEDRDDEYEDGQRNKRRGVQSLGLKSTNIRGGFRGRGGGGFRGRGGGGSRGKGGRGGGRGRGRQ

SEQ ID NO: 13578 - protein, 558 aa, Arabidopsis thaliana
  misc_feature: Ceres SEEDLINE ID no. ME25045
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
MASSVVFAATGSLSVPPLKSRRFYVNSSLDSDVSDMSVNAPKGLFPPEPVPYKGPKLKVAIIGAGLAGMSTAVELLDQGHEVDIYDSRTFIGGKVGSFVDRRGNHIEMGLHVFFGCYNNLFRLMKKVGAEKNLLVKDHTHTFINKDGTIGELDFRFPVGAPIHGIRAFLVTNQLKPYDKLRNSLALALSPVVKALVDPDGAMRDIRNLDSISFSDWFLSKGGTRASIQRMWDPVAYALGFIDCDNMSARCMLTIFSLFATKTEASLLRMLKGSPDVYLSGPIKQYITDRGGRIHLRWGCREILYDKSADGETYVTGLAISKATNKKIVKADVYVAACDVPGIKRLLPKEWRESRFFNDIYELEGVPVVTVQLRYNGWVTELQDIELARQLKRAVGLDNLLYTPDADFSCFADLALASPADYYIEGQGTLLQCVLTPGDPYMRMPNDKIIEKVAMQVTELFPSSRGLEVTWSSVVKIAQSLYREAPGKDPFRPDQKTPIKNFFLAGSYTKQDYIDSMEGATLSGRQASSYICDAGEELAELNKKLSSSATAVPDELSLV

SEQ ID NO: 13579 - protein, 371 aa, Arabidopsis thaliana
  misc_feature: Ceres SEEDLINE ID no. ME25333
  misc_feature: The plant flowers significantly late compared to wild-type.
  misc_feature: Useful for making plants with modulated flowering time
MHITSERHPFLRGNSPGDSGLILSTDAKPRLKWTPDLHERFIEAVNQLGGADKATPKTIMKVMGIPGLTLYHLKSHLQKYRLSKNLNGQANNSFNKIGIMTMMEEKTPDADEIQSENLSIGPQPNKNSPIGEALQMQIEVQRRLHEQLELRIEAQGKYLQSVLEKAQETLGRQNLGAAGIEAAKVQLSELVSKVSAEYPNSSFLEPKELQNLCSQQMQTNYPPDCSLESCLTSSEGTQKNSKMLENNRLGLRTYIGDSTSEQKEIMEEPLFQRMELTWTEGLRGNPYLSTMVSEAEQRISYSERSPGRLSIGVGLHGHKSQHQQGNNEDHKLETRNRKGMDSTTELDLNTHVENYCTTRTKQFDLNGFSWN

SEQ ID NO: 13580 - protein, 198 aa, Oryza sativa
  misc_feature: Ceres SEEDLINE ID no. ME25699
  misc_feature: The plant is abnormally small.
  misc_feature: Useful for making plants with modulated biomass
MKRFAFEDSDMARVLMLMSSHGQQEQALALPVPVQLPLAAARGDRAPERAFVCKTCNRVFPSFQALGGHRASHKKPRLDGDGDLSLSKPKLHGCSICGLEFAIGQALGGHMRRHRAMTGGMPRAIVVDKKPDVVDVHVHGHDDDGGIKRGGLWLDLNHPPCDDAGDDDAECGHNAAGAGITFHQFLDTGAMAVDCVGY

SEQ ID NO: 13581 - protein, 147 aa, Oryza sativa
  misc_feature: Ceres SEEDLINE ID no. ME27002
  misc_feature: The plant is abnormally small.
  misc_feature: The plant produces a reduced number of seeds.
  misc_feature: Useful for biocontainment applications
  misc_feature: Useful for making plants with modulated biomass
MAVNSREEEAEMNLELTLCYTPPPPPPFVGFFFCMYCDRKFHSSQALGGHQNAHKLERSQAKLRREAIAAEILAHRAVVLQAGAAANHDGGYGAGSDPLPAAQKVRAEEVQRGAAASAPEFGGFARGESSPEYGVQQAHGQDLSLRL

SEQ ID NO: 13582 - protein, 236 aa, Oryza sativa
  misc_feature: Ceres SEEDLINE ID no. ME27008
  misc_feature: Useful for biocontainment applications
MDFDLFNSYPESQLDLMSTMLQLEQLTALSDQSLFMAAPTSPPVSPMGTPSPQFSPPPQMSVTTTTAGGGYQDQYNSMPATYGAGAGVHQLDFAMSSPGSDSGAPQGSSSSSSSEAMREMIFHIAALQPVEIDPEAVRPPKRRNVRISKDPQSVAARLRRERISERIRILQRLVPGGTKMDTASMLDEAIHYVKFLKSQVQSLERAAAATGAAAHRAAAFGAAYPAALPMQHHAPW

SEQ ID NO: 13583 - protein, 299 aa, Oryza sativa
  misc_feature: Ceres SEEDLINE ID no. ME27117
  misc_feature: The plants are small.
  misc_feature: Useful for making plants with modulated biomass
MCDSLFWQSSADQGDLSDVVRASLQLQTAPRHQAASPPYVHLLGGGGGGGEDQLAAVSQHAEQQQQSMVDASAACDLLHALLPPPPVVQVQQQGASRTRTTIEEDTTGDGEELFAGAHYVVPPIKRRKSQTKKVVCIPAGASGGGGGEVVPSDLWAWRKYGQKPIKGSPYPRGYYRCSSSKGCSARKQVERSRADPTMLVVTYTSDHNHPWPTHRNALAGSTRPSSSNSSNIRLQDSTPVHHQSQTGHDRLTTTHLKQEDVIISPSLLQPDHHQLCTIIDTKHHLLFHQDYPHSFGLFD

SEQ ID NO: 13584 - protein, 161 aa, Arabidopsis thaliana
  misc_feature: Ceres SEEDLINE ID no. ME27976
  misc_feature: Bushy plant with varying petiole angles, abnormal phyllotaxy, leafnumber higher than wild-type
  misc_feature: The plant flowers significantly late compared to wild-type.
  misc_feature: Useful for making plants with modulated biomass
  misc_feature: Useful for making plants with modulated flowering time
MASKNSASLALFFALNILFFTLTVATNCNCKPSPKPKPVPSPKPKPVQCPPPPRPSVPSPNPRPVTPPRTPGSSGNSCPIDALKLGVCANVLSSLLNIQLGQPSSQQCCSLIQGLVDVDAAICLCTALRANVLGINLNVPISLSVLLNVCNRKLPSGFQCA

SEQ ID NO: 13585 - protein, 153 aa, Zea mays
  misc_feature: Useful for making plants with modulated nitrogen use efficiency
MQIFVKTLTGKTITLEVESSDTVDNVKAKIQDKEGIPPDQQRLIFAGKQLEDGRTLADYNIQKESTLHLVLRLRGGTMIKVKTLTGKEIEIDIEPTDSIDRIKERVEEKEGIPPVQQRLIYAGKQLADDKTAKDYNIEGGSVLHLVLALRGGY

SEQ ID NO: 13586 - protein, 482 aa, Arabidopsis thaliana
  misc_feature: Useful for making plants with modulated nitrogen use efficiency
MASNLVEMFNAALNWVTMILESPSARVVLFGVPIRGHFFVEGLLGVVIIILLTRKSYKPPKRPLTEQEIDELCDEWVPEPLIPPITEDMKHEPPVLESAAGPHTTVNGKDVVNFASANYLGLIGHEKLLESCTSALEKYGVGSCGPRGFYGTIDVHLDCETRISKFLGTPDSILYSYGLSTMFSTIPCFCKKGDVIVADEGVHWGIQNGLQLSRSTIVYFKHNDMESLRITLEKIMTKYKRSKNLRRYIVAEAVYQNSGQIAPLDEIVKLKEKYRFRVILDESNSFGVLGRSGRGLAEHHSVPIEKIDVVTAAMGHALATEGGFCTGNARIIDYQRLSSSGYVFSASLPPYLASAAITAIDVIDQNPDMLVKLKQNVALLWKGLSDIKGMSLTSNRESPIVFLKLEKSSGSAKDDLLLLEKMADRALKEDSLLVVSSKRSFLDKCRLPVGIKLYVSAGHSESDLLKASESLKRLASELLLKS

SEQ ID NO: 13587 - protein, 856 aa, Arabidopsis thaliana
  misc_feature: Useful for making plants with altered cell wall content and/or composition
MREMGTGDSASRLILWFCLGFLILGVGFVQCGVTYDRKALLINGQRRILFSGSIHYPRSTPDMWEDLIQKAKDGGIDVIETYVFWNLHEPSPGKYDFEGRNDLVRFVKTIHKAGLYAHLRIGPYVCAEWNFGGFPVWLKYVPGISFRTDNEPFKRAMKGFTERIVELMKSENLFESQGGPIILSQIENEYGRQGQLLGAEGHNYMTWAAKMAIATETGVPWVMCKEDDAPDPVINTCNGFYCDSFAPNKPYKPLIWTEAWSGWFTEFGGPMHHRPVQDLAFGVARFIQKGGSFVNYYMYHGGTNFGRTAGGPFVTTSYDYDAPIDEYGLIRQPKYGHLKELHRAIKMCEKALVSADPVVTSIGNKQQAHVYSAESGDCSAFLANYDTESAARVLFNNVHYNLPPWSISILPDCRNAVFNTAKVGVQTSQMEMLPTDTKNFQWESYLEDLSSLDDSSTFTTHGLLEQINVTRDTSDYLWYMTSVDIGDSESFLHGGELPTLIIQSTGHAVHIFVNGQLSGSAFGTRQNRRFTYQGKINLHSGTNRIALLSVAVGLPNVGGHFESWNTGILGPVALHGLSQGKMDLSWQKWTYQVGLKGEAMNLAFPTNTPSIGWMDASLTVQKPQPLTWHKTYFDAPEGNEPLALDMEGMGKGQIWVNGESIGRYWTAFATGDCSHCSYTGTYKPNKCQTGCGQPTQRWYHVPRAWLKPSQNLLVIFEELGGNPSTVSLVKRSVSGVCAEVSEYHPNIKNWQIESYGKGQTFHRPKVHLKCSPGQAIASIKFASFGTPLGTCGSYQQGECHAATSYAILERKCVGKARCAVTISNSNFGKDPCPNVLKRLTVEAVCAPETSVSTWRP

SEQ ID NO: 13588 - protein, 572 aa, Panicum virgatum
  misc_feature: Useful for making plants with altered carbohydrate content
MPGGAALLLAPLLAALAAAAVGPSPANAAVSYDHRAVVINGQRRILISGSIHYPRSAPEMWPDLLQKAKDGGLDVVQTYVFWNGHEPVQGQFYFGDRYDLVRFVKLAHQAGLYVHLRIGPYVCAEWNFGGFPVWLKYVPEISFRTDNGPFKAAMQAFVEKVVSMMKAEGLFEWQGGPVILAQVENEYGPMEPSMGAGAKPYAAWAARMAVATGAGVPWVMCKQDDAPDPVINTCNGFYCDYFSPNSNSKPTMWTEAWSGWFTAFGKPVPHRPVEDLAFAVARFIQKGGSFVNYYMYHGGTNFDRTSGGPFIATSYDYDAPIDEYGLLRQPKWGHLKDLHAAIKQAEPALVAGDPTVQSLGNYEKAYVFKSSGGACAAFLSNYKTDAAATVAFNGRRYELPAWSISVLPDCKTAVFNTATVRAPSAPARMSPAAAGLAWRSYGEATNALDSRAFTKDGLVEQLGMTWDKSDYLWYTTYVNIDSNEQFLKSGKWPQLTIYSAGHALQVFVNGQSYGAAYGGYDSPKLTYSGYVKMWQGSNKISILSAAVGLPVSSAHRHHCHSISSPSSELRQP

SEQ ID NO: 13589 - protein, 281 aa, Arabidopsis thaliana
  misc_feature: Useful for making plants with altered cell wall content and/or composition
MLALVGVFYPYNRGALFTALVVIYALTSGIAGYTSASFYCQLEGKSWVRNLLLTGCLFCGPLFLTFCFLNTVAITYTATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALLFVRHIYRSIKCE

SEQ ID NO: 13590 - protein, 847 aa, Arabidopsis thaliana
  misc_feature: Useful for making plants with altered cell wall content and/or composition
MGSKPNAMKNVVAMAAVSALFLLGFLVCSVSGSVSYDSRAITINGKRRILISGSIHYPRSTPEMWPDLIRKAKEGGLDVIQTYVFWNGHEPSPGKYYFEGNYDLVKFVKLVQQSGLYLHLRIGPYVCAEWNFGGFPVWLKYIPGISFRTDNGPFKAQMQRFTTKIVNMMKAERLFESQGGPIILSQIENEYGPMEYELGAPGRSYTNWAAKMAVGLGTGVPWVMCKQDDAPDPIINACNGFYCDYFSPNKAYKPKMWTEAWTGWFTKFGGPVPYRPAEDMAFSVARFIQKGGSFINYYMYHGGTNFGRTAGGPFIATSYDYDAPLDEYGLERQPKWGHLKDLHRAIKLCEPALVSGEPTRMPLGNYQEAHVYKSKSGACSAFLANYNPKSYAKVSFGNNHYNLPPWSISILPDCKNTVYNTARVGAQTSRMKMVRVPVHGGLSWQAYNEDPSTYIDESFTMVGLVEQINTTRDTSDYLWYMTDVKVDANEGFLRNGDLPTLTVLSAGHAMHVFINGQLSGSAYGSLDSPKLTFRKGVNLRAGFNKIAILSIAVGLPNVGPHFETWNAGVLGPVSLNGLNGGRRDLSWQKWTYKVGLKGESLSLHSLSGSSSVEWAEGAFVAQKQPLTWYKTTFSAPAGDSPLAVDMGSMGKGQIWINGQSLGRHWPAYKAVGSCSECSYTGTFREDKCLRNCGEASQRWYHVPRSWLKPSGNLLVVFEEWGGDPNGITLVRREVDSVCADIYEWQSTLVNYQLHASGKVNKPLHPKAHLQCGPGQKITTVKFASFGTPEGTCGSYRQGSCHAHHSYDAFNKLCVGQNWCSVTVAPEMFGGDPCPNVMKKLAVEAVCA

SEQ ID NO: 13591 - protein, 225 aa, Arabidopsis thaliana
  misc_feature: Useful for making plants with modulated oxidative stress sensitivity
MMNSTEELSSDSTNNGTVEITYKTIGPARPSQIRVASHIKIRDLRNAIAEKGKFPVSTLRMILRGKALQDEEDGDDLYVTLKDQDSFIVAVIPNPPAGVESFDDDDDDDLKFKLPPSASRWKRKLYYFLRNKLKLPDIILMGLFSLSLKMWVIITLWFILAPIAHRWDLGPIFILGTGFSIILLNLGKRQPGDVSAYSIFNEDFRELPGTYNADRIDRDIRAGQM

SEQ ID NO: 13592 - protein, 623 aa, Arabidopsis thaliana
  misc_feature: Useful for making plants with atered amino acid content
MEAVIQTRGLLSLPTKPIGVRSQLQPSHGLKQRLFAAKPRNLHGCLYPLTGTRNFKPLSQPCMGFRFPTKREAPSSYARRRRGCWRRSCLRRSDSAAVVASRKIFGVEVATLKKIIPLGLMFFCILFNYTILRDTKDVLVVTAKGSSAEIIPFLKTWVNLPMAIGFMLLYTKLSNVLSKKALFYTVIVPFIIYFGGFGFVMYPLSNYIHPEALADKLLTTLGPRFMGPIAILRIWSFCLFYVMAELWGSVVVSVLFWGFANQITTVDEAKKFYPLFGLGANVALIFSGRTVKYFSNLRKNLGPGVDGWAVSLKAMMSIVVGMGLAICLLYWWVNRYVPLPTRSKNKKEKPKMGTMESLKFLVSSPYIRDLATLVVAYGISINLVEVTWKSKLKAQFPSPNEYSAFMGDFSTCTGVATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNSLRSEEELEKEMERASSVKIPVVSQDESGNGSLGESPSSSPEKSAPTNL

SEQ ID NO: 13593 - protein, 130 aa, Arabidopsis thaliana
  misc_feature: Useful for making plants with modulated nitrogen use efficiency
MEEITDGVNNMNLATDSQKKNRIQVSNTKKPLFFYVNLAKRYMQQYNDVELSALGMAIATVVTVTEILKNNGFAVEKKIMTSTVDIKDDARGRPVQKAKIEITLVKSEKFDELMAAANEEKEDAEAQVQN

SEQ ID NO: 13594 - protein, 411 aa, Panicum virgatum
  misc_feature: Useful for making plants with altered carbohydrate content
MAGRVPGAAASSPLPRALLLLAALALFTLSFLSLRSLRPAAGPSLPTAGVTSSLGAADKPRPILPLQHSSSAYHSPEAFAAGYAEMERSFKVYIYPDGDPKTFYQTPRKLTGKYASEGYFFQNIRESRFRTDDPDKAHLFFVPISPHKMRGKGTSYENMTVIVKDYVEGLINKYPYWNRTLGADHFFVTCHDVGVRAFEGLPFMVKNSIRVVCSPSYNVDFIPHKDIALPQVLQPFALPEGGNDIENRTILGFWAGHRNSKIRVILARVWENDTELAISNNRISRAIGELVYQKQFYLTKFCICPGGSQVNSARISDSIHYGCVPVILSDYYDLPFNDALDWRKFAVILRERDVYQLKSILKSISQEEFASLHKSLVQVQKHFVWHSPPVPYDAFHMVMYELWLRHNVIKY

SEQ ID NO: 13595 - protein, 425 aa, Arabidopsis thaliana
  misc_feature: Useful for making plants with altered cell wall content and/or composition
MTIVKPSQFSFSGGGSSPLCSLKSSLLTVAILTFISLFYLSLNSLRTSPPSPVIVVTPIHVPHTFVNEYKTDNETPTMEEETYSDVYHSPEAFRLNYAEMEKRFKVYIYPDGDPNTFYQTPRKVTGKYASEGYFFQNIRESRFRTLDPDEADLFFIPISCHKMRGKGTSYENMTVIVQNYVDGLIAKYPYWNRTLGADHFFVTCHDVGVRAFEGSPLLIKNTIRVVCSPSYNVGFIPHKDVALPQVLQPFALPAGGNDVENRTTLGFWAGHRNSKIRVILAHVWENDTELDISNNRINRATGHLVYQKRFYRTKFCICPGGSQVNSARITDSIHYGCIPVILSDYYDLPFNDILNWRKFAVVLREQDVYNLKQILKNIPHSEFVSLHNNLVKVQKHFQWNSPPVKFDAFHMIMYELWLRHHVVKY

SEQ ID NO: 13596 - protein, 1173 aa, Arabidopsis thaliana; identical to SEQ ID NO: 13387
  misc_feature: Useful for making plants with modulated flowering time

SEQ ID NO: 13597 - protein, 255 aa, Arabidopsis thaliana
  misc_feature: Useful for making plants with modulated salt sensitivity
MTRSVSFPLFLFAVVLSLSSSLLADDPKPIRREVYEGGKIYDISHRYTPEIPAWESSEGLGKTFLRLAASMKNGSFANVSEMKLSVHSGTHVDAPGHFWDNYYDAGFDTDSLDLQVLNGPALLVDVPRDKNITAEVMESLHIQRGVRRVLFRTSNTDKRLMFKKEFDSSFAGFMTDGAKWLVENTDIKLIGLDYLSFAAFEESPATHRVILKGRDIIPVEALKLDGVEVGTYSLHCLPLRLVGAEGAPTRCILIK

SEQ ID NO: 13598 - protein, 586 aa, Zea mays
  misc_feature: Useful for making plants with modulated water use efficiency
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHSSYLTGNQLNSDSSDVPIVKALQGGVRVIELDMWPNPSKDNVDILHGGTLTAPVEMIKCLKSIKEYAFCASNYPLVITLEDHLTPDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLSVKKTLKVKVYMGDRWRMDFSKTHFDAFSPPDFYTKVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 13599 - protein, 259 aa, Arabidopsis thaliana; identical to SEQ ID NO: 13292
  misc_feature: Useful for making plants with modulated low light sensitivity
  misc_feature: Useful for making plants with modulated nitrogen use efficiency

SEQ ID NO: 13600 - protein, 195 aa, Arabidopsis thaliana
  misc_feature: Useful for making plants with altered alkaloid content
  misc_feature: Useful for making plants with altered lignin content
  misc_feature: Useful for making plants with modulated nitrogen use efficiency
MARSPCCEKNGLKKGPWTSEEDQKLVDYIQKHGYGNWRTLPKNAGLQRCGKSCRLRWTNYLRPDIKRGRFSFEEEETIIQLHSFLGNKWSAIAARLPGRTDNEIKNFWNTHIRKKLLRMGIDPVTHSPRLDLLDISSILASSLYNSSSHHMNMSRLMMDTNRRHHQQHPLVNPEILKLATSLFSQNQNQEPCGGS

SEQ ID NO: 13601 - protein, 191 aa, Arabidopsis thaliana
  misc_feature: Useful for making plants with modulated biomass
  misc_feature: Useful for making plants with modulated flowering time
MEEDLILINYIANHGEGVWNSLAKSAGLKRTGKSCRLRWLNYLRPDVRRGNITPEEQLTIMELHAKWGNRWSKIAKHLPGRTDNEIKNFWRTKIQKYIIKSGETTTVGSQSSEFINHHATTSHVMNDTQETMDMYSPTTSYQHASNINQQLNYGNYVPESSSIMMPLSVDQSEQNYWSVDDLWPMNIYNGN

SEQ ID NO: 13602 - protein, 45 aa, Arabidopsis thaliana
  misc_feature: Useful for making plants with altered cell wall content and/or composition
LRWANYLRPDIKRGEFSPEEDDTIIKLHALKGNKWAAIATSLAGR

SEQ ID NO: 13603 - protein, 656 aa, Panicum virgatum
  misc_feature: Useful for making plants with altered carbohydrate content
MGFKEVSSATIFCLLLLFCLGCRCLASELVTSQAATLNVDASPQSARKIPETLFGIFFEEINHAGAGGIWAELVSNRGFEAGGPHTPSNIDPWSIIGDDSSVFVATDRTSCFSRNIVALRMEVLCDDCPTGGVGIYNPGFWGMNIEDGKAYNLVMYVKSPETTDLTVSLTSSDGLQNLASTTITVSGTSNWTKVEQKLVANGTNRTSRLQITTNKKGVVWFDQVSLMPEDTYKGHGFRTELISMLLDLKPRFLRFSGGCFVEGDWLRNAFRWRESIGPWEKRPGHFGDVWHYWTDDGLGYYEFLQLAEDLGAAPIWVFNNGVSHNDEVDTAAIAPFVKDVLDSLEFARGSADSTWGSVRAAMGHPEPFPVKYVAIGNEDCGKKFYRGNYLKFYNAIRQAYPDIQMISNCDGSSRPLDHPADLYDFHVYTDSKTLFNMRSTFDSTSRSGPKAFVSEYAVWRSDAGRGSLLASLAEAAFLTGLEKNSDIVQMASYAPLFVNDNDRTWNPDAIVFNSWQHYGTPSYWMQTLFRESSGAMVHPITVNSSYSGSLAASAITWQDSENSFLRVKVVNFGSDAVSLTISTSGLQASVNALGSTTTVLTSGNVMDENSFSNPNKVVPVKSELSNAAEQMQVTLAPHSFSAFDLALAQSKLVAEM

SEQ ID NO: 13604 - protein, 678 aa, Arabidopsis thaliana
  misc_feature: Useful for making plants with altered cell wall content and/or composition
MDMESWKLLRSVCVLSFLLGSCFVYQSLRVVDAQEDPKPAVTLQVDASNGGGRPIPETLFGIFFEEINHAGAGGLWAELVSNRGFEAGGQNTPSNIWPWSIVGDHSSIYVATDRSSCFERNKIALRMDVLCDSKGCPSGGVGVYNPGYWGMNIEEGKKYKVALYVRSTGDIDLSVSLTSSNGSRTLASEKIIASASDVSKWIKKEVLLEAKATDPSARLQLTTTKKGSIWIDQVSAMPVDTHKGHGFRNDLFQMMADIKPRFIRFPGGCFVEGEWLSNAFRWKETVGPWEERPGHFGDVWKYWTDDGLGHFEFFQMAEDIGAAPIWVFNNGISHNDEVETASIMPFVQEALDGIEFARGDANSTWGSVRAKMGRQEPFELKYVAIGNEDCGKTYYRGNYIVFYDAIKKAYPDIKIISNCDGSSHPLDHPADYYDYHIYTSASNLFSMYHQFDRTSRKGPKAFVSEYAVTGKDAGTGSLLASLAEAAFLIGLEKNSDIVEMASYAPLFVNTNDRRWNPDAIVFNSSHLYGTPSYWVQRFFAESSGATLLTSTLKGNSTSLVASAISWKNNGKDYIRIKAVNFGANSENMQVLVTGLDPNVMRVSGSKKTVLTSTNVMDENSFSQPEKVVPHESLLELAEEDMTVVLPPHSFSSFDLLKESAKIRMPISDSSSHQKTTTV

SEQ ID NO: 13605 - protein, 324 aa, Arabidopsis thaliana
  misc_feature: Useful for making plants with altered cell wall content and/or composition
MASNKLISILVLVVTLLLQGDNNYVVEAQLTTNFYSTSCPNLLSTVQTAVKSAVNSEARMGASILRLFFHDCFVNGCDGSILLDDTSSFTGEQNAAPNRNSARGFNVIDNIKSAVEKACPGVVSCADILAIAARDSVVALGGPNWNVKVGRRDARTASQAAANSNIPAPTSSLSQLISSFSAVGLSTRDMVALSGAHTIGQSRCTNFRARIYNETNINAAFATTRQRTCPRASGSGDGNLAPLDVTTAASFDNNYFKNLMTQRGLLHSDQVLFNGGSTDSIVRGYSNNPSSFNSDFTAAMIKMGDISPLTGSSGEIRKVCGRTN

SEQ ID NO: 13606 - protein, 332 aa, Panicum virgatum
  misc_feature: Useful for making plants with altered carbohydrate content
MATSMARRFVAAACVAATAFALLAAPSSGQLDPHFYDKACPAALPTIRRVVEEAVAAEPRMGASLLRLHFHDCFVNGCDGSILLDDTPFFTGEKKASPNANSVRGFDVIDRIKAAVNAACRGNVVSCADIVAVAARDSVVALGGPSYNVPLGRRDARTASQAAANSSIPAPTFDLGRLASSFASHGLSLQDLVVLSGGHTLGFSRCTNFRDRLYNETAAALDGALAASLRAVCPRAAGSGDDNLAPLDPTPARFDGAAYFASLLRRRGVLHSDQQLFAGGLGATDALVRFYAANPDAFRRDFAEAMVRMASLGPLTGASGEIRYDCRKVNYS

SEQ ID NO: 13607 - protein, 166 aa, Arabidopsis thaliana
  misc_feature: Useful for making plants with modulated oxidative stress sensitivity
MGLSKTIPLVLLPILMFGVLSNAQLTSDFYSTTCPNVTAIARGLIERASRNDVRLTAKVMRLHFHDCFVNGCDGSVLLDAAPADGVEGEKEAFQNAGSLDGFEVIDDIKTALENVCPGVVSCADILAIAAEICCTGGRAVMGRIARKERWPDSDPCGRSGCTSTRT

SEQ ID NO: 13608 - protein, 619 aa, Arabidopsis thaliana
  misc_feature: Useful for making plants with altered cell wall content and/or composition
MKGGGGGGGGGGGGKRRWKVLVIGVLVLVILSMLVPLAFLLGLHNGFHSPGFVTVQPASSFESFTRINATKHTQRDVSERVDEVLQKINPVLPKKSDINVGSRDVNATSGTDSKKRGLPVSPTVVANPSPANKTKSEASYTGVQRKIVSGDETWRTCEVKYGSYCLWREENKEPMKDAKVKQMKDQLFVARAYYPSIAKMPSQSKLTRDMKQNIQEFERILSESSQDADLPPQVDKKLQKMEAVIAKAKSFPVDCNNVDKKLRQILDLTEDEASFHMKQSVFLYQLAVQTMPKSLHCLSMRLTVEHFKSDSLEDPISEKFSDPSLLHFVIISDNILASSVVINSTVVHARDSKNFVFHVLTDEQNYFAMKQWFIRNPCKQSTVQVLNIEKLELDDSDMKLSLSAEFRVSFPSGDLLASQQNRTHYLSLFSQSHYLLPKLFDKLEKVVILDDDVVVQRDLSPLWDLDMEGKVNGAVKSCTVRLGQLRSLKRGNFDTNACLWMSGLNVVDLARWRALGVSETYQKYYKEMSSGDESSEAIALQASLLTFQDQVYALDDKWALSGLGYDYYINAQAIKNAAILHYNGNMKPWLELGIPNYKNYWRRHLSREDRFLSDCNVNP

SEQ ID NO: 13609 - protein, 375 aa, Zea mays
  misc_feature: Useful for making plants with modulated water use efficiency
MVQQAAKEVIPLLTPYKMGQFELSHRVVLAPLTRCRSYGNVPQPHAAVYYSQRATRGGLLIAEATGVSATAQGYPETPGIWTQEQVEAWKPIVDAVHRKGAIFVCQIWHVGRVSTNELQPNGDAPISSTDKQISPDAESGTAYSKPRRLRTDEVPGIVDDFRRAARNAIQAGFDAVEIHGAHGYLLEQFMKDSCNDRTDQYGGSLENRCRLAVEVVDAVVREVGARRVGIRLSPFVDFVDCVDSDPVALGHYMVQQLNRHSGLLYCHMVEPRMATVDGRRQIPHGLLPFRKAFHGTFIAAGGYDREDGNKVVAEGYADLVAYGRLFLANPDLPRRFELDVALNKYDRSTFYTQDPIVGYTDYPFFEEDGKNEESV

SEQ ID NO: 13610 - protein, 246 aa, Glycine max
  misc_feature: Useful for making plants with altered terpenoid content
MVFEETELRLGLGLCLPGNGTTATTEAAAAELGVRKRGFSETETDETATVDLMLNLSPKEAAAADGADPREKPKTSPKEKTLLLPDPAKPPAKAQVVGWPPVRSFRKNMFAAQKSSGGEESEKSSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 13611 - protein, 228 aa, Arabidopsis thaliana
  misc_feature: Useful for making plants with altered alkaloid content
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 13612 - protein, 243 aa, Arabidopsis thaliana
  misc_feature: Useful for making plants with modulated nitrogen use efficiency
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAIGLAPRAMEKYCKNRS

SEQ ID NO: 13613 - protein, 339 aa, Panicum virgatum
  misc_feature: Useful for making plants with altered carbohydrate content
MKMRGLRSSSSLLVAAAALLLFSCFLATGDAANNGGGLRLGYYSASCPRAEDIVREQVAQLYDKHGNTAVSWLRALFHDCMVGSCDASLLLDTSAAAGISEKSAPRSFGMRNFKYVDAIKAALERECPGTVSCADVLVLAARDGAAALGGPRVAMRTGRRDSRASRYAEVGRDIPNHNDSVSAVLSRFAALGVDAEGAVALLGAHSVGRVHCFNLVGRLYPSVDAGMDPAYGAYLRGRCPTADAKEDTRDVAYARNDRATPMVLDNMYHKNLLARRGLLLVDQRLADDPRTAPFVARMAADNAYFHDRFAAALLTMSENNPLAADEGEVRRDCRFVNSA

SEQ ID NO: 13614 - protein, 327 aa, Arabidopsis thaliana
  misc_feature: Useful for making plants with altered cell wall content and/or composition
MANAKPFCLLGFFCLLLQLFSIFHIGNGELEMNYYKESCPKAEEIIRQQVETLYYKHGNTAVSWLRNLFHDCVVKSCDASLLLETARGVESEQKSKRSFGMRNFKYVKIIKDALEKECPSTVSCADIVALSARDGIVMLKGPKIEMIKTGRRDSRGSYLGDVETLIPNHNDSLSSVISTFNSIGIDVEATVALLGAHSVGRVHCVNLVHRLYPTIDPTLDPSYALYLKKRCPSPTPDPNAVLYSRNDRETPMVVDNMYYKNIMAHKGLLVIDDELATDPRTAPFVAKMAADNNYFHEQFSRGVRLLSETNPLTGDQGEIRKDCRYVN

SEQ ID NO: 13615 - protein, 491 aa, Hordeum vulgare subsp. vulgare; identical to SEQ ID NO: 13417
  misc_feature: Useful for making plants with modulated biotic stress sensitivity

SEQ ID NO: 13616 - protein, 107 aa, Arabidopsis thaliana
  misc_feature: Useful for making plants with modulated cold sensitivity
MADQNPRIIVEQNPSQARLDELKFKSWPKWGCSPGKYHLKYEAEEICYILRGKVKVYPKPPPSSSSDAEVEWCVEFGAGDIVTFPKGLSCTWDVSLSVDKHYIFLSS

SEQ ID NO: 13617 - protein, 331 aa, Panicum virgatum
  misc_feature: Useful for making plants with altered carbohydrate content
MGAPLRRRLLLLLAAAACAASAAAAAPRLSPNYYRRSCPRVERIVSDVVAAKQRANPSTAAGTLRLFFHDCFVNGCDASVLISPLSSDASPERAAEINLSLPGDAFDAVGRAKAALEAACPGVVSCADVLALAARDLVGILGGPRFPVALGRRDARRSDARDVEGNLPRTNMSARAMARLFAGKGLTPREMVALAGAHTVGFSHCGEFAHRIYGYRGAGGHDPRLNPEFARALQRSCAGYRSDPTVSIFNDVVTPRDFDEAYYKNLPRGLGLLASDAALWEYPPTRVFAERYAANRTAFFEDFAAAMQRLGAVGVKTGRQGVVRRRCDALD

SEQ ID NO: 13618 - protein, 343 aa, Oryza sativa
  misc_feature: Useful for making plants with modulated light quality sensitivity
MEQHQGQAGMDLPPGFRFHPTDEELITHYLAKKVADARFAALAVAEADLNKCEPWDLPSLAKMGEKEWYFFCLKDRKYPTGLRTNRATESGYWKATGKDKDIFRRKALVGMKKTLVFYTGRAPKGEKSGWVMHEYRLHGKLHAAALGFLHGKPASSKNEWVLCRVFKKSLVEVGAAGGKKAAVVTMEMARGGSTSSSVADEIAMSSVVLPPLMDMSGAGAGAVDPATTAHVTCFSNALEGQFFNPTAVHGHGGGDSSPFMASFTQYGQLHHGVSLVQLLESCNGYGGLVDMAASGSQLQPAACGGERERLSASQDTGLTSDVNPEISSSSGQKFDHEAALWGY

SEQ ID NO: 13619 - protein, 338 aa, Arabidopsis thaliana
  misc_feature: Useful for making plants with altered lignin content
MVEEGGVVVNQGGDQEVVDLPPGFRFHPTDEEIITHYLKEKVFNIRFTAAAIGQADLNKNEPWDLPKIAKMGEKEFYFFCQRDRKYPTGMRTNRATVSGYWKATGKDKEIFRGKGCLVGMKKTLVFYTGRAPKGEKTNWVMHEYRLDGKYSYHNLPKTARDEWVVCRVFHKNAPSTTITTTKQLSRIDSLDNIDHLLDFSSLPPLIDPGFLGQPGPSFSGARQQHDLKPVLHHPTTAPVDNTYLPTQALNFPYHSVHNSGSDFGYGAGSGNNNKGMIKLEHSLVSVSQETGLSSDVNTTATPEISSYPMMMNPAMMDGSKSACDGLDDLIFWEDLYTS

SEQ ID NO: 13620 - protein, 320 aa, Arabidopsis thaliana
  misc_feature: Useful for making plants with altered cell wall content and/or composition
  misc_feature: Useful for making plants with altered lignin content
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 13621 - protein, 192 aa, Arabidopsis thaliana
  misc_feature: Useful for making plants with modulated oxidative stress sensitivity
MENMGDSSIGPGHPHLPPGFRFHPTDEELVVHYLKKKAASVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTAAKPPDLTTTRKNSLRLDDWVLCRIYKKNSSQRPTMERVLERI

SEQ ID NO: 13622 - protein, 197 aa, Panicum virgatum
  misc_feature: Useful for making plants with altered carbohydrate content
MHPSGGPLSVPPGFRFHPTDEELLYYYLRKKVAYEPIDLDVIREIDLNKLEPWDLKDRCRIGTGPQNDWYFFSHKDKKYPTGTRTNRATTAGFWKATGRDKAIFLGNARRIGLRKTLVFYIGRAPHGKKTDWIMHEYRLDEENVEIQEDGWVVCRVFKKKNYQRGLNPAEMAELDDDELQPFPVPVPGALPIDHKHN

SEQ ID NO: 13623 - protein, 292 aa, Arabidopsis thaliana
  misc_feature: Useful for biocontainment applications
MMKVDQDYSCSIPPGFRFHPTDEELVGYYLKKKIASQRIDLDVIREIDLYKIEPWDLQERCRIGYEEQTEWYFFSHRDKKYPTGTRTNRATVAGFWKATGRDKAVYLNSKLIGMRKTLVFYRGRAPNGQKSDWIIHEYYSLESHQNSPPQEEGWVVCRAFKKRTTIPTKRRQLWDPNCLFYDDATLLEPLDKRARHNPDFTATPFKQELLSEASHVQDGDFGSMYLQCIDDDQFSQLPQLESPSLPSEITPHSTTFSENSSRKDDMSSEKRITDWRYLDKFVASQFLMSGED

SEQ ID NO: 13624 - protein, 252 aa, Arabidopsis thaliana
  misc_feature: Useful for making plants with modulated nitrogen use efficiency
MDNVKLVKNGVLRLPPGFRFHPTDEELVVQYLKRKVCSSPLPASIIPEFDVCRADPWDLPGNLEKERYFFSTREAKYPNGNRSNRATGSGYWKATGIDKRVVTSRGNQIVGLKKTLVFYKGKPPHGSRTDWIMHEYRLSSSPPSSMGPTQNWVLCRIFLKKRAGNKNDDDDGDSRNLRHNNNNNSSDQIEIITTDQTDDKTKPIFFDFMRKERTTDLNLLPSSPSSDHASSGVTTEIFSSSDEETSSCNSFR

SEQ ID NO: 13625 - protein, 2325 aa, Zea mays
  misc_feature: Useful for making plants with altered oil content
  misc_feature: Useful for making plants with modulated herbicide sensitivity
MSQLGLAAAASKALPLLPNRQRSSAGTTFSSSSLSRPLNRRKSHTRSLRDGGDGVSDAKKHSQSVRQGLAGIIDLPSEAPSEVDISHGSEDPRGPTDSYQMNGIINETHNGRHASVSKVVEFCAALGGKTPIHSILVANNGMAAAKFMRSVRTWANDTFGSEKAIQLIAMATPEDMRINAEHIRIADQFVEVPGGTNNNNYANVQLIVGMAQKLGVSAVWPGWGHASENPELPDALTAKGIVFLGPPASSMNALGDKVGSALIAQAAGVPTLAWSGSHVEVPLECCLDAIPEEMYRKACVTTTEEAVASCQVVGYPAMIKASWGGGGKGIRKVHNDDEVRALFKQVQGEVPGSPIFVMRLASQSRHLEVQLLCDQYGNVAALHSRDCSVQRRHQKIIEEGPVTVAPRETVKALEQAARRLAKAVGYVGAATVEYLYSMETGDYYFLELNPRLQVEHPVTEWIAEVNLPAAQVAVGMGIPLWQIPEIRRFYGMDYGGGYDIWRKTAALATPFNFDEVDSQWPKGHCVAVRITSEDPDDGFKPTGGKVKEISFKSKPNVWAYFSVKSGGGIHEFADSQFGHAFAYGLSRPAAITNMSLALKEIQIRGEIHSNVDYTVDLLNASDFRENKIHTGWLDTRIAMRVQAERPPWYISVVGGALYKTVTTNAATVSEYVSYLTKGHIPPKHISLVNSTVNLNIEGSKYTIETVRTGHGSYRLRMNDSTVEANVQSLCDGGLLMQLDGNSHVIYAEEEAGGTRLQIDGKTCLLQNDHDPSKLLAETPCKLLRFLVADGAHVDADVPYAEVEVMKMCMPLLSPASGVIHCMMSEGQALQAGDLIARLDLDDPSAVKRAEPFDGIFPQMELPVAVSSQVHKRYAASLNAARMVLAGYEHNINEVVQDLVCCLDNPELPFLQWDELMSVLATRLPRNLKSELEDKYKEYKLNFYHGKNEDFPSKLLRDIIEENLSYGSEKEKATNERLVEPLMNLLKSYEGGRESHAHFVVKSLFEEYLTVEELFSDGIQSDVIETLRHQHSKDLQKVVDIVLSHQGVRNKAKLVTALMEKLVYPNPGGYRDLLVRFSSLNHKRYYKLALKASELLEQTKLSELRASVARSLSDLGMHKGEMSIKDNMEDLVSAPLPVEDALISLFDYSDRTVQQKVIETYISRLYQPHLVKDSIQMKFKESGAITFWEFYEGHVDTRNGHGAIIGGKRWGAMVVLKSLESASTAIVAALKDSAQFNSSEGNMMHIALLSAENESNISGISSDDQAQHKMEKLSKILKDTSVASDLQAAGLKVISCIVQRDEARMPMRHTFLWLDDKSCYEEEQILRHVEPPLSTLLELDKLKVKGYNEMKYTPSRDRQWHIYTLRNTENPKMLHRVFFRTIVRQPNAGNKFRSAQISDAEVGCPEESLSFTSNSILRSLMTAIEELELHAIRTGHSHMYLCILKEQKLLDLIPFSGSTIVDVGQDEATACSLLKSMALKIHELVGARMHHLSVCQWEVKLKLDCDGPASGTWRVVTTNVTGHTCTIDIYREVEEIESQKLVYHSASSSAGPLHGVALNNPYQPLSVIDLKRCSARNNRTTYCYDFPLAFETALQKSWQSNGSTVSEGNENSKSYVKATELVFAEKHGSWGTPIIPMERPAGLNDIGMVAWIMEMSTPEFPNGRQIIVVANDITFRAGSFGPREDAFFETVTNLACERKLPLIYLAANSGARIGIADEVKSCFRVGWSDEGSPERGFQYIYLTEEDYARISSSVIAHKLELDSGEIRWIIDSVVGKEDGLGVENIHGSAAIASAYSRAYEETFTLTFVTGRTVGIGAYLARLGIRCIQRLDQPIILTGFSALNKLLGREVYSSHMQLGGPKIMATNGVVHLTVPDVLEGVSNILRWLSYVPANIGGPLPITKPLDPPDRPVAYIPENTCDPRAAICGVDDSQGKWLGGMFDKDSFVETFEGWAKTVVTGRAKLGGIPVGVIAVETQTMMQIIPADPGQLDSHERSVPRAGQVWFPDSATKTAQALLDFNREGLPLFILANWRGFSGGQRDLFEGILQAGSTIVENLRTYNQPAFVYIPMAGELRGGAWVVVDSKINPDRIECYAERTAKGNVLEPQGLIEIKFRSEELQDCMGRLDPELINLKAKLQDVNHGNGSLPDIEGIRKSIEARTKQLLPLYTQIAIRFAELHDTSLRMAAKGVIKKVVDWEESRSFFYKRLRRRIAEDVLAKEIRQIVGDKFTHQLAMELIKEWYLASQATTGSTGWDDDDAFVAWKDSPENYKGHIQKLRAQKVSHSLSDLADSSSDLQAFSQGLSTLLDKMDPSQRAKFVQEVKKVLD

SEQ ID NO: 13626 - protein, 352 aa, Panicum virgatum
  misc_feature: Useful for making plants with altered carbohydrate content
MARSCSGMMSPTSSSSVPATLLLLVVVLLLAGGCHGSPPLKAHFYRRSCPAPEAVVRDIVVARVAADPAALPAKLLRLFFHDCFVRGCDASVLIDSTPGTGGGDGGAAEKDAAPNASLGGFDVIDTAKAVLEAVCPGTVSCADIVALAARDAVSFQFGRELWDVQLGRRDGVVSRASEAAAGIPSPSDNFTALEANFAAKGLDVKDLVILSGAHTIGVAHCNTFAARLGGGSGSNSAAGADPALNAAYAAELRARCGPAAASNNATAVPMDPGSPARFDAHYFVNLKLGRGLFASDAALLADRRAAGMIHRLTRQAHFLREFRNAVRKMGRVGVLTGERGEIRRHCRAVNRR

SEQ ID NO: 13627 - protein, 1081 aa, Arabidopsis thaliana
  misc_feature: Useful for making plants with altered cell wall content and/or composition
  misc_feature: Useful for making plants with modulated biomass
MEASAGLVAGSYRRNELVRIRHESDGGTKPLKNMNGQICQICGDDVGLAETGDVFVACNECAFPVCRPCYEYERKDGTQCCPQCKTRFRRHRGSPRVEGDEDEDDVDDIENEFNYAQGANKARHQRHGEEFSSSSRHESQPIPLLTHGHTVSGEIRTPDTQSVRTTSGPLGPSDRNAISSPYIDPRQPVPVRIVDPSKDLNSYGLGNVDWKERVEGWKLKQEKNMLQMTGKYHEGKGGEIEGTGSNGEELQMADDTRLPMSRVVPIPSSRLTPYRVVIILRLIILCFFLQYRTTHPVKNAYPLWLTSVICEIWFAFSWLLDQFPKWYPINRETYLDRLAIRYDRDGEPSQLVPVDVFVSTVDPLKEPPLVTANTVLSILSVDYPVDKVACYVSDDGSAMLTFESLSETAEFAKKWVPFCKKFNIEPRAPEFYFAQKIDYLKDKIQPSFVKERRAMKREYEEFKVRINALVAKAQKIPEEGWTMQDGTPWPGNNTRDHPGMIQVFLGHSGGLDTDGNELPRLIYVSREKRPGFQHHKKAGAMNALIRVSAVLTNGAYLLNVDCDHYFNNSKAIKEAMCFMMDPAIGKKCCYVQFPQRFDGIDLHDRYANRNIVFFDINMKGLDGIQGPVYVGTGCCFNRQALYGYDPVLTEEDLEPNIIVKSCCGSRKKGKSSKKYNYEKRRGINRSDSNAPLFNMEDIDEGFEGYDDERSILMSQRSVEKRFGQSPVFIAATFMEQGGIPPTTNPATLLKEAIHVISCGYEDKTEWGKEIGWIYGSVTEDILTGFKMHARGWISIYCNPPRPAFKGSAPINLSDRLNQVLRWALGSIEILLSRHCPIWYGYHGRLRLLERIAYINTIVYPITSIPLIAYCILPAFCLITDRFIIPEISNYASIWFILLFISIAVTGILELRWSGVSIEDWWRNEQFWVIGGTSAHLFAVFQGLLKVLAGIDTNFTVTSKATDEDGDFAELYIFKWTALLIPPTTVLLVNLIGIVAGVSYAVNSGYQSWGPLFGKLFFALWVIAHLYPFLKGLLGRQNRTPTIVIVWSVLLASIFSLLWVRINPFVDANPNANNFNGKGGVF

SEQ ID NO: 13628 - protein, 1078 aa, Panicum virgatum
  misc_feature: Useful for making plants with altered carbohydrate content
MEGDAEAVKSGRRGGGQVCQICGDGVGTTAEGDVFAACYVCGFPVCRPCYEYERKDGTQACPQCKTKYKRHKGSPAIRGEEGDDTDDASDFNYPASGNDDQKQKIADRMRSWRMNAGGSGDVGRPKYDSGEIGLSKYDSGEIPRGYIPSVTNSQISGEIPGASPDHHMMSPTGNIGKRAPFPYVNHSPNPSREFSGSIGNVAWKERVDGWKMKQDKGTIPMTNGTSIAPSEGRGVGDIDASTDYNMEDALLNDETRQPLSRKVPIPSSRINPYRMVIVLRLVVLSIFLHYRITNPVRNAYPLWLLSVICEIWFALSWILDQFPKWFPINRETYLDRLALRYDREGEPSQLAAVDIFVSTVDPLKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKVRINGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKKGGFLSSLCGGRKKASKSKKGSDKKKSQKHVDSSVPVFNLEDIEEGVEGARFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSIPLLIYCVLPTICLLTGKFIMPSISNMTSIWFISLFLSIFATGILEMRWNGVGIDEWWRNEQFWVIGGISAHLFAVFQGLLKVLAGIDTNFTVTSKASDEDGDFAELYMFKWTTLLIPPTTILIINLVGVVAGTSYAINSGYQSWGPLFGKLFFAFWVIVHLYPFLKGLMGRQNRTPTIVVVWAILLASIFSLLWVRIDPFTTRVTGPDTQTCGINC

SEQ ID NO: 13629 - protein, 522 aa, Zea mays
  misc_feature: Useful for making plants with modulated plant growth and development
MSNGPFILNLDCDHYVYNSQAFREGMCFMMDRGGDRIGYVQFPQRFEGIDPSDRYANHNTVFFDVNMRALDGLMGPVYVGTGCLFRRVALYGFDPPRSKEHGGCCSCCFPQRRKIKASAAAPEETRALRMADFDEDEMNMSSFPKKFGNSSFLIDSIPIAEFQGRPLADHPGVKNGRPPGALTVPRDLLDASTVAEAVSVISCWYEDKTEWGHRVGWIYGSVTEDVVTGYRMHNRGWKSVYCVTKRDAFHGTAPINLTDRLHQVLRWATGSVEIFFSRNNALLASRRMKFLQRIAYLNVGIYPFTSIFLIVYCFLPALSLFSGQFIVKTLNVTFLTYLLVITLTLCLLAVLEIKWSGISLEEWWRNEQFWLIGGTSAHLAAVLQGLLKVVAGIEISFTLTSKSGGDDVDDEFADLYIVKWTSLMIPPIVIMMVNLIGIAVGFSRTIYSEIPQWSKLLGGVFFSFWVLAHLYPFAKGLMGRRGRTPTIVFVWAGLLSITISLLWVAINPPSQNQQIGGSFTFP

SEQ ID NO: 13630 - protein, 328 aa, Arabidopsis thaliana
  misc_feature: Useful for making plants with altered cell wall content and/or composition
MGVYLGKYCYIMIIMLVLVLGKEVRSQLLKNGYYSTSCPKAESIVRSTVESHFDSDPTISPGLLRLHFHDCFVQGCDGSVLIKGKSAEQAALPNLGLRGLEVIDDAKARLEAVCPGVVSCADILALAARDSVDLSDGPSWRVPTGRKDGRISLATEASNLPSPLDSVAVQKQKFQDKGLDTHDLVTLLGAHTIGQTDCLFFRYRLYNFTVTGNSDPTISPSFLTQLKTLCPPNGDGSKRVALDIGSPSKFDESFFKNLRDGNAILESDQRLWSDAETNAVVKKYASRLRGLLGFRFDYEFGKAMIKMSSIDVKTDVDGEVRKVCSKVN

SEQ ID NO: 13631 - protein, 215 aa, Panicum virgatum
  misc_feature: Useful for making plants with altered carbohydrate content
IVRSTVEQYYDRDATIAPALLRLHFHDCFVQGCDASVLISGASSERSAPQNFGLRGFEVIDDAKSQLEAVCPGVVSCADILALAARDAVDLTGGPSWSVPLGRRDGRISLASGASALPSPADPVSIQRQKFADQGLSDHDLVTLVGAHTIGQTDCQFFSYRLFNFKATGNADPTISQAFLPQLRALCPPGGDPGRRVALDKDSPGAFDVSFFKSV

SEQ ID NO: 13632 - protein, 351 aa, Panicum virgatum
  misc_feature: Useful for making plants with altered carbohydrate content
MARAEKKRAVRTATAAAERPSGMSDRRPLYFAAFLVLADAALVALIIAFVPYTKIDWDAYMSQVDAFLEGERDYTKIEGDTGPLVYPAGFLYVYSAIKFLTGGQVFPAQILFGVLYIVNLSLVLLLYVKTEVLPWWALGLLCLSKRVHSIFVLRLFNDGFAMTLLHAAMVLIIYHKWYLGLIVFSGAVSVKMNVLLFAPSLLLLMVKAMSIKGVFFALFGAAVVQVLLGMPFLLSHPVEYISRAFNLGRVFIHFWSVNFKFIPEKLFVSKELAIALLILHLTTLMVFAHYKWLKHEGGLFGFLNSRFKHAKSILQLFSSKPRPCILSKEHIVTVMFVSNFIGIVCARSLKP

SEQ ID NO: 13633 - protein, 257 aa, Arabidopsis thaliana
  misc_feature: Useful for making plants with modulated water use efficiency
MASLFKEQAKLSAYRDRRFSGTQEEFDEALRASTTVYIGNVSFYTTEEQLYELFSRAGEIKKIIMGLDKNTKTPCGFCFVLFYSREDTEDAVKYISGTILDDRPIRVDFDWGFQEGRQWGRGRSGGQVRDEYRTDYDPARGYGKLVQKELEAQRQLVDYGTGSLGAYPQAAPTNYGNGRRGGGNYGQGGQNRHGRGGDYHRKRQRDDDRYGRDNSRRNTDHESRRDTDSDMRPEKNPRFRESGDSDDDGEDDRKRRS

SEQ ID NO: 13634 - protein, 919 aa, Panicum virgatum
  misc_feature: Useful for making plants with altered carbohydrate content
MAAASLPPPSRWPPPPLRLLPLVLLGCLAASAPLRAAEAAGVLRQVVAGGGDGDGGAFFEPFNVTYDHRAVILGGKRRMLVSAGLHYPRATPEMWPSLIAKCKEGGADVIETYIFWNGHEPAKGQYYFEGRFDIVKFAKLVAAEGLFLFLRIGPYACAEWNFGGFPVWLRDIPGIEFRTDNEPYKAEMQSFVTKIVNIMKEEKLYSWQGGPIILQQIENEYGNIQDRYGQAGKRYMLWAAQMALALDTGVPWVMCRQTDAPEQILDTCNAFYCDGFKPNSYNKPTIWTEDWDGWYADWGEPLPHRPAQDSAFAVARFYQRGGSLQNYYMYFGGTNFERTAGGPRQITSYDYDAPIDEYGILRQPKWGHLKDLHAAIKLCEPALIAVDGSPQYVKLGPMQEAHVYSSGKIHTNGSISENGQICSAFLANIDEHKYVSVWIFGKSYSLPPWSVSILPDCENVAFNTARVGTQTSVFTVESGSPSYSSRHKPRTLSLIGGPYLSSTWWTSKEPIGKWGEGSFAAQGILEHLNVTKDISDYLSYTMSVNISDEDVTYWNSKGVLPSLTIDQIRDVARVFVNGKLAGSKIGHWVSLNQPVQLVQGPNELTLFSEIVGLQNYGAFLEKDGAGFRGQVKLTGLSNGDIDFTNSLWTYQIGLKGEFSRIYSPENQGYAKWSSMQNDDTQTPFTWFKTMFDAPEGNDPVAIGLGSMGKGQAWVNGHLIGRYWSIVAPESGCPSSCNYAGTYGDSKCRSNCGMATQSWYHIPREWLQESGNLLVLLEETGGDPSQISLQVHYTKTICSKISETYYPPLSSWSRASNSRATLNTVAPELHLQCDEGHVISKIIFASYGTPSGGCQNFSVGNCHASTTLDLVTEACVGNNKCSISVTNDVFGDPCRKVVKDLAVEAECSPPLATEEPRDDM

SEQ ID NO: 13635 - protein, 887 aa, Arabidopsis thaliana
  misc_feature: Useful for making plants with altered cell wall content and/or composition
MAESIRTFSLQWRILSLIIALLVYFPILSGSYFKPFNVSYDHRALIIAGKRRMLVSAGIHYPRATPEMWSDLIAKSKEGGADVVQTYVFWNGHEPVKGQYNFEGRYDLVKFVKLIGSSGLYLHLRIGPYVCAEWNFGGFPVWLRDIPGIEFRTDNEPFKKEMQKFVTKIVDLMREAKLFCWQGGPIIMLQIENEYGDVEKSYGQKGKDYVKWAASMALGLGAGVPWVMCKQTDAPENIIDACNGYYCDGFKPNSRTKPVLWTEDWDGWYTKWGGSLPHRPAEDLAFAVARFYQRGGSFQNYYMYFGGTNFGRTSGGPFYITSYDYDAPLDEYGLRSEPKWGHLKDLHAAIKLCEPALVAADAPQYRKLGSKQEAHIYHGDGETGGKVCAAFLANIDEHKSAHVKFNGQSYTLPPWSVSILPDCRHVAFNTAKVGAQTSVKTVESARPSLGSMSILQKVVRQDNVSYISKSWMALKEPIGIWGENNFTFQGLLEHLNVTKDRSDYLWHKTRISVSEDDISFWKKNGPNSTVSIDSMRDVLRVFVNKQLAGSIVGHWVKAVQPVRFIQGNNDLLLLTQTVGLQNYGAFLEKDGAGFRGKAKLTGFKNGDLDLSKSSWTYQVGLKGEADKIYTVEHNEKAEWSTLETDASPSIFMWYKTYFDPPAGTDPVVLNLESMGRGQAWVNGQHIGRYWNIISQKDGCDRTCDYRGAYNSDKCTTNCGKPTQTRYHVPRSWLKPSSNLLVLFEETGGNPFKISVKTVTAGILCGQVSESHYPPLRKWSTPDYINGTMSINSVAPEVHLHCEDGHVISSIEFASYGTPRGSCDGFSIGKCHASNSLSIVSEACKGRNSCFIEVSNTAFISDPCSGTLKTLAVMSRCSPSQNMSDLSF

SEQ ID NO: 13636 - protein, 391 aa, Arabidopsis thaliana
  misc_feature: Useful for making plants with modulated biomass
MASASFVKPNTLSSPWIGQRSFAHTSASSSPPPRVSFAIRAGAYSDELVKTAKSIASPGRGILAIDESNATCGKRLASIGLDNTEDNRQAYRQLLLTTPGLGDYISGSILFEETLYQSTKDGKTFVDCLRDANIVPGIKVDKGLSPLAGSNEESWCQGLDGLASRSAEYYKQGARFAKWRTVVSVPCGPSALAVKEAAWGLARYAAISQDNGLVPIVEPEILLDGDHPIERTLEVAEKVWSEVFFYLAQNNVMFEGILLKPSMVTPGAEHKNKASPETVADFTLTMLKRRVPPAVPGIMFLSGGQSEAEATLNLNAMNQSPNPWHVSFSYARALQNSVLRTWQGKPEKIEASQKALLVRAKANSLAQLGKYSAEGENEDAKKGMFVKGYTY

SEQ ID NO: 13637 - protein, 177 aa, Arabidopsis thaliana
  misc_feature: Useful for making plants with modulated flowering time
MENMGTRVIEPLIMGRVVGDVLDFFTPTTKMNVSYNKKQVSNGHELFPSSVSSKPRVEIHGGDLRSFFTLVMIDPDVPGPSDPFLKEHLHWIVTNIPGTTDATFGKEVVSYELPRPSIGIHRFVFVLFRQKQRRVIFPNIPSRDHFNTRKFAVEYDLGLPVAAVFFNAQRETAARKR

SEQ ID NO: 13638 - protein, 384 aa, Panicum virgatum
  misc_feature: Useful for making plants with altered carbohydrate content
MRLSVVLLVVALLCLSGGGGGGLVAASTDFKFPAVFNFGDSNSDTGSRVAAGLESILPPYGSTFFGGPAGRFCDGRLILDFLMEAMDMPLLNAYLDSLGAPIFRTGVNFAQAGCSITPAKPTSVSPFSFGLQIKQFFSFKDKVTKLLSKGDMYRPYIPQEDYFSEGLYMFDIGQNDLAGEFYSKTEDQVIASIPTILLEFETGLKKLYDQGARKFWIHNTGPLGCLPENIALFGKDPSQLDELHCVAKHNRAAKLFNLQLHALCTKLRGEFTGASITYVDIHTIKYSLIANYSRFGFEHATQACCGYGGPPLNFDGNVRCGQTVSLNGKLVTAKGCSDTTEFVNWDGIHYTEAANFHIASQILTGKYSDPPFVDKMPFVIKPRF

SEQ ID NO: 13639 - protein, 415 aa, Panicum virgatum
  misc_feature: Useful for making plants with altered carbohydrate content
MRRRALAIAILAAVLFLGAEAQAVQQGHQTERISGSAGDVLEDNPVGRLKVYIYDLPSKYNKKLLKKDPRCLNHMFAAEIFMHRFLLSSAVRTFNPEEADWFYTPVYTTCDLTPSGLPLPFKSPRMMRSAIELIATNWPYWNRSEGADHFFVTPHDFGACFHYQEEKAIGRGILPLLQRATLVQTFGQKNHVCLKDGSITIPPFAPPQKMQAHLIPPDTPRSIFVYFRGLFYDTSNDPEGGYYARGARASVWENFKNNPLFDISTDHPPTYYEDMQRSVFCLCPLGWAPWSPRLVEAVVFGCIPVIIADDIVLPFADAIPWEEIGVFVAEEDVPKLDSILTSIPTDVILRKQRLLANPSMKQAMLFPQPAQAGDAFHQILNGLARKLPHDDNVFLKAGERVLNWTAGPPGDLKPW

SEQ ID NO: 13640 - protein, 412 aa, Arabidopsis thaliana
  misc_feature: Useful for making plants with altered cell wall content and/or composition
MKIHSCLSAILLFLFFSASSAKQNVRTERISGSAGDVLEDDPVGKLKVYVYELPSKYNKKLLQKDPRCLTHMFAAEIFMHRFLLSSPVRTRNPDEADWFYTPIYPTCDLTPTGLPLPFKSPRMMRSSIQLISSNWPYWNRTEGADHFFVVPHDFGACFHYQEEKAIERGILPLLQRATLVQTFGQRNHVCLDEGSITIPPFAPPQKMQAHFIPPDIPRSIFVYFRGLFYDVNNDPEGGYYARGARAAVWENFKNNPLFDISTDHPTTYYEDMQRAIFCLCPLGWAPWSPRLVEAVVFGCIPVIIADDIVLPFADAIPWEEIGVFVAEKDVPELDTILTSIPTEVILRKQRLLANPSMKRAMLFPQPAQPGDAFHQILNGLARKLPHDKSIYLKTGEKALNWTAGPVADLKPW

SEQ ID NO: 13641 - protein, 585 aa, Panicum virgatum
  misc_feature: Useful for making plants with altered carbohydrate content
MGRGAAAAMPPWHALPDEVWEHAFSFLPAYSDRGAAAAACRSWLRAERRSRRRLAVANCYAASPQDAVDRFPSVRAVEVKGKPHFADFGLVPPGWGAAAAPWVAAAADGWPLLEEFSFKRMVVTDDCLEMIAASFRNFQVLRLVSCEGFSTAGLAAIAAGCRNLRELDLQENEIEDCSINWLSLFPESFTSLVTLNFSCLEGDVNIAVLERLITRCRNLKTLKVNNSIPLDLLASLLRKAPQIVELGTGRFSADYHLSLFSKLEAAFAGCKSLRRLSGAWDAVPEYLPAFYCVCEGLTSLNLSYATVRGPELIKFISRCKNLQLLWVMDLIEDHGLAIVASSCNKLQELRVFPSSPFDAAEQVSLTERGLVDVSASCPMLESVLYFCRRMTNEALITIAKNRPNFTCFRLCILEPHTPDYITHQPLDAGFSAIVESCKGLRRLSVSGLLTDRLFKSIGAHADRLEMLSIAFAGNSDLGLHYILSGCKSLKKLEIRDCPFGDKPLLANAAKLETMRSLWMSSCSLTLGACRQLARKMPRLSVEVMNDPRRACSLDSLTDESPIETLYVYRTIAGPRSDTPACVQIV

SEQ ID NO: 13642 - protein, 741 aa, Arabidopsis thaliana
  misc_feature: Useful for making plants with modulated biomass
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 13643 - protein, 327 aa, Panicum virgatum
  misc_feature: Useful for making plants with altered carbohydrate content
MEEGAAGRARPPAVCVTGAGGFVGSWLVQRLLAAGRYTVHGTVRDPGDAKNAHLAALGAAAGERLRLFRADVLDYGAVAAAVAGCDGVFHVASPVPVHAITDPEVELLAPAVTGTANVLRACSEAQVRRVVVVSSLSAVMVNPAWPQSQAMDEACWSDVELCRSTQNWYCLSKTLAELEAFDHAKSTGLDVVSLCPSLVIGPLLQSTLNASSSVIADCLKGDREVKLKLRNFVDVRDVADALLLVYEAPEASGRYICDAHAKQVSDVVELLRSWYPACKNASSKFVQVSDEPFFSSKKLEALGWKFRPFEETLRDSVESFREAGVLD

SEQ ID NO: 13644 - protein, 321 aa, Arabidopsis thaliana
  misc_feature: Useful for making plants with altered cell wall content and/or composition
MAVVQKGKVCVTGAGGFLGSWVVNHLLSRDYFVHGTVRDPGNEKYAHLKKLDKAGDKLKLFKADLLNYGSLQSAIAGCSGVFHVACPVPSASVPNPEVDLIAPAVDGTLNVLKACVEAKVKRVVYVSSVSAVAMNPMWSKSQVLDETAWSDQDYCKKTENWYSLSKTRAESEAFEFAKRTGLDLVSVCPTLVLGPVLQQHTVNASSLVLLKLLKEGYESRNNQERHLVDVRDVAQALLLVYEKAEAEGRYICIGHTVREQEVAEKLKSLYLNYNYPKRYIEADGKVKVSSEKLQKLGWTYRPLEETLVDSVESYRKAKLVD

SEQ ID NO: 13645 - protein, 149 aa, Arabidopsis thaliana; identical to SEQ ID NO: 13154
  misc_feature: Useful for making plants with altered lignin content
  misc_feature: Useful for making plants with modulated nitrogen use efficiency

SEQ ID NO: 13646 - protein, 196 aa, Arabidopsis thaliana
  misc_feature: Useful for making plants with modulated biomass
MATSMSLNLIGAFKGLSLSSTSSFLRGELSFSPKTTFTVTLPLENLQAPVPLTIESAHKKGAGSTKNGRDSPGQRLGVKIYGDQVAKPGAIIVRQRGTKFHAGKNVGIGKDHTIFSLIDGLVKFEKFGPDRKKISVYPREIVPENPNSYRARKRENFRLQREKKKARRENYTYTLPTPELVLASASIDDAEANPEC

SEQ ID NO: 13647 - protein, 1045 aa, Arabidopsis thaliana
  misc_feature: Useful for making plants with altered cell wall content and/or composition
MATKAEEQYVSNSLFTGGFNSVTRAHLMDKVIDSDVTHPQMAGAKGSSCAMPACDGNVMKDERGKDVMPCECRFKICRDCFMDAQKETGLCPGCKEQYKIGDLDDDTPDYSSGALPLPAPGKDQRGNNNNMSMMKRNQNGEFDHNRWLFETQGTYGYGNAYWPQDEMYGDDMDEGMRGGMVETADKPWRPLSRRIPIPAAIISPYRLLIVIRFVVLCFFLTWRIRNPNEDAIWLWLMSIICELWFGFSWILDQIPKLCPINRSTDLEVLRDKFDMPSPSNPTGRSDLPGIDLFVSTADPEKEPPLVTANTILSILAVDYPVEKVSCYLSDDGGALLSFEAMAEAASFADLWVPFCRKHNIEPRNPDSYFSLKIDPTKNKSRIDFVKDRRKIKREYDEFKVRINGLPDSIRRRSDAFNAREEMKALKQMRESGGDPTEPVKVPKATWMADGTHWPGTWAASTREHSKGDHAGILQVMLKPPSSDPLIGNSDDKVIDFSDTDTRLPMFVYVSREKRPGYDHNKKAGAMNALVRASAILSNGPFILNLDCDHYIYNCKAVREGMCFMMDRGGEDICYIQFPQRFEGIDPSDRYANNNTVFFDGNMRALDGVQGPVYVGTGTMFRRFALYGFDPPNPDKLLEKKESETEALTTSDFDPDLDVTQLPKRFGNSTLLAESIPIAEFQGRPLADHPAVKYGRPPGALRVPRDPLDATTVAESVSVISCWYEDKTEWGDRVGWIYGSVTEDVVTGYRMHNRGWRSVYCITKRDSFRGSAPINLTDRLHQVLRWATGSVEIFFSRNNAILASKRLKFLQRLAYLNVGIYPFTSLFLILYCFLPAFSLFSGQFIVRTLSISFLVYLLMITICLIGLAVLEVKWSGIGLEEWWRNEQWWLISGTSSHLYAVVQGVLKVIAGIEISFTLTTKSGGDDNEDIYADLYIVKWSSLMIPPIVIAMVNIIAIVVAFIRTIYQAVPQWSKLIGGAFFSFWVLAHLYPFAKGLMGRRGKTPTIVFVWAGLIAITISLLWTAINPNTGPAAAAEGVGGGGFQFP

SEQ ID NO: 13648 - protein, 234 aa, Arabidopsis thaliana
  misc_feature: Useful for making plants with altered alkaloid content
  misc_feature: Useful for making plants with altered lignin content
MDTNNQQPPPSAAGIPPPPPGTTISAAGGGASYHHLLQQQQQQLQLFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 13649 - protein, 202 aa, Arabidopsis thaliana
  misc_feature: Useful for making plants with modulated cold sensitivity
MAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 13650 - protein, 205 aa, Arabidopsis thaliana
  misc_feature: Useful for biocontainment applications
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYSTLSPFPFFF

SEQ ID NO: 13651 - protein, 233 aa, Oryza sativa subsp. japonica
  misc_feature: Useful for making plants with modulated biotic stress sensitivity
MSTEAETTSAAAPAPAPAPASAPARCQRIGCDATFTDDNNPDGSCQYHPSGPMFHDGMKQWSCCKQKSHDFSLFLAIPGCKTGKHTTEKPITKAVPTKPSKAVPVQTSKQSVGADTCSRCRQGFFCSDHGSQPKAQIPTATSDTNMVPVEKPAVPPPKKKIDLNEPRVCKNKGCGKTYKEKDNHDEACDYHPGPAVFRDRIRGWKCCDIHVKEFDEFMEIPPCTKGWHNADAA

SEQ ID NO: 13652 - protein, 441 aa, Panicum virgatum
  misc_feature: Useful for making plants with altered carbohydrate content
MAAAAISHLRRGAQRHALLCLSLSRRRLSSSAASPLAAAARRLLSTTVDAGTSSSGEHYKPPPFDPFRAATLSPSAPQLESPPIEDEPPSSPPPPEEAVASEAAHEQATLACQEVELEGLKAGVEAVKSREESPEEKEAWWLLGRAVVNYCGSAVGTLAANDPSTSQMLNYDQVFIRDFVPSAIAFLLKGESEIVKNFLLHTLQLQSWEKTVDCYSPGQGLMPASFKVRSVPLDGNSEAFEEVLDPDFGESAIGRVAPVDSGLWWIILLRAYGKITGDYALQERVDVQTGIRLILNLCLSDGFDMFPTLLVTDGSCMIDRRMGIHGHPLEIQALFYSVLRCAREMIGVNDGSKNLIRAINNRLSALSFHIREYYWVDMKKINEIYRYKTEEYSHDAINKFNIYPEQIPSWLADWIPVKGGYLIGNLQPAHMDFRFFSLGNL

SEQ ID NO: 13653 - protein, 633 aa, Panicum virgatum
  misc_feature: Useful for making plants with altered carbohydrate content
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSTANIQWEDVYKSIQNLNGGEQKLKVALLNFNRTEFGTWTDMLPESDFSVVRLEHANETITWQTLYPEWIDEEEETEIPSCPSLPDPNFPRSTHFDVVAVKLPCTRVAGWSRDVARLHLQLSAAKIAATTARGNGGVHVLFVTDCFPVPNLFSCKNLVKREGNAWLYKPDVKALQEKLRLPVGSCELAVPLNAKARLYTVDRRREAYATILHSASEYVCGAITAAQSIRQAGSTRDLVILVDETISDHHRKGLESAGWKVRIIERIRNPKAERDAYNEWNYSKFRLWQLTDYDKVIFIDADLLILRNIDFLFAMPEITATGNNATLFNSGVMVIEPSNCTFQLLMEHINEITSYNGGDQGYLNEIFTWWHRIPKHMNFLKHFWEGDEEAVKAKKTRLFGANPPILYVLHYLGRKPWLCFRDYDCNWNVEILREFASDVAHARWWKVHNKMPKKLQSYCLLRSRLKAGLEWERRQAEKANFTDGHWKRNITDPRLKTCFEKFCFWESMLWHWGENKTNSTKNNPAPAPPTASLSSS

SEQ ID NO: 13654 - protein, 618 aa, Arabidopsis thaliana
  misc_feature: Useful for making plants with altered cell wall content and/or composition
MIPSSSPMESRHRLSFSNEKTSRRRFQRIEKGVKFNTLKLVLICIMLGALFTIYRFRYPPLQIPEIPTSFGLTTDPRYVATAEINWNHMSNLVEKHVFGRSEYQGIGLINLNDNEIDRFKEVTKSDCDHVALHLDYAAKNITWESLYPEWIDEVEEFEVPTCPSLPLIQIPGKPRIDLVIAKLPCDKSGKWSRDVARLHLQLAAARVAASSKGLHNVHVILVSDCFPIPNLFTGQELVARQGNIWLYKPNLHQLRQKLQLPVGSCELSVPLQAKDNFYSAGAKKEAYATILHSAQFYVCGAIAAAQSIRMSGSTRDLVILVDETISEYHKSGLVAAGWKIQMFQRIRNPNAVPNAYNEWNYSKFRLWQLTEYSKIIFIDADMLILRNIDFLFEFPEISATGNNATLFNSGLMVVEPSNSTFQLLMDNINEVVSYNGGDQGYLNEIFTWWHRIPKHMNFLKHFWEGDEPEIKKMKTSLFGADPPILYVLHYLGYNKPWLCFRDYDCNWNVDIFQEFASDEAHKTWWRVHDAMPENLHKFCLLRSKQKAQLEWDRRQAEKGNYKDGHWKIKIKDKRLKTCFEDFCFWESMLWHWGETNSTNNSSTTTTSSPPHKTALPSL

SEQ ID NO: 13655 - protein, 205 aa, Panicum virgatum
  misc_feature: Useful for making plants with altered carbohydrate content
MGGATNLPPGFHFFPSDEDLVIHFLSRKAANLPCRPDIIPTVLLQHYSPWELNGTALQAGNQWYFFSHAAQSRISPNGYWSPIGADETVTSSGCVVGLKKTLIFCTGEPSKGFKTNWIMHEYHLQDGGYNVSGSSTSSSSSSSSRKSQRKRVHSSTESNNWVICRVFESSCGSQVSFHDEGTELSCLDEVFLSLDDYDEVSLPNN

SEQ ID NO: 13656 - protein, 602 aa, Arabidopsis thaliana
  misc_feature: Useful for biocontainment applications
  misc_feature: Useful for making plants with modulated flowering time
MASVEGDDDFGSSSSRSYQDQLYTELWKVCAGPLVEVPRAQERVFYFPQGHMEQLVASTNQGINSEEIPVFDLPPKILCRVLDVTLKAEHETDEVYAQITLQPEEDQSEPTSLDPPIVGPTKQEFHSFVKILTASDTSTHGGFSVLRKHATECLPSLDMTQATPTQELVTRDLHGFEWRFKHIFRGQPRRHLLTTGWSTFVSSKRLVAGDAFVFLRGENGDLRVGVRRLARHQSTMPTSVISSQSMHLGVLATASHAVRTTTIFVVFYKPRISQFIVGVNKYMEAIKHGFSLGTRFRMRFEGEESPERIFTGTIVGSGDLSSQWPASKWRSLQVQWDEPTTVQRPDKVSPWEIEPFLATSPISTPAQQPQSKCKRSRPIEPSVKTPAPPSFLYSLPQSQDSINASLKLFQDPSLERISGGYSSNNSFKPETPPPPTNCSYRLFGFDLTSNSPAPIPQDKQPMDTCGAAKCQEPITPTSMSEQKKQQTSRSRTKVQMQGIAVGRAVDLTLLKSYDELIDELEEMFEIQGQLLARDKWIVVFTDDEGDMMLAGDDPWNEFCKMAKKIFIYSSDEVKKMTTKLKISSSLENEEYGNESFENRSRG

SEQ ID NO: 13657 - protein, 1165 aa, Arabidopsis thaliana
  misc_feature: Useful for making plants with modulated light quality sensitivity
MKAPSSNGVSPNPVEGERRNINSELWHACAGPLISLPPAGSLVVYFPQGHSEQVAASMQKQTDFIPSYPNLPSKLICMLHNVTLNADPETDEVYAQMTLQPVNKYDRDALLASDMGLKLNRQPNEFFCKTLTASDTSTHGGFSVPRRAAEKIFPALDFSMQPPCQELVAKDIHDNTWTFRHIYRGQPKRHLLTTGWSVFVSTKRLFAGDSVLFIRDGKAQLLLGIRRANRQQPALSSSVISSDSMHIGVLAAAAHANANNSPFTIFYNPRWAAPAEFVVPLAKYTKAMYAQVSLGMRFRMIFETEECGVRRYMGTVTGISDLDPVRWKNSQWRNLQIGWDESAAGDRPSRVSVWDIEPVLTPFYICPPPFFRPRFSGQPGMPDDETDMESALKRAMPWLDNSLEMKDPSSTIFPGLSLVQWMNMQQQNGQLPSAAAQPGFFPSMLSPTAALHNNLGGTDDPSKLLSFQTPHGGISSSNLQFNKQNQQAPMSQLPQPPTTLSQQQQLQQLLHSSLNHQQQQSQSQQQQQQQQLLQQQQQLQSQQHSNNNQSQSQQQQQLLQQQQQQQLQQQHQQPLQQQTQQQQLRTQPLQSHSHPQPQQLQQHKLQQLQVPQNQLYNGQQAAQQHQSQQASTHHLQPQLVSGSMASSVITPPSSSLNQSFQQQQQQSKQLQQAHHHLGASTSQSSVIETSKSSSNLMSAPPQETQFSRQVEQQQPPGLNGQNQQTLLQQKAHQAQAQQIFQQSLLEQPHIQFQLLQRLQQQQQQQFLSPQSQLPHHQLQSQQLQQLPTLSQGHQFPSSCTNNGLSTLQPPQMLVSRPQEKQNPPVGGGVKAYSGITDGGDAPSSSTSPSTNNCQISSSGFLNRSQSGPAILIPDAAIDMSGNLVQDLYSKSDMRLKQELVGQQKSKASLTDHQLEASASGTSYGLDGGENNRQQNFLAPTFGLDGDSRNSLLGGANVDNGFVPDTLLSRGYDSQKDLQNMLSNYGGVTNDIGTEMSTSAVRTQSFGVPNVPAISNDLAVNDAGVLGGGLWPAQTQRMRTYTKVQKRGSVGRSIDVNRYRGYDELRHDLARMFGIEGQLEDPQTSDWKLVYVDHENDILLVGDDPWEEFVNCVQSIKILSSAEVQQMSLDGNFAGVPVTNQACSGGDSGNAWRGHYDDNSATSFNR

SEQ ID NO: 13658 - protein, 398 aa, Panicum virgatum
  misc_feature: Useful for making plants with altered carbohydrate content
MKGKGGAMDRRSSTRWRMLVLCAFSFGLGMLFTDRFWTAPDTNNHIMSQRRRQDQELQLVSEDCNTKRKHGEDKDIMEEVTKTHEAILSLDKSISTLQMELAAKRSTLELLRSSGSPVTSETSQPRKKAFVVIGVNTAFSSRKRRDSVRETWMPQGEKLQQLEEQKGIVIRFTIGHSATSNSILDKAIDSEDAQHHDFLRLDHVEGYHELSAKTKIFFSTAVGIWDADFYVKVDDDVHVNLGMLATTLARHKSKPRTYIGCMKSGPVLADKNVKYHEPEYWKFGEEGNKYFRHATGQIYAISKDLATYISINQPILHKYANEDVSLGSWFIGLEVNHIDERNMCCGTPPDCEWKGQAGNVCVASFDWSCSGICKSVEKIKDVHARCGEGDSAVWSALI

SEQ ID NO: 13659 - protein, 128 aa, Arabidopsis thaliana
  misc_feature: Useful for making plants with modulated biomass
  misc_feature (98)..(98): Xaa is any aa, unknown, or other
  misc_feature (100)..(100): Xaa is any aa, unknown, or other
  misc_feature (105)..(105): Xaa is any aa, unknown, or other
  misc_feature (106)..(106): Xaa is any aa, unknown, or other
  misc_feature (116)..(116): Xaa is any aa, unknown, or other
MGRGRVELKRIENKINRQVTFAKRRNGLLKKAYELSVLCDAEVALIIFSNRGKLYEFCSSSSMLRTLERYQKCNYGAPEPNVPSREALAELSSQQEYXKXKEAVXXPYREPQRNLXGEDLGPLSDKGA

SEQ ID NO: 13660 - protein, 115 aa, Arabidopsis thaliana
  misc_feature: Useful for making plants with modulated flowering time
MVRGKTQMKRIENATSRQVTFSKRRNGLLKKAFELSVLCDAEVSLIIFSPKGKLYEFASSNMQDTIDRYLRHTKDRVSTKPVSEENMQHLKYEAANMMKKLNNSKLLNVNSWEKA

SEQ ID NO: 13661 - protein, 446 aa, Panicum virgatum
  misc_feature: Useful for making plants with altered carbohydrate content
MARRNAGAMPREGSAGSVKDWSEFDPSPSPKLAYSHSYVAMRGLLTSVASLDPILMSSSLKSLWAALSSHRHARSLERPKSKGVNWRRPMVHLLVCFLVGIFIGFTPPFSVDLSDKIDSENEMLPFDGDVVDRQMLELKSTKLEPFAVETEAVEEQQVDESPPVPAMLDDEVDFIEASHIVPSVNDSDFVVRKQLIIVTATSVRPHQAYYLNRLAHVLKNVPPPLLWIVAEWPYQSRETAEILRSSGVLYRHLICNRNTTNIRKIIVCQKNNAIFHIKKHRLDGIVHFADEERAYSVDLFEEMRKIRRFGTWPVAIHVGARYRVVLEGPLCRGNQVTGWHTNQRRGVPRRFPIGFSGFAFNSTILWDPQRWNSPTLESIILHSGGRGGLQESRFIEKLVEDETQMEGLADNCSRVMVWNFDLEPPQLHYPTGWLLQKNLDAVVPIT

SEQ ID NO: 13662 - protein, 312 aa, Panicum virgatum
  misc_feature: Useful for making plants with altered carbohydrate content
MASTTCCLSLLVLVALASVASAQLSSTFYDTSCPRALATIKSAVNAAVAKEARMGASLLRLHFHDCFVQGCDASILLAGNEQNDPPNLTLRGFDVIANIKAQVEAICKQTVSCADILAVAARDSVVALGGPSWSVPLGRRDSPKAASTSTVNQFLIPPTASLAELIKGYGDLGLNPTDMVALSGAHTIGQAHCPSYQDHIYNDTNINQAFATSLRASCPMTGGSNVMAPLDTATPTAFDNAYFKNLLSQKGLLHSDQELFNGGSTDNIVRNFASSPSAFSSAFVTAMVKMGNLSPLTGTQGQIRTTCSAANS

SEQ ID NO: 13663 - protein, 237 aa, Arabidopsis thaliana
  misc_feature: Useful for making plants with modulated nitrogen use efficiency
DLGAAPSGAIVLLHACAHNPTGVDPTSEQWEQIRQLMRSKSLLPFFDSAYQGFASGSLDTDAQSVRTFVADGGECLIAQSYAKNMGLYGERVGALSIVCKSADVASKVESQVKLVVRPMYSSPPIHGASIVATILKSSDMYNNWTIELKEMADRIKSMRQQLFEAIQARGTPGDWSHIIKQIGMFTFTGLNKEQVEFMTKEFHIYMTSDGRISMAGLSSKTVPHLADAMHAAVTRLG

SEQ ID NO: 13664 - protein, 1520 aa, Arabidopsis thaliana
  misc_feature: Useful for making plants with modulated salt sensitivity
MADKDVPFGVEDIVQTPLPGYVAPTAVSFSPDDSLITYLFSPEKNLKRRVYAFDVNKGESNLVFSPPDGGVDESNISPEEKLRRERLRERGLGVTRYEWVKTNSKMRFIVVPLPAGVYMKDLSSSPNPELIVPSSPTSPIIDPRLSPNGLFLAYVRESELHVLNLLKNQTQQLTSGANGSTLSHGLAEYIAQEEMDRRNGYWWSLDSKFIAYTEVDSSQIPLFRIMHQGKRSVGSEAQEDHAYPFAGALNSTLRLGVVSSAGGGKTTWMNLVCGGRGNTEDEYLGRVNWLPGNVLIVQVLNRSQSKLKIISFDINTGQGNVLLTEESDTWVTLHDCFTPLEKVPSSRGSGGFIWASERTGFRHLYLYESDGTCLGAITSGEWMVEQIAGVNEPMSLVYFTGTLDGPLETNLYCAKLEAGNTSRCQPMRLTHGKGKHIVVLDHQMKNFVDIHDSVDSPPRVSLCSLSDGTVLKILYEQTSPIQILKSLKLEPPEFVQIQANDGKTTLYGAVYKPDSSKFGPPPYKTMINVYGGPSVQLVYDSWINTVDMRTQYLRSRGILVWKLDNRGTARRGLKFESWMKHNCGYVDAEDQVTGAKWLIEQGLAKPDHIGVYGWSYGGYLSATLLTRYPEIFNCAVSGAPVTSWDGYDSFYTEKYMGLPTEEERYLKSSVMHHVGNLTDKQKLMLVHGMIDENVHFRHTARLVNALVEAGKRYELLIFPDERHMPRKKKDRIYMEQRIWEFIEKNLMDRRNGYWWSLDSKFIAYTEVDSSQIPLFRIMHQGKRSVGSEAQEDHAYPFAGALNSTLRLGVVSSAGGGKTTWMNLVCGGRGNTEDEYLGRVNWLPGNVLIVQVLNRSQSKLKIISFDINTGQGNVLLTEESDTWVTLHDCFTPLEKVPSSRGSGGFIWASERTGFRHLYLYESDGTCLGAITSGEWMVEQIAGVNEPMSLVYFTGTLDGPLETNLYCAKLEAGNTSRCQPMRLTHGKGKHIVVLDHQMKNFVDIHDSVDSPPRVSLCSLSDGTVLKILYEQTSPIQILKSLKLEPPEFVQIQANDGKTTLYGAVYKPDSSKFGPPPYKTMINVYGGPSVQLVYDSWINTVDMRTQYLRSRGILVWKLDNRGTARRGLKFESWMKHNCGYVDAEDQVTGAKWLIEQGLAKPDHIGVYGWSYGGYLSATLLTRYPEIFNCAVSGAPVTSWDGYDSFYTEKYMGLPTEEERYLKSSVMHHVGNLTDKQKLMLVHGMIDENVHFRHTARLVNALVEAGKRYELLIFPDERHMPRKKKDRIYMEQRIWEFIEKNLMGCSVSKKKKKNAMRPPGYEDPELLASVTPFTVEEVEALYELFKKLSSSIIDDGLIHKEEFQLALFRNRNRRNLFADRIFDVFDVKRNGVIEFGEFVRSLGVFHPSAPVHEKVKFAFKLYDLRQTGFIEREELKEMVVALLHESELVLSEDMIEVMVDKAFVQADRKNDGKIDIDEWKDFVSLNPSLIKNMTLPYLKDINRTFPSFVSSCEEEEMELQNVSS

SEQ ID NO: 13665 - protein, 402 aa, Arabidopsis thaliana
  misc_feature: Useful for making plants with modulated drought sensitivity
MGCFHSKAAKEFRGHEDPVKLASETAFSVSEVEALFELFKSISSSVVDDGLINKEEFQLALFKSRKRENIFANRIFDMFDVKRKGVIDFGDFVRSLNVFHPNASLEDKIDFTFRLYDMDCTGYIERQEVKQMLIALLCESEMKLADETIEIILDKTFEDADVNQDGKIDKLEWSDFVNKNPSLLKIMTLPYLRDITTTFPSFVFHSEVDEIATMSIILNNIAFPQIFDMFDVKRKGVIDFGDFVRSLNVFHPNASLEDKIDFTFRLYDMDCTGYIERQEVKQMLIALLCESEMKLADETIEIILDKTFEDADVNQDGKIDKLEWSDFVNKNPSLLKIMTLPYLRDITTTFPSFVFHSEVDEIATMGCFHSKAAKEFRGHEDPVKLASETACKFTRAISLNLL

SEQ ID NO: 13666 - protein, 213 aa, Arabidopsis thaliana
  misc_feature: Useful for making plants with modulated water use efficiency
MGCFHSKAAKEFRGHEDPVKLASETAFSVSEVEALFELFKSISSSVVDDGLINKEEFQLALFKSRKRENIFANRIFDMFDVKRKGVIDFGDFVRSLNVFHPNASLEDKIDFTFRLYDMDCTGYIERQEVKQMLIALLCESEMKLADETIEIILDKTFEDADVNQDGKIDKLEWSDFVNKNPSLLKIMTLPYLRDITTTFPSFVFHSEVDEIAT

SEQ ID NO: 13667 - protein, 470 aa, Arabidopsis thaliana
  misc_feature: Useful for making plants with altered cell wall content and/or composition
MASSSQKLISVCVAVLVVLALTAMIFRNSEISLSRKLKTEVIQSSNSSTMAAIRKLKTEEFQSLNSSTMAATRLDGEPQQQQHAVADDPDMVADEVAKLVQMSEQNRTARRKLGFFSCGTGNPIDDCWRCDRNWHKNRKRLADCGIGFGRNAIGGRDGRFYIVTDPTDEDVVNPKPGTLRHAVIQEEPLWIVFKRDMVIELKQELIMNSFKTIDARGSNVHIANGACITIQFITNVIIHGLHIHDCKPTGNAMVRSSPSHFGWRTMADGDAVSIFGSSHIWIDHNSLSHCADGLVDAVMGSTAITVSNNHFTHHNEVMLLGHSDSYTKDKLMQVTIAYNHFGEGLVQRMPRCRHGYFHVVNNDYTHWEMYAIGGSAEPTINSQGNRYAAPMDRFAKEVTKRVETDASEWKKWNWRSEGDLLLNGAFFRPSGAGASASYGRASSLAAKPSSMVDTITSTAGALGCRKGRPC

SEQ ID NO: 13668 - protein, 428 aa, Panicum virgatum
  misc_feature: Useful for making plants with altered carbohydrate content
MQEAGGGGGGCMTGNPIDDCWRCAGTDWRQDRQRLADCGIGFGRNALGGKGGPLYVVTDSSDGDPVNPAPGTLRHAAIQEGPLWIVFAADMTIRLREELLVNSYKTIDGRGARVHIGAGGACITLQYVSNVIIHNVHVHDCVPAGDANVRSSPTHYGWRTRSDGDGISLFGARDVWVDHCALWRCADGLVDAIMGSTAITVSNSYFAHHDEVMLLGASDAYLPDSAMQVTIAFNRFGPGLVQRMPRCRRGYFHIVNNDYTSWEMYAIGGSASPTINSQGNRYIAPADPNAKEVTKRVDTAEGQWSGWNWRTEGDMMVNGAFFVPSGEGMEEIYDKASSTDPKSSALVDALTQNAGVLGDPRNDAAETGYAGVNYAGVGNGRGGGGGDGYGYLGMIYANGAGRGRRALSTLQLVSPVITLVALGCLRLL

SEQ ID NO: 13669 - protein, 391 aa, Arabidopsis thaliana
  misc_feature: Useful for making plants with altered cell wall content and/or composition
MGRLKQCWSSLLVLAVLVIGTGAVPITYLQSAVAKGAVCLDGSAPAYHFDKGFGSGVNNWIVHMEGGGWCTDVASCNERKGTMKGSSKFMNKDFGFSGILGGKQSTNPDFYNWNRIKVRYCDGSSFTGNVEAVNPANKLFFRGARVWRAVVDDLMAKGMKNAQNAILSGCSAGALAAILHCDTFRAILPRTASVKCVSDAGYFIHGKDITGGSYIQSYYSKVVALHGSAKSLPVSCTSKMKPELCFFPQYVVPSMRTPLFVINAAFDSWQIKNVLAPTAVDKGKEWKNCKLDLKKCSAAQLKTVQGFRDQMMRALSPVHSTPSRGLFLDSCHAHCQGGSAASWSGDKGPQVANTRIAKAVGNWFYGRSAFQKIDCPSPTCNPTCPAISTED

SEQ ID NO: 13670 - protein, 413 aa, Panicum virgatum
  misc_feature: Useful for making plants with altered carbohydrate content
MASRVVAVILAVLVGASAAAPGSEPWWNETQVYGTDANSGGSTGVFVGLTLIQSAAAKGAVCLDGSLPGYHLHRGFGSGANSWLVNLEGGGWCNDVSSCVLRKGNRRGSSNHMERQLQFTGIMSNRPEENPDFYNWNRVKVRYCDGGSFTGDGSNSAAGLYFRGQRIWQAAMDDLMAQGMRYANQALLAGCSAGGVSTILHCDEFRGLFPSNTRVKCLADAGMFLDTVDVSGRREMRSFFNGIVRLQGSGRSLPRSCTSRMDKTSCFFPQNVVPNIQTPTFILNTAYDVWQLQQSVAPKTADPQGLWSKCRTNHAYCNSNQLQFLQGFRNQMLDSVRGFSASRQNGMFINSCFAHCQSERQDTWYANNSPRLGNKRIAEAVGDWFFERGVAKYTDCAYPCDNTCHHLVFRGDH

SEQ ID NO: 13671 - protein, 228 aa, Brassica napus
  misc_feature: Useful for making plants with modulated nitrogen use efficiency
MGRAPCCDKENVKRGPWSPEEDAKLKDYIEKQGTGGNWITLPRKAGLRRCGKSCRLRWLNYLRPNIRHGDFTEEEDNIICSLFASIGSRWSVIAAHLHGRTDNDIKNYWNTKLKKKLMATMAPPRNHHLSAIASSSSSSPSPSSHYNMINSLLPYDPSMSTNQLITPHRGMMTMMGQQQQLLYQEDMGSLVNSPNNNKFVMSHQDDSQKQSTNKGIMLLSDVRSGGRE

SEQ ID NO: 13672 - protein, 490 aa, Panicum virgatum
  misc_feature: Useful for making plants with altered carbohydrate content
MFVSPSRKMSRSASTFQVLLVLATIVAQTQWARASVSGMHCNDLTPSVERPHSASITDFGAVGDGTTLNTKAFQNALFYLNSFANKGGAQLFVPAGRWLTGSFSLISHLTLSLDKDAVILGSPDSSDWPVIDALPSYGRGRELPGKRHQSLIFGSNLTDVIITGTNGTIDGQGAIWWDWFHNHTLNYTRPPLVELMYSTRVIISNLTFINSPFWNIHPVYCSQVLVQHLTILAPISSPNTDGIDPDSSTNVCIEDCYIRNGDDIVVIKSGWDEYGISFAHPSSNISIRNITGQTRNSAGIAFGSEMSGGISNVRAEGIHIVNSVHGIRIKTAPGRGGYVKNVYVADVSLDNVSIAIRITGNYGEHPDENYNKNALPTISNITIKNIVGVNIGVAGMLQGISGDNFSNICLSNVSLSVRSTNPWNCSLVEGYSNSVSPEICEQLRKGPGPGQVCYDGNSYPAAAAQPQSPQKSSASRLVNPFFCTSWFLCR

SEQ ID NO: 13673 - protein, 455 aa, Arabidopsis thaliana
  misc_feature: Useful for making plants with altered cell wall content and/or composition
MKMPVALVWLLAFTILLISGEGNNAICKENFKLDPRPHSVSILEFGAVGDGKTLNTIAFQNAVFYLKSFADKGGAQLYVPPGKWLTGSFNLTSHLTLFLEKGATILASPDPSHWDVVSPLPSYGRGIELPGKRYRSLINGDNLIDVVITGENGTFDGQGAAWWEWLESGSLNYSRPHIIEFVSSKHILISNLTFLNAPAINIHPVYCSQIHIRKVLIETSVDSPHVLGVAPDSSDNVCIEDSTINVGHDAVSLKSGWDQYGIHYGRPTTAVHIRNLRLKSPTGAGISFGSEMSGGVSDVTVERLNIHSSLIGVAFRTTRGRGGYIRNITISDVDLTSVDTAIVANGHTGSHPDDKFDRDALPVVTHIVMRNFTGVDIGVAGNLTGIGESPFTSICLADIHLQTRSEESWICSNVSGFSDDVSPEPCQELMSSPSSCFAGGSIYEGDATAQSYYSW

SEQ ID NO: 13674 - protein, 130 aa, Arabidopsis thaliana
  misc_feature: Useful for making plants with altered lignin content
  misc_feature: Useful for making plants with modulated nitrogen use efficiency
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGW

SEQ ID NO: 13675 - protein, 141 aa, Arabidopsis thaliana
  misc_feature: Useful for making plants with modulated flowering time
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYSSRGGGGGSYGGGRREGGGGYGGGEGGGYGGNGGGGGW

SEQ ID NO: 13676 - protein, 169 aa, Arabidopsis thaliana
  misc_feature: Useful for making plants with altered alkaloid content
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGGGYSGGGGSYGGGGGRREGGGGYSGGGGYSSRGGGGGSYGGGRREGGGGYGGGEGGGYGGSGGGGGW

SEQ ID NO: 13677 - protein, 128 aa, Arabidopsis thaliana
  misc_feature: Useful for making plants with altered lignin content
  misc_feature: Useful for making plants with modulated biomass
  misc_feature: Useful for making plants with modulated nitrogen use efficiency
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERR

SEQ ID NO: 13678 - protein, 587 aa, Oryza sativa subsp. japonica
  misc_feature: Useful for making plants with modulated water use efficiency
MGAMAMVEQEGCVENRQPLAASSSSVSDGSSYGGGGGGLAQMSPPVSSSANSISGLRRTSGPIRRAKGGWTPEEDETLRKAVEAYKGRNWKKIAECFPYRTEVQCLHRWQKVLNPELIKGPWTQEEDDQIIDLVKKYGPTKWSVIAKALPGRIGKQCRERWHNHLNPEIRKDAWTTEEEQALINAHRIYGNKWAEIAKVLPGRTDNSIKNHWNSSLRKKQDMYNTSNNMVVPKLLVHDKFKDKPKLMAMEGHLDLNKAPIINSKDQPGTAHRSNCSGFLSRSSLPTAQPLTSREASVVDGSAVTLVAQALESDSVRGKGLEIDSVHEKGLEVNSAPDHTGNSWTIQLEAAPSKGEAELSLKNEARSLGPLCYQIPNMEDVVPVSSSLFSDHLTGNHTSEHCGDDILSPAGCTTPPPTKGKLTSQLSVDSILKSAANSFPGTPSILKRRKRDKSTPVSASEMKISGSNTDRFYTPMGMEPATATPESFKTTSFLSLGSLDGSVKSFDVSPQYRARSKRMALTKTVEKQLDFSSDGLDTCGSEILNSSCNNSQSTLSITEAPKLKEKEHAVQLENLTKNFAHTTNLDVT

SEQ ID NO: 13679 - protein, 327 aa, Panicum virgatum
  misc_feature: Useful for making plants with altered carbohydrate content
MASDGDGGGDGLVCVTGGSGFIGSWLVRRLLDRGYTVHATVKNLQDEGETKHLRALDGAGARLWLFQMDLLDPASVRPAVEGARGVFHLASPVILHPTQDPEKELVEPAVEGTLGVLRAAKDCGVGRVVMVSSQTAMVPNPRWPADKVVDEDSWADVDLLKELKLWYSVSKTLAEKAAWDFAEKQGLQLAVLNPVLVLGPTLTPSITGSLQVFLQIMKGQRFDMDEYFLGCVDVRDVAQSLVALYESSSAQGRHLCVESIERMVDFTNKLADLYPELPVQKIQEDKQEWVVRAKDPSKKLIELGVRFIPSDQIIMDTMDCFRSKGLI

SEQ ID NO: 13680 - protein, 336 aa, Zea mays
  misc_feature: Useful for making plants with altered alkaloid content
  misc_feature: Useful for making plants with altered lignin content
MPGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPPYAHARAGRPRLSEFHDRSFEGDYGREVDEIGNGISETGMRGKLVKRNKKSSGDLDIYGGHRINVEPIGTLGEDSRSEIRSRGDRDIDNQQALQAEEKDVVSSVATVLSDLCGPGEWMPMAKLHNELLEQFGNVWHPSRVRKYLTQDDWSPTETKGRPWFGLLALLRKYPEHFVINTRSKGRMTSEFVSLVSLLS

SEQ ID NO: 13681 - protein, 822 aa, Panicum virgatum
  misc_feature: Useful for making plants with altered carbohydrate content
MASKPSFKRTDSIAESMPDALRQSRYQMKRCFQRYVSKGKKLLKNQQLIQELEKSLDDKVEKEKLVESFLGYIICSTQEAVVLPPYVAFAVRMNPGIWEFVKVHSDDLSVKGITPSEYLKFKETLYDENWAKDDNSLEVDFGALDLSTPHMTLPSSIGNGLQFISKFMSSKLGEKPEISMKPLLDYLLSLNYRGEKLMVNDTIDTVNKLQTALLLAEVFVSGLPRYTPFAKFEQRFQEWGLEKGWGDTAERCKETLNCLSEVLQAPDPINMENFFSRIPSIFNIVVFSIHGYFGQEKVLGLPDTGGQVVYILDQVRALEEELLQRIKQQGLNVTPKILVLTRLIPDAKGTKCNVELEPVENTKHSSILRVPFKTEDGKDLRQWVSRFDIYPYLERYAQDSCAKILDILEGKPDLIIGNYTDGNLVASLMSSKLGVTQGTIAHALEKTKYEDSDVKWRDLDQKYHFSCQFTADMIAMNTSDFIITSTYQEIAGSKEKPGQYEHHYAFTMPGLCRYATGINVFDPKFNIAAPGADQSIYFPFTQKQKRLTDLHPQIEELLYSKQDTDEHIGYLADRNKPIIFSMARLDKSKDREEIEEINKMHNLIDKYQLKGQIRWIKAQTDRVRNGELYRCIADTKGAFVQPALYEAFGLTVIEAMNCGLTTFATNLGGPAEIIVDGVSGFHINPMNGREASNKIADFFQKCKEDPSYWNKVSTAGLQRIYECYTWKIYATKVLNMGSTYGFWKTLNKGERIAKQRYLQMFYNLQFRNLAKTVPRVYEHPPQAPASTGPSTMTVVKPKERKPQTRIQRIMTSLMGNKSSTSD

SEQ ID NO: 13682 - protein, 942 aa, Arabidopsis thaliana
  misc_feature: Useful for making plants with altered cell wall content and/or composition
MSSSSQAMLQKSDSIAEKMPDALKQSRYHMKRCFASFVGGGKKLMKREHLMNEIEKCIEDSRERSKILEGLFGYILTCTQEAAVVPPFVALAARPNPGFWEYVKVNSGDLTVDEITATDYLKLKESVFDESWSKDENALEIDFGAIDFTSPRLSLSSSIGKGADYISKFISSKLGGKSDKLEPLLNYLLRLNHHGENLMINDDLNTVAKLQKSLMLAVIVVSTYSKHTPYETFAQRLKEMGFEKGWGDTAERVKETMIILSEVLEAPDNGKLDLLFSRLPTVFNVVIFSVHGYFGQQDVLGLPDTGGQVVYILDQVRALEEELLIRINQQGLGFKPQILVVTRLIPEARGTKCDQELEAIEGTKHSHILRVPFVTNKGVLRQWVSRFDIYPYLERFTQDATSKILQRLDCKPDLIIGNYTDGNLVASLMATKLGVTQGTIAHALEKTKYEDSDAKWKELDPKYHFSCQFTADLIAMNVTDFIITSTYQEIAGSKDRPGQYESHTAFTMPGLCRVVSGIDVFDPKFNIAAPGADQSVYFPYTEKDKRFTKFHPSIQELLYNEKDNAEHMGYLADREKPIIFSMARLDTVKNITGLVEWYGKDKRLREMANLVVVAGFFDMSKSNDREEKAEIKKMHDLIEKYKLKGKFRWIAAQTDRYRNSELYRCIADTKGVFVQPALYEAFGLTVIEAMNCGLPTFATNQGGPAEIIVDGVSGFHIDPNNGDESVTKIGDFFSKCRSDGLYWDNISKGGLKRIYECYTWKIYAEKLLKMGSLYGFWRQVNEDQKKAKKRYIEMLYNLQFKQLTKKVTIPEDKPLPLRLASLRNLLPKKTTNLGAGSKQKEVTETEKTKQKSKDGQEQHDVKVGEREVREGLLAADASERVKKVLESSEEKQKLEKMKIAYGQQHSQGASPVRNLFWSVVVCLYICYILKQRFFGANSAQEY

SEQ ID NO: 13683 - protein, 128 aa, Arabidopsis thaliana
  misc_feature: Useful for making plants with modulated heat sensitivity
MEDNDKSPPKDYYKILEVDYDATEELIRLNYRKLALKWHPDKHKGDSAATEKFQEINEAYNVLMDPAKRFEYDFTGIYEIHKYTLREYLARFKGMILTCNGLGISQSSSPWTHQLAETTKQQTSKDTV

SEQ ID NO: 13684 - protein, 394 aa, Arabidopsis thaliana
  misc_feature: Useful for biocontainment applications
MNSFSQVPPGFRFHPTDEELVDYYLRKKVASKRIEIDIIKDVDLYKIEPCDLQELCKIGNEEQSEWYFFSHKDKKYPTGTRTNRATKAGFWKATGRDKAIYIRHSLIGMRKTLVFYKGRAPNGQKSDWIMHEYRLETSENGTPQEEGWVVCRVFKKKLAATVRKMGDYHSSPSQHWYDDQLSFMASEIISSSPRQFLPNHHYNRHHHQQTLPCGLNAFNNNNPNLQCKQELELHYNQMVQHQQQNHHLRESMFLQLPQLESPTSNCNSDNNNNTRNISNLQKSSNISHEEQLQQGNQSFSSLYYDQGVEQMTTDWRVLDKFVASQLSNDEEAAAVVSSSSHQNNVKIDTRNTGYHVIDEGINLPENDSERVVEMGEEYSNAHAASTSSSCQIDL

SEQ ID NO: 13685 - protein, 305 aa, Panicum virgatum
  misc_feature: Useful for making plants with altered carbohydrate content
MDHQQQQQTPCVPPGFRFHPTEEELVGYYLARKVAAQKIDLDIIREVDLYRIEPWDLQERCSYYGGAGGQEDEPTEYYFFSYKDRKYPSGTRTNRATAAGFWKATGRDKPVLSSGRSSAACLSVIGMRKTLVFYRGRAPNGRKTDWIIHEYRLQNNEHAPAQEEGWVVCRAFQKPMPNQQQRHGCYAGSFPAGYPSMPTYYYDGSNAAAAAHARLLMGGAAAPAAMHDHTLVQAAESKLQVHLLADMPPPLHSPAFDAAGQSYEQSAAESSAVDWNLLSSLLPAAQLNFHQPPASPSCSKNNNDL

SEQ ID NO: 13686 - protein, 621 aa, Arabidopsis thaliana
  misc_feature: Useful for making plants with altered cell wall content and/or composition
MGSKHNPPGNNRSRSTLSLLVVVGLCCFFYLLGAWQKSGFGKGDSIAMEITKQAQCTDIVTDLDFEPHHNTVKIPHKADPKPVSFKPCDVKLKDYTPCQEQDRAMKFPRENMIYRERHCPPDNEKLRCLVPAPKGYMTPFPWPKSRDYVHYANAPFKSLTVEKAGQNWVQFQGNVFKFPGGGTMFPQGADAYIEELASVIPIKDGSVRTALDTGCGVASWGAYMLKRNVLTMSFAPRDNHEAQVQFALERGVPAIIAVLGSILLPYPARAFDMAQCSRCLIPWTANEGTYLMEVDRVLRPGGYWVLSGPPINWKTWHKTWNRTKAELNAEQKRIEGIAESLCWEKKYEKGDIAIFRKKINDRSCDRSTPVDTCKRKDTDDVWYKEIETCVTPFPKVSNEEEVAGGKLKKFPERLFAVPPSISKGLINGVDEESYQEDINLWKKRVTGYKRINRLIGSTRYRNVMDMNAGLGGFAAALESPKSWVMNVIPTINKNTLSVVYERGLIGIYHDWCEGFSTYPRTYDFIHASGVFSLYQHSCKLEDILLETDRILRPEGIVIFRDEVDVLNDVRKIVDGMRWDTKLMDHEDGPLVPEKILVATKQYWVAGDDGNNSPSSSNSEEE

SEQ ID NO: 13687 - protein, 251 aa, Populus balsamifera subsp. trichocarpa
  misc_feature: Useful for making plants with altered lignin content
MRKPDLVGKDRVPSNSSINKAKLRKGLWSPEEDEKLIKYMLTNGQGCWSDIARNAGLQRCGKSCRLRWINYLRPDLKRGAFSPQEEELIIHLHTILGNRWSQIAARLPGRTDNEIKNFWNSTLKKRLKINNTSTSSPNDSDSSEPRDHAIGNIMPTHDPDTMTLCMDSSSSSSISMQGMITSNRFDSFSMLNNRYDVTGAASLFDMSTCLTQVGMGDGFYGDHYGILEANNKTGLESDLSLPPLESRSFEE

SEQ ID NO: 13688 - protein, 271 aa, Arabidopsis thaliana
  misc_feature: Useful for making plants with altered lignin content
  misc_feature: Useful for making plants with altered terpenoid content
MGRTTWFDVDGLRKGEWTAEEDRKLVVYINEHGLGEWGSLPKRAGLQRCGKSCRLRWLNYLRPGIKRGKFTPQEEEEIIKYHALLGNRWAAIAKQMPNRTDNNIKNHWNSCLKKRLAKKGIDPMTHEPTTTTSLTVDVTSSSTTSSPTPSPTSSSFSSCSSTGSARFLNKLAAGISSRKHGLESIKTVILAEQPREAVDEEKMMTINMKEKELISCYMEIDETMSIDELPCDDSTSGFVAFDDYSLIDPYRDSVYVSDFYDETEHLDLFLL

SEQ ID NO: 13689 - protein, 248 aa, Arabidopsis thaliana
  misc_feature: Useful for making plants with enhanced nutritional value
  misc_feature: Useful for making plants with modulated heat sensitivity
MEGSSKGLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKKHEPCCKIKMKKRDITPIPTTPALKNNVYKPRPRSFTVNNDCNHLNAPPKVDVNPPCLGLNINNVCDNSIIYNKDKKKDQLVNNLIDGDNMWLEKFLEESQEVDILVPEATTTEKGDTLAFDVDQLWSLFDGETVKFD

SEQ ID NO: 13690 - protein, 69 aa, Arabidopsis thaliana
  misc_feature: Useful for making plants with altered cell wall content and/or composition
MADWGPVLIAVILFVVLSPGLLFQIPAGGRVVEFGNMQTSGASILVHAIIFFGLITIFTIAINVHIYSG

SEQ ID NO: 13691 - protein, 501 aa, Panicum virgatum
  misc_feature: Useful for making plants with altered carbohydrate content
MARLRCLFVLALLLGQLPGDAVAGRGHHGPAAHDYRDALAKSILFFEGQRSGRLPPSQRMSWRRDSGLSDGAAAKVDLVGGYHDAGDNVKFGFPMAFSMTMLAWSVVEFGGLMKAELQHAREAVRWGADYLLKATAHPDTIYVQVGDATKDHACWERPEDMDTPRTVYKVDAGTPGSDVAAETAAALAAASLVFRKADPAYAGRLLARAKRVFAFADRHRGSYSTGLAADVCPYYCSYSGYQDELLWGAAWLHRATRSPAYLGYIQANGQVLGAGEGDNTFGWDNKHAGARVLIARSLLVQRQGALREYRAHADAFICSMVPGTPADQTQYTRGGLLFKLSDSNMQYVTSSAFLLLTYAKYLAFARQTVSCGGGGGAVVTPQRLRAIARRQVDYLLGSNPAGMSYMVGYGARYPRRVHHRASSLPSVVAHPGRIGCSQGFAALYAGGANPNVLVGAVVGGPDLQDRFPDQRSDHEHSEPATYINAPLVGALAYLAHSYGQL

SEQ ID NO: 13692 - protein, 161 aa, Arabidopsis thaliana
  misc_feature: Useful for making plants with modulated heat sensitivity
MASFTCSSPSSILPIIDTRSGNLRCTFQSQVSCGIQRDDNGRRVWRRRTLTKKDDMLRYKMQRVPFVEEQVRKIREVGKVMTMDIEQLLLREDNRFEFVNSVAAEATEYVDKNRDEYGGSKKAIFHVLSNRVNDLGFDRPEAYVEADPYKPGPGYLLEYYT

SEQ ID NO: 13693 - protein, 337 aa, Panicum virgatum
  misc_feature: Useful for making plants with altered carbohydrate content
MAQPPRVCVTGGGGFIASWLVKLLLSRGYAVHATLRDPGNPKNAHLKELDNAPENLLLFKADVLDYDTLTPAVEGCEGVFHLATPVPEDKIVDPESQLDTAVKGTLNILKVCSAAKVQKLVVMSSNAAVDFNPNWPQDIIKDESCWSDKEFCKENGDWYSVAKIMGEQAALEYADKNGLNVVTLCPPLVFGPLLQPTVNTSSKFLIYVIKGGPDVMNNKLWHIVDVRDVADALLLLYEKEESSGRYICSPHHIRTRDLVALLKKMHPEYNYVDNILDVDQKASLTCQKLMDLGWEPRTTLEETLSDCVECYEKAGALQDVPGRPRRLPHLFRLAGDQ

SEQ ID NO: 13694 - protein, 189 aa, Arabidopsis thaliana
  misc_feature: Useful for making plants with altered cell wall content and/or composition
MAVKQKVCVTGAGGFIASWLVKFLLSRGYTVHGTVRDPCDEKNDHLRKLDNASKNLKLFKADLFDDEGLFSAIDGCSGVFHIASPVPFEGVPLTEEELIKPALTGTKNVLEACTETKVQKVVVVSSIAAVVYNPKWPQDVAKDEDCWSDTQYLHSLEGYWRYYYLAKTLTEREALEWSKRNFADVVTLC

SEQ ID NO: 13695 - protein, 549 aa, Panicum virgatum
  misc_feature: Useful for making plants with altered carbohydrate content
MGSVDESVAAAVAAPAAEVVFRSKLPDIEINNSQPLHTYCFGKMAEVAGRPCLIDGQTGASYTYAEVESLSRRAAAGLRRMGVGRGDVVMNLLRNCPEFAFSFLGAARLGAATTTANPFYTPHEIHRQAEAAGARLIVTEACAVEKVREFAAARGIPVVTVDGRFDGCAEFAEVIAAEELEADADIQPDDVVALPYSSGTTGLPKGVMLTHRSLITSVAQQVDGENPNLHFRTDDVLLCLLPLFHIYSLNSVLLAGLRAGCAIVIMRKFDLGALVDLVRAHGVTIAPFVPPIVVEIAKSPRVTAADLASIRMVMSGAAPMGRELQDAFMTKIPNAVLGQGYGMTEAGPVLAMCLAFAKEPFQVKSGSCGTVVRNAELKIVDPDTGAALGRNQPGEICIRGEQIMKGYLNDPESTKNTIDKDGWLHTGDIGYVDDDDEIFIVDRLKEIIKYKGFQVPPAELEALLITHPEIKDAAVVSMKDDLAGEIPVAFIVRTEGSQLTEDEIKQFVAKEVVFYKKIHKVFFTDSIPKNPSGKILRKDLRARLAAGVH

SEQ ID NO: 13696 - protein, 556 aa, Arabidopsis thaliana
  misc_feature: Useful for making plants with altered cell wall content and/or composition
MTTQDVIVNDQNDQKQCSNDVIFRSRLPDIYIPNHLPLHDYIFENISEFAAKPCLINGPTGEVYTYADVHVTSRKLAAGLHNLGVKQHDVVMILLPNSPEVVLTFLAASFIGAITTSANPFFTPAEISKQAKASAAKLIVTQSRYVDKIKNLQNDGVLIVTTDSDAIPENCLRFSELTQSEEPRVDSIPEKISPEDVVALPFSSGTTGLPKGVMLTHKGLVTSVAQQVDGENPNLYFNRDDVILCVLPMFHIYALNSIMLCSLRVGATILIMPKFEITLLLEQIQRCKVTVAMVVPPIVLAIAKSPETEKYDLSSVRMVKSGAAPLGKELEDAISAKFPNAKLGQGYGMTEAGPVLAMSLGFAKEPFPVKSGACGTVVRNAEMKILDPDTGDSLPRNKPGEICIRGNQIMKGYLNDPLATASTIDKDGWLHTGDVGFIDDDDELFIVDRLKELIKYKGFQVAPAELESLLIGHPEINDVAVVAMKEEDAGEVPVAFVVRSKDSNISEDEIKQFVSKQVVFYKRINKVFFTDSIPKAPSGKILRKDLRARLANGLMN

SEQ ID NO: 13697 - protein, 342 aa, Panicum virgatum
  misc_feature: Useful for making plants with altered carbohydrate content
MEAGAAGLLLAALMVVVGWPAAAASLDTSPVPFQAGYMPLFGGDNLVRSPGGRSVRLKLDRRTGSGFVSKSAYHHGYFSASIKLPDDHTAGVVVAFYLSNADVYPRNHDEVDFELLGNRRGHEWRVQTNVYGNGSTSRGREERYLLPFDPTLRPHAYAVAWTPTAVVFYVDGAPIREVVRAPAMGGDFPSKPMSVYATIWDGSAWATEGGRYKVDYAHAPFAADFSRLVLAGCPPAGGGARCAVAVITAEFAVMTPAKRAAMRRFRRRHLLYTVCHDRYRYNGTVFPECDDAERDDFHKWGESKRVSPGRRGYRRQQQPRADKAAAGGRPSTWPTIGTLRAD

SEQ ID NO: 13698 - protein, 333 aa, Arabidopsis thaliana
  misc_feature: Useful for making plants with altered cell wall content and/or composition
METLSRLLVFMSLFSGLVSGFALQNLPITSFEESYTQLFGDKNLFVHQDGKSVRLTLDERTGSGFVSNDYYLHGFFSASIKLPSDYTAGVVVAFYMSNGDMYEKNHDEIDFEFLGNIREKEWRVQTNIYGNGSTHSGREERYNLWFDPTEDFHQYSILWSDSHIIFFVDNVPIREVKRTAEMGGHFPSKPMSLYTTIWDGSKWATNGGKYGVNYKYAPYIARFSDLVLHGCPVDPIEQFPRCDEGAAEDMRAAQEITPSQRSKMDVFRRRLMTYSYCYDRARYNVALSECVVNPAEAQRLRVYDPVRFGGIPRRHRNGKHRSKRSRVDGTESI

SEQ ID NO: 13699 - protein, 345 aa, Arabidopsis thaliana
  misc_feature: Useful for making plants with modulated heat sensitivity
MEELKVEMEEETVTFTGSVAASSSVGSSSSPRPMEGLNETGPPPFLTKTYEMVEDPATDTVVSWSNGRNSFVVWDSHKFSTTLLPRYFKHSNFSSFIRQLNTYGFRKIDPDRWEFANEGFLAGQKHLLKNIKRRRNMGLQNVNQQGSGMSCVEVGQYGFDGEVERLKRDHGVLVAEVVRLRQQQHSSKSQVAAMEQRLLVTEKRQQQMMTFLAKALNNPNFVQQFAVMSKEKKSLFGLDVGRKRRLTSTPSLGTMEENLLHDQEFDRMKDDMEMLFAAAIDDEANNSMPTKEEQCLEAMNVMMRDGNLEAALDVKVEDLVGSPLDWDSQDLHDMVDQMGFLGSEP

SEQ ID NO: 13700 - protein, 495 aa, Arabidopsis thaliana
  misc_feature: Useful for making plants with modulated biomass
  misc_feature: Useful for making plants with modulated heat sensitivity
MFVNFKYFSFFIRTKMDGVTGGGTNIGEAVTAPPPRNPHPATLLNANSLPPPFLSKTYDMVEDPATDAIVSWSPTNNSFIVWDPPEFSRDLLPKYFKHNNFSSFVRQLNTYGFRKVDPDRWEFANEGFLRGQKHLLKKISRRKSVQGHGSSSSNPQSQQLSQGQGSMAALSSCVEVGKFGLEEEVEQLKRDKNVLMQELVKLRQQQQTTDNKLQVLVKHLQVMEQRQQQIMSFLAKAVQNPTFLSQFIQKQTDSNMHVTEANKKRRLREDSTAATESNSHSHSLEASDGQIVKYQPLRNDSMMWNMMKTDDKYPFLDGFSSPNQVSGVTLQEVLPITSGQSQAYASVPSGQPLSYLPSTSTSLPDTIMPETSQIPQLTRESINDFPTENFMDTEKNVPEAFISPSPFLDGGSVPIQLEGIPEDPEIDELMSNFEFLEEYMPESPVFGDATTLENNNNNNNNNNNNNNNNNNNNTNGRHMDKLIEELGLLTSETEH

SEQ ID NO: 13701 - protein, 564 aa, Panicum virgatum
  misc_feature: Useful for making plants with altered carbohydrate content
MACTQEVVFDLNLIENSALEDGLAGWSPVGSCTALSVHEEEPAKVPTETINDVGEDYRPSGRYILASGRADEADGLRQAIKGALKPRVTYRVAGWISLGGAAAADAEGAGHAVRVNLRLDDDECVVEGGAVCAEVGKWAEIKGAFRLKKSPRAAAVYVQGAPAGVDVKVMDLQVFATDRKARFRKLRRKTDKVRKRDVVLNFGSAAASGISGASVRVMQMDSSFPFGACINPAVIQDPAFVDFFTKHFDWAVFENELKWYHTEAQQGQLNYADSDALLDFCDRYGKPVRGHCIFWAVENTVQQWVKSLDKDQLTAAVQARLQSLLTRYAGRFPHYDVNNEMLHGSFYRDRLGNDVDAFMFREAARLDPGAALFVNDYNVEGGNDPNATPEKYIEQIAALQQKGAPVGGIGLQGHVTNPVGEVICDALDKLSAATDLPVWLTELDVCESDVDLRADDLEVVLREAYAHPAVEGVVFWGFMQGHMWRQDACLVNSDGTVNDAGERFVDLRREWTSHARGHIDSAGHFKFRGYHGTYVVQLATATGKVHKTFSVEKGDTPLVLDMNI

SEQ ID NO: 13702 - protein, 517 aa, Arabidopsis thaliana
  misc_feature: Useful for making plants with modulated nitrogen use efficiency
MAMAMALRRLSSSIDKPIRPLIRSTSCYMSSLPSEAVDEKERSRVTWPKQLNAPLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALDLPHGGHLSHGYQTDTKKISAVSIFFETMPYRLDESTGYIDYDQMEKSATLFRPKLIVAGASAYARLYDYARIRKVCNKQKAVMLADMAHISGLVAANVIPSPFDYADVVTTTTHKSLRGPRGAMIFFRKGVKEINKQGKEVLYDFEDKINQAVFPGLQGGPHNHTITGLAVALKQATTSEYKAYQEQVLSNSAKFAQTLMERGYELVSGGTDNHLVLVNLKPKGIDGSRVEKVLEAVHIASNKNTVPGDVSAMVPGGIRMGTPALTSRGFVEEDFAKVAEYFDKAVTIALKVKSEAQGTKLKDFVSAMESSSTIQSEIAKLRHEVEEFAKQFPTIGFEKETMKYKN

SEQ ID NO: 13703 - protein, 371 aa, Arabidopsis thaliana
  misc_feature: Useful for making plants with altered cell wall content and/or composition
MEIGSSSTVAGGGQLSVPPGFRFHPTEEELLYYYLKKKVSYEPIDLDVIREVDLNKLEPWELKEKCRIGSGPQNEWYFFSHKDKKYPTGTRTNRATAAGFWKATGRDKSIHLNSSKKIGLRKTLVFYTGRAPHGQKTEWIMHEYRLDDSENEIQEDGWVVCRVFKKKNHFRGFHQEQEQDHHHHHQYISTNNDHDHHHHIDSNSNNHSPLILHPLDHHHHHHHIGRQIHMPLHEFANTLSHGSMHLPQLFSPDSAAAAAAAAASAQPFVSPINTTDIECSQNLLRLTSNNNYGGDWSFLDKLLTTGNMNQQQQQQVQNHQAKCFGDLSNNDNNDQADHLGNNNGGSSSSPVNQRFPFHYLGNDANLLKFPK

SEQ ID NO: 13704 - protein, 89 aa, Arabidopsis thaliana
  misc_feature: Useful for making plants with altered lignin content
  misc_feature: Useful for making plants with modulated nitrogen use efficiency
MEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 13705 - protein, 338 aa, Panicum virgatum
  misc_feature: Useful for making plants with altered carbohydrate content
MAGSSTVCVTGAGGFIASWLVKLLLSRGYTVHGTVRDLGDKKSAHLKRLEYAAESLRIFKADLLDYDAMAAAIVGCQGVFHVATPVPSEKLTDLELQMLAPAVTGTTNVLRAASAAGVQRVVVVSSIVAVEINPKDWPEGKIRDESCWSDEEFCRNNNIWYPVAKIISEEAALEYGRQTGLDVVSVNPGLVFGPMLQPTVNASSQFLIYLLKGGPDKVRNKLWHIVDVRDLAEALLLVYEGAGASGRHICAPHVVSVRELLDSLKSNYPDYPCIAKESVFDRDHPAPMSSEKLKKLGWSFRPLEETIADAIGFCQRAGFLGDADGAAPCRFPPLFNQI

SEQ ID NO: 13706 - protein, 131 aa, Arabidopsis thaliana
  misc_feature: Useful for making plants with altered terpenoid content
  misc_feature: Useful for making plants with modulated flowering time
  misc_feature (9)..(9): Xaa is any aa, unknown, or other
MSMRRSKAXGKRSLRELSEEEEEEEETEDEDTFEEEEALEKKQKGKATSSSGVCQVESCTADISKAKQYHKRHKVCQFHAKAPHVRISGLHQRFCQQCSRFHALSEFDEAKRSCRRRLAGHNERRRKSTTD

SEQ ID NO: 13707 - protein, 131 aa, Oryza sativa
  misc_feature: Useful for biocontainment applications
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 13708 - protein, 826 aa, Panicum virgatum
  misc_feature: Useful for making plants with altered carbohydrate content
MAAAMVVGGAGKDRSSPGGGGAPQVDTGKYVRYTPEQVEALERVYSECPKPSSLRRQQLIRECPILSNIEPKQIKVWFQNRRCREKQRKEASRLQTVNRKLTAMNKLLMEENDRLQKQVSRLVYENGYMKQQLHNPSVATTDTSCESVVTSGQHHQQQNAAAPRPQRDANNPAGLLAIAEETLAEFLSKATGTAVDWVQMVGMKPGPDSIGIIAVSHNCSGVAARACGLVSLEPTKVAEILKDRPSWYRDCRCVDILHVIPTGNGGTIELIYMQTYAPTTLAAPRDFWTLRYTSGLEDGSLVICERSLTQSTGGPSGPNTPNFVRAEVLPSGYLIRPCEGGGSMIHIVDHVDLDAWSVPEVLRPLYESPKILAQKTTIAALRHIRQIAHESSGEMPYGGGRQPAVLRTFSQRLSRGFNDAVNGFPDDGWSLMSSDGSEDVTIAINSSPNKLVGSHVNSSQLFSAIGGGILCAKASMLLQNVPPALLVRFLREHRSEWADPGVDAYSAAALRASPYAVPGLRASGFMGSQVILPLAHTLEHEEFLEVIRLEGHSLCHDEVVLSRDMYLLQLCSGVDENAAGACAQLVFAPIDESFADDAPLLPSGFRVIPLDAKMDPPSGTRTLDLASTLEVGSGGTTRASSDASSTCNTRSVLTIAFQFSYENHLRESVAAMARQYVRTVVASVQRVAMAIAPSRLGGQLEMKQTPGSPEAHTLARWIGRSYRFHTGAELLRADTQCTDASLKALWQHSDSIMCCSLKAAPVFTFANQAGLDMLETTLIALQDISLEKILDDDGRKALCTEYPKIMQQGFAYLPGGVCVSSMGRPV

SEQ ID NO: 13709 - protein, 435 aa, Arabidopsis thaliana
  misc_feature: Useful for making plants with modulated heat sensitivity
MASSVLSECGFRPLPRFYPKHTTSFASNPKPTFKFNPPLKPPSSLLNSRYGFYSKTRNWALNVATPLTTLQSPSEEDTERFDPGAPPPFNLADIRAAIPKHCWVKNPWMSMSYVVRDVAIVFGLAAVAAYFNNWLLWPLYWFAQGTMFWALFVLGHDCGHGSFSNDPRLNSVAGHLLHSSILVPYHGWRISHRTHHQNHGHVENDESWHPLPESIYKNLEKTTQMFRFTLPFPMLAYPFYLWNRSPGKQGSHYHPDSDLFLPKEKKDVLTSTACWTAMAALLVCLNFVMGPIQMLKLYGIPYWIFVMWLDFVTYLHHHGHEDKLPWYRGKEWSYLRGGLTTLDRDYGWINNIHHDIGTHVIHHLFPQIPHYHLVEATEAAKPVLGKYYREPKNSGPLPLHLLGSLIKSMKQDHFVSDTGDVVYYEADPKLNGQRT

SEQ ID NO: 13710 - protein, 458 aa, Glycine max
  misc_feature: Useful for making plants with modulated oxidative stress sensitivity
MVRENAVMGGASEERGVRVTRAMARAVLGGVSASSRPSFKKQHKNNKGFGRVALADVTNISKKGCATSKSQARGGYKKTNTKGASNVSIQVLSTQEDVRAKLAKDLPSISMVQSHDANVAERQEGTEVVQPSMSVMAGPLLSMQDSMKSDEILRSPNKDVDMMITEKLKLSDGLDIVDIDSVELKDPQVWSSYAPDIYNSIFVREFERRPSSDYMDMLQQDITPSMRGILIDWLVEVSEEYKLLPDTLYLTVNLIDRSLSQSLVQKQRLQLLGVTCMLIASKYEEICAPRVEEFCFITDNTYTKAEVLKMESEVLNLLHFQLSVPTTKTFLRRFILASQSSYKVSYVELEFLANYLAELTLVEYSFLQFLPSLIAASAVLLARWTLNQSEHPWNSTMEHYTNYKVSELKTTVLALADLQHDMKGCSLNSIREKYKQQKFRSVANLSPKPVQSLFKAQV

SEQ ID NO: 13711 - protein, 531 aa, Arabidopsis thaliana
  misc_feature: Useful for making plants with altered cell wall content and/or composition
MESQLWNWILPLLISSLLISFVAFYGFFVKPKRNGLRHDRKTVSTVTSDVGSVNITGDTVADVIVVGAGVAGSALAYTLGKDKRRVHVIERDLSEPDRIVGELLQPGGYLKLLELGIEDCVEEIDAQRVYGYALFKNGKRIRLAYPLEKFHEDVSGRSFHNGRFIQRMREKAASLPNVQLEQGTVLSLLEENGTIKGVRYKNKAGEEQTAFAALTIVCDGCFSNLRRSLCNPQVEVPSCFVGLVLENCNLPYANHGHVVLADPSPILMYPISSTEVRCLVDVPGQKVPSIANGEMKNYLKTVVAPQMPHEVYDSFIAAVDKGNIKSMPNRSMPASPYPTPGALLMGDAFNMRHPLTGGGMTVALADIVVLRNLLRPLRDLSDGASLCKYLESFYTLRKPVAATINTLANALYQVFCSSENEARNEMREACFDYLGLGGMCTSGPVSLLSGLNPRPLTLVCHFFAVAVYGVIRLLIPFPSPKRIWLGAKLISGASGIIFPIIKAEGVRQMFFPATVPAYYYKAPTVGETKCS

SEQ ID NO: 13712 - protein, 996 aa, Arabidopsis thaliana
  misc_feature: Useful for making plants with modulated light quality sensitivity
MEPTEKPSTKPSSRTLPRDTRGSLEVFNPSTQLTRPDNPVFRPEPPAWQNLSDPRGTSPQPRPQQEPAPSNPVRSDQEIAVTTSWMALKDPSPETISKKTITAEKPQKSAVAAEQRAAEWGLVLKTDTKTGKPQGVGVRNSGGTENDPNGKKTTSQRNSQNSCRSSGEMSDGDVPGGRSGIPRVSEDLKDALSTFQQTFVVSDATKPDYPIMYASAGFFNMTGYTSKEVVGRNCRFLQGSGTDADELAKIRETLAAGNNYCGRILNYKKDGTSFWNLLTIAPIKDESGKVLKFIGMQVEVSKHTEGAKEKALRPNGLPESLIRYDARQKDMATNSVTELVEAVKRPRALSESTNLHPFMTKSESDELPKKPARRMSENVVPSGRRNSGGGRRNSMQRINEIPEKKSRKSSLSFMGIKKKSESLDESIDDGFIEYGEEDDEISDRDERPESVDDKVRQKEMRKGIDLATTLERIEKNFVITDPRLPDNPIIFASDSFLELTEYSREEILGRNCRFLQGPETDLTTVKKIRNAIDNQTEVTVQLINYTKSGKKFWNIFHLQPMRDQKGEVQYFIGVQLDGSKHVEPVRNVIEETAVKEGEDLVKKTAVNIDEAVRELPDANMTPEDLWANHSKVVHCKPHRKDSPPWIAIQKVLESGEPIGLKHFKPVKPLGSGDTGSVHLVELVGTDQLFAMKAMDKAVMLNRNKVHRARAEREILDLLDHPFLPALYASFQTKTHICLITDYYPGGELFMLLDRQPRKVLKEDAVRFYAAQVVVALEYLHCQGIIYRDLKPENVLIQGNGDISLSDFDLSCLTSCKPQLLIPSIDEKKKKKQQKSQQTPIFMAEPMRASNSFVGTEEYIAPEIISGAGHTSAVDWWALGILMYEMLYGYTPFRGKTRQKTFTNVLQKDLKFPASIPASLQVKQLIFRLLQRDPKKRLGCFEGANEVKQHSFFKGINWALIRCTNPPELETPIFSGEAENGEKVVDPELEDLQTNVF

SEQ ID NO: 13713 - protein, 240 aa, Panicum virgatum
  misc_feature: Useful for making plants with altered carbohydrate content
MAALRRAAAVACVLALALGAAAQLTPTFYDGSCPRLQSIVRAGMAAAVQQEPRMGASILRLFFHDCFVQGCDASVLLDDSATLTGEKNAGPNANSLRGYEVIDAIKSQVEAACPDVVSCADILALAARDGVNLLSGPTWAVPLGRRDTRTASQAAANSNLPSPSSSAAALVSAFASKAWTRATWWRSRARTPWGRRGARASGRACTTTPTSAPGSRRSDGRSARRKAAAPPTATWRRWTR

SEQ ID NO: 13714 - protein, 313 aa, Panicum virgatum
  misc_feature: Useful for making plants with altered carbohydrate content
MEARGGRGSSPAGGAARLRVALVWVLLLAAAAGSRAQLQVGFYDTLCPAAEIIVQEEVSKAVSGNPGVAASLVRLHFHDCFVRGCDASVLLDSTPGNTAEKDAPPNTSLRGFEVIDSAKTRLEQACFGVVSCADVLAFAARDALALVGGNAYQVPSGRRDGNVSVAQETNGNLPPPTASVSQLNQIFGSKGLSQADMVTLSGAHTIGSAHCSSFDSRLYSYGPNAAGQDPSMDPVTPTALDTNYYASIVAKRGLLASDQALLADPTTAAQVVAYTNSPDTFQTDFAAAMVKMGAIGVLTGTAGTIRANCRVAN

SEQ ID NO: 13715 - protein, 317 aa, Arabidopsis thaliana
  misc_feature: Useful for making plants with altered cell wall content and/or composition
MNAHMLNLLVIVIFVVSFDVQALSPHYYDHTCPQADHIVTNAVKKAMSNDQTVPAALLRMHFHDCFVRGCDGSVLLDSKGKNKAEKDGPPNISLHAFYVIDNAKKALEEQCPGIVSCADILSLAARDAVALSGGPTWAVPKGRKDGRISKAIETRQLPAPTFNISQLRQNFGQRGLSMHDLVALSGGHTLGFAHCSSFQNRLHKFNTQKEVDPTLNPSFAARLEGVCPAHNTVKNAGSNMDGTVTSFDNIYYKMLIQGKSLFSSDESLLAVPSTKKLVAKYANSNEEFERAFVKSMIKMSSISGNGNEVRLNCRRVR

SEQ ID NO: 13716 - protein, 498 aa, Panicum virgatum
  misc_feature: Useful for making plants with altered carbohydrate content
MVETGGGRLHQRRGAAAFVAANRTLLAAAWVVGFALVFLWQSASISLRSGGGGSGGVLLGLLSGPLPPPRPAPRLRPAAYNLTDFGGVGDGRALNTGAFERAVEAIAALAERGGGQLNVPPGRWLTAPFNLTSHMTLFLAEGAEILGIPDEKYWPLMPALPSYGYGRERKGPRFGSLIHGQNLRDVVITGHNGSINGQGEVWWMKHHRRMLNSTRPPLVQLMWSKDIIVANITLRNSPFWHFHPYDCTNVTVSNVTILSPVSGAPNTDGIDPDSCQDVLIENCYISVGDDAIAVKSGWDQYGIAYGRPSSNISIRNVTARSLVSAGISIGSEMSGGVANVTVENVRIWESRRGVRIKTATGRGGYIRNISYRNITFDNVRAGIVIKVDYNEHADDGYDRNAFPDITSISFKEIHGRGVRVPVRAHGSDVIPVKDISFQDMSVGISYKKKHIFQCSYVEGRVIGSVFPKPCENLDVYNEQGQLVKRAVSLNSTELDYDI

SEQ ID NO: 13717 - protein, 506 aa, Arabidopsis thaliana
  misc_feature: Useful for making plants with altered cell wall content and/or composition
MVENLFPSRFQFHLQRLDPKRRLTSLLASHKTLFTFLWITAFGSVFLWQRTAYIEGGSGTGPVGGKFTIFGKIKPIQPIPRLRPVVFDLKDFGGVGDGFTLNTEAFERAVISISKLGGSSGGGQLNVPPGRWLTAPFNLTSHMTLFLAEDSEILGVEDEKYWPLMPPLPSYGYGRERPGPRYGSLIHGQNLKDIVITGHNGTINGQGQSWWKKHQRRLLNYTRGPLVQIMWSSDIVIANITMRDSPFWTLHPYDCKNVTIRNVTILAPVTGAPNTDGIDPDSCEDMVIEDCYISTGDDAIAIKSGWDQFGIAYGRPSTNILIRNLVVRSVISAGVSIGSEMSGGISNVTIENLLIWNSRRGIRIKTAPGRGGYIRNITYKNLTLDNVRVGIVIKTDYNEHADDNYDRKAYPILSGFSFAGIHGQGVRVPVRIHGSEQIPVRNVTFRDMSVGLTYKKKHIFQCSFVKGRVFGSIFPRPCENFDVYDEEGRLVKPAAESNVADIDYDI

SEQ ID NO: 13718 - protein, 475 aa, Arabidopsis thaliana
  misc_feature: Useful for making plants with altered cell wall content and/or composition
MRRLSGILVIYIISTVLFGHFTNVARARYHYHKGRHGVTHPLPPPPPPPLETANPPDQVPSDPYPSPDPAPGDSDSGCVFDVTSFGAVGDGSCDDTAAFQDAWKAACAVESGVVLAPEGGVFKITSTIFSGPCKPGLVFQLDGVLMPPDGPEEWPEKDNKNQWLVFYRLDGFTFSGKGTVEGNGQKWWDLPCKPHRGPDGSSSSGPCASPTMIRFFMSNNIEVKGLRIQNSPQFHMKFDGCQGVLINEIQISSPKLSPNTDGIHLGNTRSVGIYNSVVSNGDDCISIGTGCSDVDIQGVTCGPSHGISIGSLGVHNSQACVSNITVRNTVIRDSDNGLRVKTWQGGTGSVSNLLFENIQMENVLNCIIVDQYYCQSKDCRNETSAVKVFDVEYRNIKGTYDVRSPPIHFACSDTVACTNITMSEVELLPEEGELVDDPFCWNAYGKQETLTIPPIDCLLDGSPVVEEAYDSNYGC

SEQ ID NO: 13719 - protein, 164 aa, Arabidopsis thaliana
  misc_feature: Useful for making plants with modulated water use efficiency
MAESASNTASEKLIQIDVSSDSVCPWCFVGKKNLDKAIEASKDQYNFEIRWRPFFLDPSAPKEGVSKREFYLQKYGNRYQGMFARMSEVFKGLGLEFDTAGLTGSSLDSHRLIHYTGKQAPEKQHKLVEELFNGYFTQGKFIGDREFLVETANKVGVESRRIPL

SEQ ID NO: 13720 - protein, 464 aa, Arabidopsis thaliana; identical to SEQ ID NO: 12881
  misc_feature: Useful for making plants with modulated nitrogen use efficiency

SEQ ID NO: 13721 - protein, 265 aa, Panicum virgatum
  misc_feature: Useful for making plants with altered carbohydrate content
MSIHGLILEVRVTGCRKLRDTEFFTRQDPYVVLEYATTKLRTRTCTDGGRNPTFDEKFHIPLIEGLRELNVVVWNSNTLTHDDFIGSGRVYLHKVLANGYDDSSWPLQTRHMRSAGEVKLIMHVDVSAMKNKMGKSIGAASTHSVPPPSVPAPAPAAAAAPALASAVPYTGVPPSYPPAPAYPVASAYPAYPTPSQSPYTTTEYPPPPQQAYPPPSAGYPPSYPPQPYGQSYPPQPYGQPYPPPPEAQSPYPPAPYPGTYPPRPY

SEQ ID NO: 13722 - protein, 247 aa, Arabidopsis thaliana
  misc_feature: Useful for making plants with altered cell wall content and/or composition
MSMMAGIQGQILEVTVVGCQKLKDTEWFSRQDPYVVLEYGGRSHRTRTCTDGGKNAVFQEKFIFTLIEGLRDLKVAVWNSNTLSTDDFIGNATIQLQKVLSQEYDDCTWTLQSKTGRFAGEVQLLLHYAGAKKHNYGSAPSAPYAPHVPQYSAPPSASPYSTAPPYSGPSLYPQVQQYPQPSGYPPASGYPPQPSAYPPPSTSGYPPIPSAYPPPPPSSAYPPQPYPPQPSYYPQGPYPGQYPPPPY

SEQ ID NO: 13723 - protein, 241 aa, Arabidopsis thaliana
  misc_feature: Useful for making plants with modulated nitrogen use efficiency
MAFLVRSPEIPTVSARIFSDANSSVISHVFMRRKATVSAIDARDLPGVKNPKSRLYWQFSAPVKEDYKISREEEEEEEEDKQSYYVNMGHAVRSIREEFPLLFYKELNFDIYRDDIVFKDPMNTFMGIDNYKSIFGALRFHGRIFFRALCVDIVSVWQPTENTLMIRWTVHGIPRGPWETRGRFDGTSEYKFDKNGKIYEHKVDNIAINSPPKFQMLTVQELVEAISCPSTPKPTYFEFGD

SEQ ID NO: 13724 - protein, 194 aa, Glycine max
  misc_feature: Useful for biocontainment applications
  misc_feature: Useful for making plants with modulated flowering time
MRVSTEKLETEPESKKIKRIRGGGGGDSSNKHPLYRGVRMRNWGKWVSEIREPRKKSRIWLGTFPTPEMAARAHDVAALSIKGSAAILNFPHFANSLPRPASLAPRDVQAAAAKAAHMDPSSLSSLVSAMDLSSASDELSQIIELPSLESTDDGSVVLEKEFVFVDSLDAWMYQPPFGFDTEQDTGFEGLMWNY

SEQ ID NO: 13725 - protein, 374 aa, Arabidopsis thaliana
  misc_feature: Useful for making plants with modulated flowering time
  misc_feature: Useful for making plants with modulated low light sensitivity
MTNQNVIVSDRKPILGLKTITVSVSNSPLFSNSFPTYFNFPRRKLLKLLEAADKNNLVVAPKITSMIDSMRDSSPTRLRSSSYDSVSDNDDKTSWIVRFPSALNMFDEIVNAAKGKQIVMFLDYDGTLSPIVEDPDKAFITHEMREVVKDVASNFPTAIVTGRSIEKVRSFVQVNEIYYAGSHGMDIEGPTNENSNGQSNERVLFQPAREFLPMIEKVVNILEEKTKWIPGAMVENNKFCLSVHFRRVDEKRWPALAEVVKSVLIDYPKLKLTQGRKVLEIRPTIKWDKGQALNFLLKSLGYENSDDVVPVYIGDDRTDEDAFKVLRERGQGFGILVSKVPKDTNASYSLQDPSQVNKFLERLVEWKRKTVGEE

SEQ ID NO: 13726 - protein, 653 aa, Nicotiana tabacum
  misc_feature: Useful for making plants with modulated heat sensitivity
MAPAVGIDLGTTYSCVGIFREIGKCDIIANDQGNRTTPSFVGFTDTERLIGDAAKNQVAMNPQNTVFDAKRLIGRKFADPEVQADMKHFPFKIVDKGGKPNIEVEFKGETKTFTPEEISAMILTKMRETAESYLGETVTNAVVTVPAYFNDSQRQATKDAGLIAGLNVLRIINEPTAAAIAYGLDKKVEGERNVLIFDLGGGTFDVSLLTIEEGIFEVKSTAGDTHLGGEDFDNRLVNHFVNEFKRKHKKDLSTNVRALRRLRTACERAKRTLSSSAQTSIEIDSLFEGIDFYTSITRARFEELCQDLFRSTIQPVDRVLTDAKIDKSLVHEIVLVGGSTRILRVQKLITDYFNGKEPNKSINPDEAVAYGAAVQAAILSGDTSSKATNEILLLDVAPLSLGIETAGGMMTKLIPRNTTIPTKKSEVFSTFSDNQPGVLIQVYEGERQRTKDNNLMGKFELTGIPPAPRGVPQIEVTFDLDANGIMNVSAVEKGTGKSNKIVITNDKGRLSKEEIERMLSDAEKYKEEDEAEGKRVAAKNGLESYAYSLRNTLSDPKVEEKIEASDKETLTAEIDKVVQWLDDNQQATREEYEEHQKELEGKANPIMMKFYGAGGEGAPGGMPGGPGGFPGAGGPGGAPGAGGDDGPTVEEVD

SEQ ID NO: 13727 - protein, 319 aa, Panicum virgatum
  misc_feature: Useful for making plants with altered carbohydrate content
MPRPPTPTGGTSPPASPPTRSSPPRPTSASSTAPTSSPTAGPPWSPTRSTPPPPSCGGHAGAGGSDWDWFINLSASDYPLVTQDDLIHVFSKLPRDLNFIDHTSDIGWKEFQRAKPVIIDPGLYMRKKADVFWIPQRRSVPTAFKLFTGSAWMALSRPFVEYCIWGWDNLPRTVLMYYSNFISSPEGYFHTVVCNAEEFKNTTVNHDLHYISWDNPPKQHPHYLTVEDLDRMVASDAPFARKFHANDPVLDKIDDEILSRGADMPTPGGWCAGTRENGSDPCSVIGDTSLLLPGRGAVRLQRLVTSLLSEEKFHPRQCK

SEQ ID NO: 13728 - protein, 214 aa, Panicum virgatum
  misc_feature: Useful for making plants with altered carbohydrate content
MAAPTFPALLLSAVLLLLLPPPPGAEAVWLELPPSGTKCVSEEIQPNVVVLADYAIMYESHPTSHPTVAVKVTSPYGNTVHHNENATTGQFAFTTSEAGNYLACFWIDSAEKGSGTSLNLDWKMGIAAKDWDTIAKKEKIEGVELELRKLEAAVESIHHNLLYLKAREADMRTVSEKTNSRVAWFSVLSLGVCIVVSVLQLWHLQGFFRKKKLI

SEQ ID NO: 13729 - protein, 217 aa, Arabidopsis thaliana
  misc_feature: Useful for making plants with altered cell wall content and/or composition
MKMTAKMRREFPTAFLLLFLVPVMIPVGEAVWLDVPPTGTKCVSEEIQSNVVVLADYLIISEDHEVMPTISVKVTSPYGNNLHNMENVTHGQFAFTTQESGNYLACFWADEKSHGNKNVSINIDWRTGIAAKDWASIAKKEKIEGVELEIRKLEGAVEAIHENILYLRNREADMRTMSEKTNSRVAWYSIMSLGVCIAVSGFQVLYLKQYFEKKKLI

SEQ ID NO: 13730 - protein, 273 aa, Arabidopsis thaliana
  misc_feature: Useful for making plants with modulated water use efficiency
MSFVFRGSRGDLESGFSGGFLPERRAMRVHGARPVNSNSLAFLVTVLLLFMILNSHQMPPNFLLWLVLGVFLMATTLRMYATCQQLQAHAQAQAAAASGLFSHTELRLHVPPSIALATRGRLQGLRLQLALLDREFDDLDYETLRALDSDNVSTTSMSEEEINALPVHKYKVLDPENGCSLAKQASTSSSAEKMLDSANESKKGTEDELTCSVCLEQVTVGEIVRTLPCLHQFHAGCIDPWLRQQGTCPVCKFRAHSGWQEQDEIDDDASDMV

SEQ ID NO: 13731 - protein, 380 aa, Arabidopsis thaliana
  misc_feature: Useful for making plants with modulated nitrogen use efficiency
MSASDSTSSLPVTLDSINPKVLKCEYAVRGEIVNIAQKLQEDLKTNKDAYPFDEIIYCNIGNPQSLGQLPIKFFREVLALCDHASLLDESETHGLFSTDSIDRAWRILDHIPGRATGAYSHSQGIKGLRDVIAAGIEARDGFPADPNDIFLTDGASPAVHMMMQLLLSSEKDGILSPIPQYPLYSASIALHGGSLVPYYLDEATGWGLEISDLKKQLEEARSKGISVRALVVINPGNPTGQVLAEENQRDIVNFCKQEGLVLLADEVYQENVYVPDKKFHSFKKVARSLGYGEKDISLVSFQSVSKGYYGECGKRGGYMEVTGFTSDVREQIYKMASVNLCSNISGQILASLVMSPPKKEMEFSHPWLNVQRLWKTLSTV

SEQ ID NO: 13732 - protein, 491 aa, Panicum virgatum
  misc_feature: Useful for making plants with altered carbohydrate content
MAAAAVVPRPPPSLPTRAFPSASSTSCSSRRYPLRLRRSMPRPLVCAAASSSVWMPDPDLEPEPARDDQPAPESRPRRIALFVEPSPFAYVSGYKNRFQNFIKYLREMGDEVIVVTTHEGVPQEFHGAKLIGSWSFPCPWYQKVPLSLALSPRIIGEVARFKPDIIHASSPGIMVFGALIITKLLCVPLVMSYHTHVPIYIPRYTFSWLVKPMWLIIKFLHRAADLTLVPSVAIGRDLQAARVTAANKIRLWNKGVDSESFHPRFRNKEMRSRLTNGEPEKPLILYVGRLGVEKSLDFLKRVMDRLPGSRIAFIGDGPFRAELEQMFSGMPAVFTGTLQGEELSQAYASGDVFVMPSESETLGFVVLEAMSSGVPVVGARAGGIPDIIPEDQEGKTSFLYTPGDVDDCVSKIERLLSCEELREMMGRAARKEMEKFDWRAATRKIRNEQYSAAIWFWRKKRAQLLRPVQWVVRRLLRPTMPGAGNTVAKQS

SEQ ID NO: 13733 - protein, 328 aa, Panicum virgatum
  misc_feature: Useful for making plants with altered carbohydrate content
MASMIASSTVVTLGALIFLLLVSYGLCTRIVNFNASDITADPYWVPARATWYGAPTGAGPYDNGGACGFKNVNLPPFSAMTSCGNQPLFKDGKGCGSCYQIRCLNHPVCSGNPETVAITDMNYYPVAKYHFDLSGTAFGALAQPGRNDELRHAGIIDIQFRRVPCIYPGLTVTFHIEHGSNPVYLAVLVEFEDGDGDVVQVDLMEANSRWWTPMRESWGSIWRLDSNHRLTGPFSLRITNESGQKLVAYQVIPANWAPNTYYRSNIQYQATSSGAGLGMSSGAGLDISSATGLVISSAARLDTKILSIIGLICLVLFCFVCMGLRNLS

SEQ ID NO: 13734 - protein, 330 aa, Arabidopsis thaliana
  misc_feature: Useful for making plants with modulated heat sensitivity
MEDDNSNNNNNNNVIAPFIVKTYQMVNDPSTDWLITWGPAHNSFIVVDPLDFSQRILPAYFKHNNFSSFVRQLNTYGFRKVDPDRWEFANEHFLRGQKHLLNNIARRKHARGMYGQDLEDGEIVREIERLKEEQRELEAEIQRMNRRIEATEKRPEQMMAFLYKVVEDPDLLPRMMLEKERTKQQQQVSDKKKRRVTMSTVKSEEEEVEEDEGRVFRVMSSSTPSPSSTENLYRNHSPDGWIVPMTQGQFGSYETGLVAKSMLSNSTSSTSSSLTSTFSLPESVNGGGGGGCGSIQGERRYKETATFGGVVESNPPTTPPYPFSLFRGGF

SEQ ID NO: 13735 - protein, 453 aa, Arabidopsis thaliana
  misc_feature: Useful for making plants with modulated nitrogen use efficiency
MASLMLSLGSTSLLPREINKDKLKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNVS

SEQ ID NO: 13736 - protein, 194 aa, Arabidopsis thaliana
  misc_feature: Useful for making plants with altered cell wall content and/or composition
MAPLVLYLLTLLMAGHTSASWCVCKTGLSDSVLQKTLDYACGNGADCNPTHPKGSCFNPDNVRAHCNYAVNSFFQKKGQASESCNFTGTATLTTTDPSYTGCAFPSSASGSSGSGSTTVTPGKNSPKGSNSITTFPGGNSPYSGTPSTGLLGGNITDATGTGLNPDYSTESSGFALYYSNNLLLTGFCSLVMML

SEQ ID NO: 13737 - protein, 687 aa, Panicum virgatum
  misc_feature: Useful for making plants with altered carbohydrate content
MAPSWWGKDARANGGGGGTPVVVKMENPNWSISEVSASEVAPGSPAGGGGGKAGRGKNARQITWVLLLKAHRAAGRLTGAASAALAVAAAARRRVAAGRTDSDAAPGENTALRMRFYGCIRVFLVLSLLLLAVEVAAYLQGWHLDVEEGLLAVDGLFAAAYAGWMRTRLDYLAPPLQFLTNACVVLFLIQSVDRLVLCLGCFWIRLKGIKPVPLAAGKEDVEAGAEDFPMVLVQMPMCNEREVYQQSIGAVCSLDWPRSNFLIQVLDDSDDATTSALIKEEVEKWQREGVRIIYRHRVIRDGYKAGNLKSAMNCSYVKDYEFVVIFDADFQPQADFLKRTVPHFKGKDDVGLVQARWSFVNKDENLLTRLQNINLCFHFEVEQQVNGAFLNFFGFNGTAGVWRIKALEDSGGWMERTTVEDMDIAVRAHLKGWKFVYLNDVECQCELPESYEAYRKQQHRWHSGPMQLFRLCFVDIIKSKIGFWKKFNLIFLFFLLRKLILPFYSFTLFCVILPMTMFVPEAELPTWVVCYIPATMSILNILPAPKSFPFIVPYLLFENTMSVTKFSAMISGLFQLGSAYEWVVTKKSGRSSEGDLVSLVEKHSKQQRVGSAPNLDALTKEESNPKKDSKKKKHNRIYRKELALSFLLLTAAARSLLSAQGIHFYFLLFQGVSFLVVGLDLIGEQVE

SEQ ID NO: 13738 - protein, 699 aa, Arabidopsis thaliana
  misc_feature: Useful for making plants with altered cell wall content and/or composition
MAPKFEWWAKGNNNNTRKGTPVVVKMENPNNWSMVELESPSHDDFLVRTHEKSRNKNARQLTWVLLLKAHRAAGCLTSLGSALFALGTAVRRRIAAGRTDIEISSSGVGSLQKQNHTKKSKLFYSCLKVFLWLSLILLGFEIAAYFKGWSFGTSKLQLQFIFNKGFFDWVYTRWVLLRVEYLAPPLQFLANGCIVLFLVQSLDRLILCLGCFWIRFKKIKPVPKPDSISDLESGDNGAFLPMVLVQIPMCNEKEVYQQSIAAVCNLDWPKGKILIQILDDSDDPITQSLIKEEVHKWQKLGARIVYRHRVNREGYKAGNLKSAMNCSYVKDYEFVAIFDADFQPLPDFLKKTIPHFKDNEEIGLVQARWSFVNKEENLLTRLQNINLAFHFEVEQQVNSVFLNFFGFNGTAGVWRIKALEDSGGWLERTTVEDMDIAVRAHLHGWKFVFLNDVECQCELPESYEAYRKQQHRWHSGPMQLFRLCLPAVIKSKISIGKKFNLIFLFFLLRKLILPFYSFTLFCIILPMTMFVPEAELPAWVVCYIPATMSFLNILPAPKSFPFIVPYLLFENTMSVTKFNAMVSGLFQLGSAYEWVVTKKSGRSSEGDLAALVEKDEKTTKHQRGVSAPETEAEKKAEKTKRKKKKHNRIYMKELSLAFLLLTAATRSLLSAQGIHFYFLLFQGISFLLVGLDLIGEQVE

SEQ ID NO: 13739 - protein, 497 aa, Panicum virgatum
  misc_feature: Useful for making plants with altered carbohydrate content
MAGKQFPSLAHARPASASSRRLLAAAGALVLLSAVYFLLLSPSSPRPADAVLASHTPTTSSFLASLESFLAAPHPSDSAAAPGDLDAAIRAQEEARLLGDPAWPAPAAGPLRVYVYEMPSKFTYDLLRRFRDSYRKTENLTSNGSPVHRLIEQHSIDYWLWADLMAPESQRLLKSVVRVQRQEEADIFYVPFFTTISYFLLEKQECKALYREALKWVTDQPAWQRSEGRDHVIPVHHPWSFKSVRRFIKKTIWLLPDMDSTGNWYKPGQVYLEKDVILPYVPNVDHCDSKCVSETQSKRSILLFFRGRLKRNAGGKIRSKLVEELKSAEDIVIEEGSAGAQGKAAAQDGMRKSLFCLSPAGDTPSSARLFDAIVSGCIPVIISDELELPFEGILDYREIALFVSSSDALQPGWLVKYLRRMDAKRIREMQSNLVKFSKHFLYSSPARSLGPEDLTWRMIAGKLLNIKLHIRRSQRVVRESRSICTCECRVGNSTRML

SEQ ID NO: 13740 - protein, 511 aa, Arabidopsis thaliana
  misc_feature: Useful for making plants with altered cell wall content and/or composition
MSGKQQNHRSTSSRPRSKTLILIGSLFTVSLLVILYTSSSSSRASISNPNPSDRPETSFVTSLEHFLIYKAPKLSLPVRDDTVRGESDDDVRKLDEMVFERENRWLNEDPGYPVEFPIKVYVYEMPKKFTFDLLWLFHNTYKETSNATSNGSPVHRLIEQHSIDYWLWADLISPESERRLKSVVRVQKQQDADFFYVPFFTTISFFLLEKQQCKALYREALKWVTDQPAWKRSEGRDHIFPIHHPWSFKSVRKFVKNAIWLLPDMDSTGNWYKPGQVSLEKDLILPYVPNVDICDTKCLSESAPMRTTLLFFRGRLKRNAGGKIRAKLGAELSGIKDIIISEGTAGEGGKLAAQRGMRRSLFCLCPAGDTPSSARLFDAIVSGCIPVIVSDELEFPFEGILDYKKVAVLVSSSDAIQPGWLVNHLRSLTPFQVKGLQNNLAQYSRHFLYSSPAQPLGPEDLTWRMIAGKLVNIKLHTRRSQRVVKGSRSICRCDCWRSNSTASNSLSSLLS

SEQ ID NO: 13741 - protein, 331 aa, Arabidopsis thaliana
  misc_feature: Useful for making plants with altered cell wall content and/or composition
MTSLPYADADCSLRALAGRAEGFGRFAVGGLHGDLYVVTSLADDGPGTLREGGRRKEPLWIVFAVSGTINLNSYLSVSSYKTIDGRGQRIKLTGKGIRLKECEHIIICNLEFEGGRGHDVDGIQIKPKSRHIWIDRCSLRDYDDGLIDITRQSTDITVSRCYFAQHDKTMLIGADPSHVEDRCIRVTIHHCFFDGTRQRQPRLRFGKVHLYNNYTRNWGIYAVCASVEAQVFSQCNIYEAGVKKKTFEYYSEKAADKEEARTGLVRSENDLFLNGAQPSLMTGASEECVFHPSEHYPTWTVEPPSETLKQIMQICTGWQSLSRPSDHGVPK

SEQ ID NO: 13742 - protein, 185 aa, Panicum virgatum
  misc_feature: Useful for making plants with altered carbohydrate content
HVTSLQDDGPGSLREACRAAEPLWIVFEVSGTIRLHSYLRVSSHKTIDGRGQRVVLTGKGLQLKTCHHVIVCNLVFEGGRGHDVDGIQIKPGSTNIWIDRCTLADYDDGLIDITRQSTDITVSRCHFARHDKTMLIGADPTHVGDRCIRVTIHHCFFDGTRQRHPRLRFGKVHLYNNYTRSWGIY

SEQ ID NO: 13743 - protein, 393 aa, Arabidopsis thaliana
  misc_feature: Useful for making plants with modulated drought sensitivity
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSWMADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPVMADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYREVW

SEQ ID NO: 13744 - protein, 428 aa, Panicum virgatum
  misc_feature: Useful for making plants with altered carbohydrate content
MGRGSGAAPVSPGLALEAAVLALLAAAAALPSPAAGVNVTAVLSAFPNFADFARLLASTPVAGELAGRSSLTLLAVPNANLPQSPSAFAAGAGADIADVLRYHVLLEYLSPSDLARLPASGKLVTTLFQTTGRAPSDLGAVNLTAGTNSTVVVRSPAPSPGSNATVLGAVTAVPYNLSVLAVGGLIVPSGFDLAASESRPAPPVNITRVLTDARGFNVAASMLQASGVASEFEADEHGAGITVFVPTDDAFAGLPATDRLQSLPAERKAVVLRFHVLHSYYPLGSLESIVNPVQPTLATEYTEAGRFTLNITRVNGSIAIDTGVVQASITRTVFDQNPVSVFAVSKVLLPKEMFSRGDSDSTTMAPPSAAMAPGNEGNEQTPPTRLSSPPDLHGEDSESSAALTTAKGASWWCIGLMYLQLHLLLSLV

SEQ ID NO: 13745 - protein, 420 aa, Arabidopsis thaliana
  misc_feature: Useful for making plants with altered cell wall content and/or composition
  misc_feature: Useful for making plants with modulated salt sensitivity
MANVISISHFTLLALPYLLLLLSSTAAAINVTAVLSSFPNLSSFSNLLVSSGIAAELSGRNSLTLLAVPNSQFSSASLDLTRRLPPSALADLLRFHVLLQFLSDSDLRRIPPSGSAVTTLYEASGRTFFGSGSVNVTRDPASGSVTIGSPATKNVTVLKLLETKPPNITVLTVDSLIVPTGIDITASETLTPPPTSTSLSPPPAGINLTQILINGHNFNVALSLLVASGVITEFENDERGAGITVFVPTDSAFSDLPSNVNLQSLPAEQKAFVLKFHVLHSYYTLGSLESITNPVQPTLATEEMGAGSYTLNISRVNGSIVTINSGVVLAVVTQTAFDQNPVSVFGVSKVLLPKELFPKSGQPVATAPPQEISLSPESSSEQPSRLVSPPREIVSSGAVKRPLGFLVLWCWCIAFCYVLV

SEQ ID NO: 13746 - protein, 435 aa, Arabidopsis thaliana
  misc_feature: Useful for making plants with altered cell wall content and/or composition
MKQLHKQMSSKRDEETIPMSQSSPYSPKTLKHPRSLPRSLHYLFREQRLLFILVGILIGSTFFILQPSLSRLGAAESTSLITRSVSYAVTDSPPSRSTFNSGGGGGRTGRVPVGIGRKRLRIVVTGGAGFVGSHLVDKLIGRGDEVIVIDNFFTGRKENLVHLFSNPRFELIRHDVVEPILLEVDQIYHLACPASPVHYKYNPVKTIITNVMGTLNMLGLAKRVGARFLLTSTSEVYGDPLEHPQKETYWGNVNPIGERSCYDEGKRTAETLAMDYHRGAGVEVRIARIFNTYGPRMCLDDGRVVSNFVAQTIRKHPMTVYGDGKQTRSFQYVSDLVEGLVALMENDHVGPFNLGNPGEFTMLELAEVVKEVIDPSATIEFKPNTADDPHKRKPDISKAKEQLNWEPKISLREGLPRMVSDFRNRILNEDEGKGL

SEQ ID NO: 13747 - protein, 433 aa, Panicum virgatum
  misc_feature: Useful for making plants with altered carbohydrate content
MASELTYRGAAAAHGSASNGGEYSPKPSKPLSWLSRAARYAAAEHRPVFALAGMLFAAALFTFSSSSSSSTSDSSYAAASAGFRHLAIAGHPSFRESSVGGKVPLGLRRRALRVLVTGGAGFVGSHLVDRLVERGDSVIVVDNFFTGRKGNIAHHLQNPRFEVIRHDVVEPILLEVDQIYHLACPASPVHYKYNPIKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHIGPFNLGNPGEFTMLELAKVVQDTIDPEARIEFRPNTADDPHKRKPDISRAKELLGWEPKVPLHEGLPLMVTDFRKRIFGDQEKSTEAAGGLS

SEQ ID NO: 13748 - protein, 160 aa, Arabidopsis thaliana
  misc_feature: Useful for making plants with modulated heat sensitivity
MTKFRKLGRPAGHRMSMLRTMVSQLVKHERIETTVTKAKEVRRLADNMIQLGKEGSLSAARRAAGFVRGDDVLHKIFTELAHRYKDRAGGYTRLLRTRIRVGDAAPMAYIEFIDRENELRQSKPATPQPPQRVPLDPWERSRLTRQFAPPKEEKIPDSEL

SEQ ID NO: 13749 - protein, 462 aa, Arabidopsis thaliana
  misc_feature: Useful for making plants with altered cell wall content and/or composition
MASLTSNKPRNFGAYSHYATPCTRTHQIGALFLVVSTFFVTRLFDQWFSESNSVTPVIDLRRTSSSYGIKTDNGIIRWPERGYGSHLSLKIYVYDENEIDGLKELLYGRDGSVKTTACLKGQWGSQVKIHKLLLESKFRTIKKDEADLFFVPAYVKCVRMLGGLNDKEINQTYVKVLSQMPYFRRSGGRDHIFVFPSGAGAHLFRSWSTFINRSIILTPEADRTDKKDTTAFNSWKDIIIPGNVDDAMTKNGQPDVQPLPLSKRKYLANYLGRAQGKAGRLKLIDLSKQFPDKLECPDLKFSGTEKFGRTTYFEHLRNAKFCLAPRGESSWTLRFYESFFVECVPVLLSDHAELPFQNVIDYAQVSIKWPSTRIGSEFLDYLASISDRDIEGMIARGRKIRCLFVYGPDSAPCSAVKGILWELQRKVRHFQQSTETFWLHNGSFVNRELVQFSSWRPPMPLP

SEQ ID NO: 13750 - protein, 314 aa, Panicum virgatum
  misc_feature: Useful for making plants with altered carbohydrate content
RLQQQDPLAGLPACPLLLTGDPIAARSVSGSGGSPTSYRSMRHHHACSRAHQVGALLLVAATFLLTRLFDRLLLDASSPSSPSSPLSAARPASSADLRIYVYSEDEIQGLRALLRGRDGTVAAATCLKGQWGTQVKIHQLLLKSRFRTFTKDEANLFFVPSYVKCVRMTGALNDKEINQTYVKVLSQMPYFRRSGGRDHIFVFPSGAGAHLFRSWATFLNRSIILTPEGDRTDKRGTSAFNTWKDIIIPGNVDDSMVKSDARAVQPIPLRKRKYLSNFLGRAQGKAGRLQLVKLAKQYPDKVVYCLLSRISLMW

SEQ ID NO: 13751 - protein, 741 aa, Arabidopsis thaliana
  misc_feature: Useful for making plants with altered cell wall content and/or composition
MNRVTTESIASTAILVVMVFLFSWRSIEAANVSYDHRSLTIGNRRQLIISAAIHYPRSVPAMWPSLVQTAKEGGCNAIESYVFWNGHEPSPGKYYFGGRYNIVKFIKIVQQAGMHMILRIGPFVAAEWNYGGVPVWLHYVPGTVFRADNEPWKHYMESFTTYIVNLLKQEKLFAPQGGPIILSQVENEYGYYEKDYGEGGKRYAQWSASMAVSQNIGVPWMMCQQWDAPPTVISTCNGFYCDQFTPNTPDKPKIWTENWPGWFKTFGGRDPHRPAEDVAYSVARFFGKGGSVHNYYMYHGGTNFGRTSGGPFITTSYDYEAPIDEYGLPRLPKWGHLKDLHKAIMLSENLLISGEHQNFTLGHSLEADVYTDSSGTCAAFLSNLDDKNDKAVMFRNTSYHLPAWSVSILPDCKTEVFNTAKVTSKSSKVEMLPEDLKSSSGLKWEVFSEKPGIWGAADFVKNELVDHINTTKDTTDYLWYTTSITVSENEAFLKKGSSPVLFIESKGHTLHVFINKEYLGTATGNGTHVPFKLKKPVALKAGENNIDLLSMTVGLANAGSFYEWVGAGLTSVSIKGFNKGTLNLTNSKWSYKLGVEGEHLELFKPGNSGAVKWTVTTKPPKKQPLTWYKVVIEPPSGSEPVGLDMISMGKGMAWLNGEEIGRYWPRIARKNSPNDECVKECDYRGKFMPDKCLTGCGEPSQRWYHVPRSWFKSSGNELVIFEEKGGNPMKIKLSKRKVSVV

SEQ ID NO: 13752 - protein, 655 aa, Arabidopsis thaliana
  misc_feature: Useful for making plants with altered cell wall content and/or composition
MANSPAAPAPTTTTGGDSRRRLSASIEAICKRRFRRNSKGGGRSDMVKPFNIINFSTQDKNSSCCCFTKFQIVKLLLFILLSATLFTIIYSPEAYHHSLSHSSSRRQDPRYFSDLDINWDDVTKTLENIEEGRTIGVLNFDSNEIQRWREVSKSKDNGDEEKVVVLNLDYADKNVTWDALYPEWIDEEQETEVPVCPNIPNIKVPTRRLDLIVVKLPCRKEGNWSRDVGRLHLQLAAATVAASAKGFFRGHVFFVSRCFPIPNLFRCKDLVSRRGDVWLYKPNLDTLRDKLQLPVGSCELSLPLGIQDRPSLGNPKREAYATILHSAHVYVCGAIAAAQSIRQSGSTRDLVILVDDNISGYHRSGLEAAGWQIRTIQRIRNPKAEKDAYNEWNYSKFRLWQLTDYDKIIFIDADLLILRNIDFLFSMPEISATGNNGTLFNSGVMVIEPCNCTFQLLMEHINEIESYNGGDQGYLNEVFTWWHRIPKHMNFLKHFWIGDEDDAKRKKTELFGAEPPVLYVLHYLGMKPWLCYRDYDCNFNSDIFVEFATDIAHRKWWMVHDAMPQELHQFCYLRSKQKAQLEYDRRQAEAANYADGHWKIRVKDPRFKICIDKLCNWKSMLRHWGESNWTDYESFVPTPPAITVDRRSSLPGHNL

SEQ ID NO: 13753 - protein, 270 aa, Oryza sativa
  misc_feature: Useful for biocontainment applications
MGRGRIEIKRIENTTSRQVTFCKRRNGLLKKAYELSVLCDAEVALIVFSSRGRLYEYSNNNNVKATIDRYKKAHACGSTSGAPLIEVNAQQYYQQESAKLRHQIQMLQNTNKHLVGDNVSNLSLKELKQLESRLEKGISKIRARKNELLASEINYMAKREIELQNDNMDLRTKIAEEEQQLQQVTVARSAAMELQAAAAAQQQQQNPFAVAAAQLDMKCFFPLNLFEAAAQVQAVAAQRQQIIPTELNLGYHHHLAIPGAAAADAPPPHF

SEQ ID NO: 13754 - protein, 430 aa, Arabidopsis thaliana
  misc_feature: Useful for making plants with altered cell wall content and/or composition
MYGKTICTIVFFIFLVASFSIYMGTVDPRPYFYLLQSQPNGASSPCSSSGKPLRVFMYDLPRKFNIAMMDPHSSDVEPITGKNLPSWPQTSGIKRQHSVEYWLMASLLNGGEDENEAIRVFDPDLADVFYVPFFSSLSFNTHGKNMTDPDTEFDRLLQVELMEFLENSKYWNRSGGKDHVIPMTHPNAFRFLRQQVNASILIVVDFGRYSKDMARLSKDVVSPYVHVVESLNEEGDDGMGDPFEARTTLLYFRGNTVRKDEGKIRLRLEKLLAGNSDVHFEKSVATTQNIKVSTEGMRSSKFCLHPAGDTPSSCRLFDAIVSHCIPVIISDKIELPFEDEIDYSEFSLFFSIKESLEPGYILNNLRQFPKEKWLEMWKRLKNVSHHFEFQYPPKREDAVNMLWRQVKHKIPYVKLAVHRNRRLKVPDWWL

SEQ ID NO: 13755 - protein, 354 aa, Zea mays
  misc_feature: Useful for making plants with altered lignin content
MDSDYVASLLMGMGSSAPALDFAALDAGFLETLCGGGGGLFGVSGVAAGAGCGGVSPEGSSVSDPAWARARDDDNVRKRKEPPTGSAGGKEACPGKAAEAKGPDGKRCRVGGSDSPVKPKVEEVAASDASVELKAQKKGKGKTAKPAVEPPKDYVHVRARRGQATDSHSLAERVRREKISQRMKFLQDLVPGCNKVVGKALMLDEIINYVQSLQQQVEFLSMKLATVNPQLDFSNLSTLLHKDMYQPCGPSANSVFPLESDGAAFPFCDQADLFHSFGSGSAAMEDQCSLSLLDTALPHAANPQFAFQKQQRDFWEDGLQNALPTGSEQRQEEDGLLVPNFDGQLHADQTKVEF

SEQ ID NO: 13756 - protein, 89 aa, Glycine max
  misc_feature: Useful for making plants with modulated low light sensitivity
MKKRQVVVKSVANTSSSVMRNIRYGECQKNHAANIGGYAVDGCREFMASTGEGAGGALTCAACGCHRNFHRREVNTEVVCEYSPPNSGR

SEQ ID NO: 13757 - protein, 339 aa, Panicum virgatum
  misc_feature: Useful for making plants with altered carbohydrate content
MASRPLSSSSKSMVIMRVVVAALVFSAATTAMAAGLQMDFYSSTCPDVEQIVKEEMVEILRAAPALAGPLLRLHFHDCFVRGCDASVLLDSTPTNTAEKDAKPNLTLRGFGSVQRVKDRLEKACPGTVSCADILALMARDAVVLARGPSWPVTLGRRDGRVSVANETKQLPPPTANVTTLVRMFAAKGLGVKDLVVLSGGHTLGTAHCNLFSDRLYNFTGANNLADVDPALDATYLARLRSRCRSLADNTTLNEMDPGSFLSFDASYYRLVAKRRGLFHSDAALLTHPTTRAYVQRQATGLFADEFFRDFADSMVKMSTIDVLTGAQGEIRKKCYLVLN

SEQ ID NO: 13758 - protein, 321 aa, Arabidopsis thaliana
  misc_feature: Useful for making plants with modulated nitrogen use efficiency
MAASKRLVVSCLFLVLLFAQANSQGLKVGFYSKTCPQLEGIVKKVVFDAMNKAPTLGAPLLRMFFHDCFVRGCDGSVLLDKPNNQGEKSAVPNLSLRGFGIIDDSKAALEKVCPGIVSCSDILALVARDAMVALEGPSWEVETGRRDGRVSNINEVNLPSPFDNITKLISDFRSKGLNEKDLVILSGGHTIGMGHCPLLTNRLYNFTGKGDSDPSLDSEYAAKLRKKCKPTDTTTALEMDPGSFKTFDLSYFTLVAKRRGLFQSDAALLDNSKTRAYVLQQIRTHGSMFFNDFGVSMVKMGRTGVLTGKAGEIRKTCRSAN

SEQ ID NO: 13759 - protein, 358 aa, Arabidopsis thaliana
  misc_feature: Useful for making plants with altered cell wall content and/or composition
MTKAYSTRVLTFLILISLMAVTLNLFPTVEAKKRSRDAPIVKGLSWNFYQKACPKVENIIRKELKKVFKRDIGLAAAILRIHFHDCFVQGCEASVLLAGSASGPGEQSSIPNLTLRQQAFVVINNLRALVQKKCGQVVSCSDILALAARDSVVLSGGPDYAVPLGRRDSLAFASQETTLNNLPPPFFNASQLIADFANRNLNITDLVALSGGHTIGIAHCPSFTDRLYPNQDPTMNQFFANSLKRTCPTANSSNTQVNDIRSPDVFDNKYYVDLMNRQGLFTSDQDLFVDKRTRGIVESFAIDQQLFFDYFTVAMIKMGQMSVLTGTQGEIRSNCSARNTQSFMSVLEEGIEEAISMI

SEQ ID NO: 13760 - protein, 586 aa, Panicum virgatum
  misc_feature: Useful for making plants with altered carbohydrate content
MALMLRPWAFLLFLALLSYDESGLQSTRNGVAQATQRVFLYPQSPKVSSIVSTKYRTAYHFQPPKNWINDPNGPMYYNGIYHQFYQYNPNGSLWGNIVWGHSVSTDLINWIRLEPAIEQTTPSDINGCWTGSATILKGGRPVIIYTGADTEKRQVQNIVFPKNVSDPYLKEWIKPDNNPLIQPVGQGLNSDQFRDPTTSWIGPDGLWRIAIGAELNGYSAALLYKSEDFVNWTRVDHPLYSSNASTMWECPDFFAVLPGKNSGLDLSAAIPNGAKHVLKMSLDNCDKYMVGVYDLKSDTFVPDTVLDDRRLWSRIDYGNYYASKSFFDSKRGRRIIWGWTNETDSSSDDVAKGWAGIHAIPRTIWLDSNSKQLLQWPVEEIESLRREEVSHQGLELNQGDLFEIKGIDTLQADVEIDFELTSIDSAGPFDPSWLLDIEKHCREAGASVHGDVGPFGLVVLASDNMEEHTSVYFRVYKSQEKYMILMCSDLRKSSLRPELYTPAYGGFFEFDLEKEKTISLRTLIDRSAVESFGGGGKLCIMARVYPVTVINGGTRMYAFNNGTSTVKVPQLKAWSMRRAQVNVKMG

SEQ ID NO: 13761 - protein, 584 aa, Arabidopsis thaliana
  misc_feature: Useful for making plants with modulated biomass
MTKEVCSNIGLWLLLTLLIGNYVVNLEASHHVYKRLTQSTNTKSPSVNQPYRTGFHFQPPKNWMNDPNGPMIYKGIYHLFYQWNPKGAVWGNIVWAHSTSTDLINWDPHPPAIFPSAPFDINGCWSGSATILPNGKPVILYTGIDPKNQQVQNIAEPKNLSDPYLREWKKSPLNPLMAPDAVNGINASSFRDPTTAWLGQDKKWRVIIGSKIHRRGLAITYTSKDFLKWEKSPEPLHYDDGSGMWECPDFFPVTRFGSNGVETSSFGEPNEILKHVLKISLDDTKHDYYTIGTYDRVKDKFVPDNGFKMDGTAPRYDYGKYYASKTFFDSAKNRRILWGWTNESSSVEDDVEKGWSGIQTIPRKIWLDRSGKQLIQWPVREVERLRTKQVKNLRNKVLKSGSRLEVYGVTAAQADVEVLFKVRDLEKADVIEPSWTDPQLICSKMNVSVKSGLGPFGLMVLASKNLEEYTSVYFRIFKARQNSNKYVVLMCSDQSRSSLKEDNDKTTYGAFVDINPHQPLSLRALIDHSVVESFGGKGRACITSRVYPKLAIGKSSHLFAFNYGYQSVDVLNLNAWSMNSAQIS

SEQ ID NO: 13762 - protein, 200 aa, Arabidopsis thaliana
  misc_feature: Useful for making plants with modulated heat sensitivity
MSFTGTQQKCRACEKTVYPVELLSADGISYHKACFKCSHCKSRLQLSNYSSMEGVVYCRPHFEQLFKESGSFSKNFQSPAKPLTDKPTPELNRTPSRLAGMFSGTQDKCATCTKTVYPIEKVTVESQCYHKSCFKCSHGGCPISPSNYAALEGILYCKHHFAQLFKEKGSYNHLIKSASIKRATAAATAAAAAVAAVPES

SEQ ID NO: 13763 - protein, 193 aa, Panicum virgatum
  misc_feature: Useful for making plants with altered carbohydrate content
MATSFQGTTTKCTACDKTVYLVDKLTADNRVYHKACFRCHHCKGTLKLANYNSFEGVLYCRPHFDQLFKRTGSLDKSFEGTPKVVKPERKNENAIKVSSAFAGTREKCVGCSKTVYPIERVTVNNTMYHKSCFKCCHGGCTISPSNYIAHEGKLYCKHHHIQLIKEKGNFSQLENDHEKTSQAGSLEDEEAEY

SEQ ID NO: 13764 - protein, 407 aa, Panicum virgatum
  misc_feature: Useful for making plants with altered carbohydrate content
MIPLNRRASLPRAGMEYFDARRKPHNVGKIIAALILTALCIFVLKQSPSFGGNSVFSRHEPGVTHVLVTGGAGYIGSHASLRLLKDNYRVTIVDNLSRGNMGAVKALQKLFPQPGRLQFIFADLGDQKSVNKIFAENAFDAVMHFAAVAYVGESTLEPLRYYHNITSNTLLILEAMASHGVKTLIYSSTCATYGEPEKMPITEATPQFPINPYGKAKKMAEDIILDFSKSKGADMAVMILRYFNVIGSDPEGRLGEAPRPELREHGRISGACFDAALGVIPGLKVKGTDYPTADGTCIRDYIDVTDLVDAHVKALNKAEPRKVGIYNVGTGRGRSVREFVDACKKATGVDIKVEYLNRRPGDYAEVYSDPTKINKELNWTAQYTDLKESLSVAWRWQKSHPHGYGTN

SEQ ID NO: 13765 - protein, 419 aa, Arabidopsis thaliana
  misc_feature: Useful for making plants with altered cell wall content and/or composition
MFSFGRARSQGRQNRSMSLGGLDYADPKKKNNYLGKILLTASLTALCIFMLKQSPTFNTPSVFSRHEPGVTHVLVTGGAGYIGSHAALRLLKESYRVTIVDNLSRGNLAAVRILQELFPEPGRLQFIYADLGDAKAVNKIFTENAFDAVMHFAAVAYVGESTQFPLKYYHNITSNTLVVLETMAAHGVKTLIYSSTCATYGEPDIMPITEETPQVPINPYGKAKKMAEDIILDFSKNSDMAVMILRYFNVIGSDPEGRLGEAPRPELREHGRISGACFDAARGIMPGLQIKGTDYKTADGTCVRDYIDVTDLVDAHVKALQKAKPRKVGIYNVGTGKGSSVKEFVEACKKATGVEIKIDYLPRRAGDYAEVYSDPSKIRKELNWTAKHTNLKESLETAWRWQKLHRNGYGLTTSSVSVY

SEQ ID NO: 13766 - protein, 381 aa, Medicago sativa
  misc_feature: Useful for making plants with modulated salt sensitivity
MANYALANVFILLLNLSTLLIVLACPYCPYPSPKPPTHHPPIVKPPVHKRRKYSPTPKPPVHKPPRYPPKPSPCPPPSSTPKPPHVPKPPHHPKPPVVHPPHVPKPPVHPPYVPKPPIVKPPIVHPPYVPKPPVVKPPPYVPKPPVVRPPYVPKPPVVPVTPPYVPKPPVVRPPYVPKPPVVPVTPPYVPKPPIVKPPIVFPPHVPLPPVVPSPPPYVPSPPIVKPPIVFPPHVPLPPVVPVTPPYVQPPPIVTPPTPTPPIVTPPVVSPPTPPSETPCPPPPLVPYPPTPPAQQTCSIDALKLGACVDVLGGLIHIGIGGSAKQTCCPLLQGLVDLDAAICLCTTIRLKLLNINLVIPLALQVLIDCGKTPPEGFKCPAY

SEQ ID NO: 13767 - protein, 293 aa, Panicum virgatum
  misc_feature: Useful for making plants with altered carbohydrate content
MAKSYTLLFGAVVVLALLVSPIACTRKLAKPNRHRRPTHRPAVRARSNHTATPSASYAYGSGGWLSAGATYYGAPNGDGSDGGACGYQTAVGQRPFSSMIAAGSPSLFKGGKGCGACYEVKCNSNPACSGQPATVVITDECPGGVCLAEAAHFDMSGTSMGAMAKPGMADRLRAAGILKVQYKRVPCKYSGVNIAFRVDQGSNPFYLEVLVEFEDGDGDLSAVDLMEAGCGTWTPMVQNWGALWRYNSDTGKALRAPFSLRLASDSGKVLVANNVIPAGWKAGATYRSLVNYS

SEQ ID NO: 13768 - protein, 259 aa, Arabidopsis thaliana
  misc_feature: Useful for making plants with altered cell wall content and/or composition
MASSQRYFALLALFAVSLKFCYCQNETIDVAGSGTAGVTWYGEPFGAGSTGGACGYGSAVANPPLYAMVSAGGPSLFNNGKGCGTCYQVVCIGHPACSGSPITVTITDECPGGPCASEPVHIDLSGKAMGALAKPGQADQLRSAGVIRVNYKRAACLYRGTNIVFRMDAGANPYYISFVVEYENGDGDLSNVEIQPAGGSFISMQEMRSAVWKVNSGSALRGPFNIRLTSGESHKVIVAYNVIPANWKPDESYRSIVNF

SEQ ID NO: 13769 - protein, 292 aa, Panicum virgatum
  misc_feature: Useful for making plants with altered carbohydrate content
MAKSRTLLFGALVVLALLVSPIACSRKLAKPNKHKPSHKPAVGARGNYTATPSASDAYGSGGWLSAGATYYGAPNGDGSDGGACGYQTAVGQRPFSSMITAGSPSLFKGGKGCGACYEVKCDSNPACSGQPATVVITDECPGGVCLAEAAHFDMSGTSMGAMAKPGMTDRLRAAGILKIQYKRVPCKYSGVNIAFRVDQGSNPFYLEVLVEFEDGDGDLSAVDLMEAGCGTWTPMVQNWGALWRYNSNTGKALRAPFSLRLTSDSGKVLVANNVIPAGWKAGATYRSLVNYS

SEQ ID NO: 13770 - protein, 446 aa, Panicum virgatum
  misc_feature: Useful for making plants with altered carbohydrate content
MWVERVVGERRMREIQRFARNAKLTAVCLLLTIVVLRGYVGAGRYGTPQQDLIELRQHFVSHPHRALAEHHDARSRGSATTTSSSSSGRGDDEPDPPPRTLRDPPYTLGPKISDWDEQRAAWHRRHPETPPFLNDVKPRVLLVTGSSPKPCENPVGDHYLLKSIKNKIDYCRVHGIEIFYNMALLDAEMAGFWAKLPLIRALLLAHPEVEFLWWMDSDAMFTDMAFELPWERYGPYNLVMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKQMDRAFNFGDNQILQMYGFTHKSLASRRVKRIRNETSNPLEMKDELGLLHPAFKAVKTST

SEQ ID NO: 13771 - protein, 460 aa, Arabidopsis thaliana
  misc_feature: Useful for making plants with altered cell wall content and/or composition
MIEKCIGAHRFRRLQRFMRQGKVTILCLVLTVIVLRGTIGAGKFGTPEKDIEEIREHFFYTRKRGEPHRVLVEVSSKTTSSEDGGNGGNSYETFDINKLFVDEGDEEKSRDRTNKPYSLGPKISDWDEQRRDWLKQNPSFPNFVAPNKPRVLLVTGSAPKPCENPVGDHYLLKSIKNKIDYCRIHGIEIFYNMALLDAEMAGFWAKLPLIRKLLLSHPEIEFLWWMDSDAMFTDMVFELPWERYKDYNLVMHGWNEMVYDQKNWIGLNTGSFLLRNSQWSLDLLDAWAPMGPKGKIREEAGKVLTRELKDRPAFEADDQSAMVYLLATEREKWGGKVYLESGYYLHGYWGILVDRYEEMIENHKPGFGDHRWPLVTHFVGCKPCGKFGDYPVERCLRQMDRAFNFGDNQILQMYGFTHKSLGSRRVKPTRNQTDRPLDAKDEFGLLHPPFKAAKLSTTTT

SEQ ID NO: 13772 - protein, 291 aa, Arabidopsis thaliana
  misc_feature: Useful for making plants with altered cell wall content and/or composition
MLRGRRLVFVGDSLNRNMWESLVCILKGSVKDETKVYEARGRHHFRGEAEYSFVFQDYNCTVEFFVSPFLVQEWEIVDKKGTKKETLRLDLVGKSSEQYKGADVIVFNTGHWWTHEKTSKGEDYYQEGSNVYHELAVLEAFRKALTTWGRWVEKNVNPAKSLVFFRGYSASHFSGGQWNSGGACDSETEPIKNDTYLTPYPSKMKVLEKVLRGMKTPVTYLNITRLTDYRKDGHPSVYRKQSLSEKEKKSPLLYQDCSHWCLPGVPDSWNEILYAELIVKLNQLSQTQRKT

SEQ ID NO: 13773 - protein, 621 aa, Arabidopsis thaliana
  misc_feature: Useful for making plants with altered cell wall content and/or composition
MYGRDPWGGPLEINTADSATDDDRSRNLNDLDRAALSRPLDETQQSWLLGPTEQKKKKYVDLGCIIVSRKIFVWTVGTLVAAALLAGFITLIVKTVPRHHPKTPPPDNYTIALHKALKFFNAQKSGKLPKHNNVSWRGNSGLQDGKGETGSFYKDLVGGYYDAGDAIKFNFPMAYAMTMLSWSVIEYSAKYEAAGELTHVKELIKWGTDYFLKTFNSTADSIDDLVSQVGSGNTDDGNTDPNDHYCWMRPEDMDYKRPVTTCNGGCSDLAAEMAAALASASIVFKDNKEYSKKLVHGAKVVYQFGRTRRGRYSAGTAESSKFYNSSMYWDEFIWGGAWMYYATGNVTYLNLITQPTMAKHAGAFWGGPYYGVFSWDNKLAGAQLLLSRLRLFLSPGYPYEEILRTFHNQTSIVMCSYLPIFNKFNRTNGGLIELNHGAPQPLQYSVNAAFLATLYSDYLDAADTPGWYCGPNFYSTSVLRDFARSQIDYILGKNPRKMSYVVGFGTKYPRHVHHRGASIPKNKVKYNCKGGWKWRDSKKPNPNTIEGAMVAGPDKRDGYRDVRMNYNYTEPTLAGNAGLVAALVALSGEEEATGKIDKNTIFSAVPPLFPTPPPPPAPWKP

SEQ ID NO: 13774 - protein, 623 aa, Panicum virgatum
  misc_feature: Useful for making plants with altered carbohydrate content
MYAANHWGGSFEIADGAAEDDHSRNMDLDRGALSRQQHHELDETQQSWLLGPPEAKKKDKYVDLGCVIVKRKLLWWAFWCVVGAFVLIGLPIIIAKSIPHKKHGPPPPDQYTEALHKALRFFNAQKSGRLPKNNGVPWRGNSGLSDGSDAKDVKGGLVGGYYDAGDNIKFHFPMAFSMTMLSWSVIEYSAKYKAVGEYDHVRELIKWGTDYLLLTFNSSASTVDKIYAQVGAAKINGSQPDDHYCWNRPEDMSYRRPTIAVSSAPDLGGEIAAALAAASIVFRDNAAYSKKLTHGAATVYKFARQAGHRTPYSLRQPDIEYYYNSTSYWDEFMWSAAWMYYATGNTSYISFATDPRLPKNAKAFLNILDFSVFSWDNKLPGAQLLLSRLRMFLNPGYPYEESLIGYHNATSLNMCMYFPRFAAFNFTKGGMALFNHGKGQPLQYVVANSFLASLYADYMEAANVPGWYCGPNFMSTNDLRAFAKSQLNYILGDNPRKMSYVVGFGKKYPRHLHHRGASTPHNGVKYSCTGGYKWRDSKKADPNLLTGAMVGGPDRNDRFKDSRNTYGQNEPTLVGNAGLVAALVAITDSGRGVGVTAVDKNTMFSAVPPMFPTAPPPPSSWKP

SEQ ID NO: 13775 - protein, 432 aa, Panicum virgatum
  misc_feature: Useful for making plants with altered carbohydrate content
MAMSSCVTNKSLPFLVAPSEATPAGTLRLTSMDRALASLPMTALFVFEHPIDQPAETLRRALSRALVPYYPVAGRLTAGAHGQSIACTGEGVLFVGASARCTLRDARLSDQRPAIPVEDLTVTYAGLYNKDPPLLLTQVTEFSCGGFVVGVTWNHVVADGVGMAQFLQAVGEFARGFSSPSVVQPVRVDNFLPELPPPITTMTKSMVSSKHTDFPSSYITIPMSFVNRIKDEFRRSGPQGDQKKAAAATCTAFDVFTAAIWRSRARATIAGAASQDAPTALAFTVNLRKQAGAKDGYYGNVFAFGLAAATLREVADGDILDLVRLIRDAKARVPYTFTDGAAYIGDEMGGRLQCLDGYDTLYVTSWWNLGFDDVDFGGGGPARVMGDMERKVVPGCILCGRKDKADGVAAMAFCVKQEHAEAFHEELGRLKM

SEQ ID NO: 13776 - protein, 641 aa, Panicum virgatum
  misc_feature: Useful for making plants with altered carbohydrate content
MKAQPLLPAALKRRRGPRVAVLALVFCSLLVPFAFLFDRAPSGYVTTEERHRQEVVLPSLDHAEKRGRPGAISGRRQDAPEKKIPRGSAGVIHQHVPEKRISKVSAGVIDQHKQIDSHSTSGGAKSKALPAPKVEPSKAMAESTRETREISKDVQGRQKVAKADEVEKAKACQLEFGSYCLWSIEHKEVMKDSIVKRLKDQLFVARSYYPSIAKLQGHEALTQEMKQNIQEHEWVLSVSTVDADLPSFINKRMEQMERTIARSKSCTVDCKNVDRKLRQILDMTEDEAHFHMKQSAFLYNLGAQTLQKSHHCLNMRLTLEYFKSSSLDSDDSPSGKFNSPKYMHYVILSKNVLAASVVINSTVSSCKEPGNLAFHILTDAQNFYAMKYWFARNSYKNAVIHVINYEAIILEKLPKYNIQQLYLPEEFRVLIRSIKQPTENTRMEYLSLFSHSHFLIPEIFKYLNKVVLLDDDVVVQRDLSFLWNIDMGDKVNGAVKFCGLKLGQMRNVLGKTAYDPKSCAWMSGVNLINLDKWREHNVTENYLLLMKKFKFKDERSLRAAAIPLSLLSFQHLIYPLDEKLTLAGLGYDYGIDEEVARRAASLHYNGNMKPWLELGIPDYKKYWRRFLVRGDRFMDECNVNP

SEQ ID NO: 13777 - protein, 809 aa, Panicum virgatum
  misc_feature: Useful for making plants with altered carbohydrate content
MSAPKLGRNLSIRDRVEDTLHAHRNELVALLSKYVNKGKGILQPHHILDELDEVQGSGGGALAEGPFLDVLRSAQEAIVLPPFVAIAVRPRPGVWEYVRLNVHELSVEQLTVPEYLRFKEELVDGQHNDPYMLELDFEPFNASVPRPNRSSSIGNGVQFLNRHLSSIMFRNRDCLEPLLDFLRGHRHKGHVMMLNDRIQSLGRLQSVLTKAEEYLSKLPADTPYSQFSYKFQEWGLEKGWGDTSEHVLEMIHLLLDILQAPDPSTLEKFLGRIPMIFNVVVVSPHGYFGQANVLGLPDTGGQIVYILDQVRALENEMVLRLKKQGLDVTPKILIVTRLIPDAKGTSCNQRLERISGTQHTYILRVPFRNENGVLKKWISRFDVWPYLEKFAEDAAGEIAAELQGTPDFIIGNYSDGNLVASLLSYKMGITQCNIAHALEKTKYPDSDIYWKKFDEKYHFSCQFTADIISMNNADFIITSTYQEIAGSKNTVGQYESHTAFTLPGLYRVVHGIDVFDPKFNIVSPGADMSIYFPYTEKAKRLTSLHGSIESLIYDPEQNDEHIGHLDDRSKPILFSMARLDRVKNITGLVEAYAKCSKLRELVNLVVVAGYNDVKKSKDREEIAEIEKMHDLIKTYNLFGQFRWISAQTNRVRNGELYRYIADTHGAFVQPAFYEAFGLTVVEAMTCGLPTFATLHGGPAEIIEHGISGFHIDPYHPDQAAKLIAEFFEQCKQDPNHWVKVSEAGLQRIYEKYTWKIYSERLMTLAGVYGFWKYVSKLERRETRRYLEMFYILKFRELVKTVPLAVDQPQ

SEQ ID NO: 13778 - protein, 809 aa, Arabidopsis thaliana
  misc_feature: Useful for making plants with altered cell wall content and/or composition
MANPKLTRVLSTRDRVQDTLSAHRNELVALLSRYVDQGKGILQPHNLIDELESVIGDDETKKSLSDGPFGEILKSAMEAIVVPPFVALAVRPRPGVWEYVRVNVFELSVEQLTVSEYLRFKEELVDGPNSDPFCLELDFEPFNANVPRPSRSSSIGNGVQFLNRHLSSVMFRNKDCLEPLLDFLRVHKYKGHPLMLNDRIQSISRLQIQLSKAEDHISKLSQETPFSEFEYALQGMGFEKGWGDTAGRVLEMMHLLSDILQAPDPSSLEKFLGMVPMVFNVVILSPHGYFGQANVLGLPDTGGQVVYILDQVRALETEMLLRIKRQGLDISPSILIVTRLIPDAKGTTCNQRLERVSGTEHTHILRVPFRSEKGILRKWISRFDVWPYLENYAQDAASEIVGELQGVPDFIIGNYSDGNLVASLMAHRMGVTQCTIAHALEKTKYPDSDIYWKDFDNKYHFSCQFTADLIAMNNADFIITSTYQEIAGTKNTVGQYESHGAFTLPGLYRVVHGIDVFDPKFNIVSPGADMTIYFPYSEETRRLTALHGSIEEMLYSPDQTDEHVGTLSDRSKPILFSMARLDKVKNISGLVEMYSKNTKLRELVNLVVIAGNIDVNKSKDREEIVEIEKMHNLMKNYKLDGQFRWITAQTNRARNGELYRYIADTRGAFAQPAFYEAFGLTVVEAMTCGLPTFATCHGGPAEIIEHGLSGFHIDPYHPEQAGNIMADFFERCKEDPNHWKKVSDAGLQRIYERYTWKIYSERLMTLAGVYGFWKYVSKLERRETRRYLEMFYILKFRDLVKTVPSTADD

SEQ ID NO: 13779 - protein, 622 aa, Arabidopsis thaliana
  misc_feature: Useful for making plants with altered cell wall content and/or composition
MELFALLIKVAGLLATVTVGANVVSYSRFRRQNLAKFRSPIDESKEVLADFNSIEHEEGKFFFGLATAPAHAEDDLDDAWLQFAKETPCSAEEAEAADKKARRKKVKLAVGAITKGLAKNTHGKEDKNAADKPPSKNVAAWHNAPHAEDRLKFWSDPDKEVKLAKDTGVTVFRMGVDWSRIMPVEPTKGIKEAVNYEAVEHYKWILKKVRSNGMKVMLTLFHHSLPPWAADYGGWKMEKTVDYFMDFTRIVVDSMYDLVDSWVTFNEPHIFTMLTYMCGSWPGNNPDFLEIATSTLPMGVFHRALHWMAVAHSKAYDYIHGKISLKKPLVGVAHHVSFMRPYGLFDIGAVTISNSLTIFPYIDSICEKLDFIGINYYGQEAVCGAGLKLVETDEYSESGRGVYPDGLYRVLLMFHERYKHLKVPFIVTENGVSDETDVIRRPYLIEHLLALYAAMLKGVPVLGYIFWTISDNWEWADGYGPKFGLVAVDRSHDLARTLRQSYHLFSKIVKSGKVTRKDRSLAWNELQKAAKAGKLRPFYRGVDNHNLMYADGLDKPQWRPFVDRDWRFGHYQMDGLQDPLSRVARTLLIWPLIMKKRIRKVKIKHTDDAGLVLHPALASPFD

SEQ ID NO: 13780 - protein, 423 aa, Arabidopsis thaliana
  misc_feature: Useful for making plants with modulated root development
MARKKIREYDSKRLVKEHFKRLSGKELPIRSVQINETTDLNELVEKEPWLSSEKLVVKPDMLFGKRGKSGLVALKLDFADVATFVKERLGKEVEMSGCKGPITTFIVEPFVPHNEEYYLNVVSDRLGCSISFSECGGIEIEENWDKVKTIFLPTGASLTPEICAPLVATLPLEIKAEIEEFIKVIFTLFQDLDFTFLEMNPFTLVDGSPYPLDMRGELDDTAAFKNFKKWGDIEFPLPFGRVMSPTESFIHGLDEKTSASLKFTVLNPKGRIWTMVAGGGASVIYADTVGDLGYASELGNYAEYSGAPKEDEVLQYARVVIDCATANPDGKSRALVIGGGIANFTDVAATFNGIIRALKEKEAKLKAARMHIFVRRGGPNYQKGLAKMRALGDDIGVPIEVYGPEATMTGICKEAIQYITAAA

SEQ ID NO: 13781 - protein, 474 aa, Arabidopsis thaliana
  misc_feature: Useful for making plants with modulated biomass
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTGTHHAVLSSYEYVSQGLRQYNLDNMMDGFYIAPAFMDKLVVHITKNFLTLPNIKVPLILGIWGGKGQGKSFQCELVMAKMGINPIMMSAGELESGNAGEPAKLIRQRYREAADLIKKGKMCCLFINDLDAGAGRMGGTTQYTVNNQMVNATLMNIADNPTNVQLPGMYNKEENARVPIICTGNDFSTLYAPLIRDGRMEKFYWAPTREDRIGVCKGIFRTDKIKDEDIVTLVDQFPGQSIDFFGALRARVYDDEVRKFVESLGVEKIGKRLVNSREGPPVFEQPEMTYEKLMEYGNMLVMEQENVKRVQLAETYLSQAALGDANADAIGRGTFYGKGAQQVNLPVPEGCTDPVAENFDPTARSDDGTCVYNF

SEQ ID NO: 13782 - protein, 285 aa, Arabidopsis thaliana
  misc_feature: Useful for making plants with altered cell wall content and/or composition
MAAFATKQSPLLLASLLILIGVATGSFYDSFDITWGAGRANIFESGQLLTCTLDKTSGSGFQSKKEYLFGKIDMKIKLVPGNSAGTVTAYYLSSKGETWDEIDFEFLGNVTGQPYVIHTNVFTGGKGNREMQFYLWFDPTADFHTYTVLWNPLNIIFLVDGIPIRVFKNNEANGVAYPKSQPMKIYSSLWEADDWATQGGKVKTDWTNAPFSASYRSFNDVDCCSRTSIWNWVTCNANSNSWMWTTLNSNQLGQLKWVQKDYMIYNYCTDFKRFPQGLPTECNLN

SEQ ID NO: 13783 - protein, 154 aa, Panicum virgatum
  misc_feature: Useful for making plants with altered carbohydrate content
MARRVSSLLLLLLLGALAAAAAASFDQDFDITWGDGRGKIQDGGRLLTLTLDRTSGSGFQSRREYLFGKIDMQIKLVPDNSAGTVTAYYLSSQGSTHDEIDFEFLGNVTGEPYTLHTNVFTQGQGQREQQFRLWFDPTTDFHTYSILWNPKHIM

SEQ ID NO: 13784 - protein, 261 aa, Panicum virgatum
  misc_feature: Useful for making plants with altered carbohydrate content
MEGTSRSLPCILLTLLATTSLLWKEAACFSASGLNKAFATFYGGSDASGTMGGACGYGNLYSTGYGTNTAALSTALFNDGASCGQCYRITCDYQADPRFCISGTSVTITATNLCPPNYALPNDNGGWCNPPRQHFDMAEPAWLKIGIYRGGIVPVIYQRVPCVKQGGVRFTINGRDYFELVLISNVGGCGSIQSVSIKGSRTGWIAMSRNWGVNWQSNAYLNGQSLSFQVTSSDGQTKTFLNIVPANWGFGQTFASSQQFS

SEQ ID NO: 13785 - protein, 255 aa, Arabidopsis thaliana
  misc_feature: Useful for making plants with altered cell wall content and/or composition
MTKIFSLLVAMIFSTMFFMKISSVSAGWLQAHATFYGGSDASGTMGGACGYGNLYTDGYKTNTAALSTALFNDGKSCGGCYQILCDATKVPQWCLKGKSITITATNFCPPNFAQASDNGGWCNPPRPHFDMAQPAFLTIAKYKAGIVPILYKKVGCRRSGGMRFTINGRNYFELVLISNVAGGGEISKVWIKGSKSNKWETMSRNWGANYQSNTYLNGQSLSFKVQLSDGSIKAALNVVPSNWRFGQSFKSNVNF

SEQ ID NO: 13786 - protein, 680 aa, Arabidopsis thaliana
  misc_feature: Useful for making plants with altered cell wall content and/or composition
MTTFSTCAAFLSLVVVLHAVHVGGAILESQAPHRELKAYRPLQDNNLQEVYASSAAAVHYDPDLKDVNIVATYSDHYGNIRLGRVKMGDLSPSWVLENPAYQVSRKTKGSQLVIPRDSFQNDTGMEDNASHSTTNQTDESENQFPNVDFASPAKLKRQILRQERRGQRTLELIRQEKETDEQMQEAAIQKSMSFENSVIGKYSIWRRDYESPNADAILKLMRDQIIMAKAYANIAKSKNVTNLYVFLMQQCGENKRVIGKATSDADLPSSALDQAKAMGHALSLAKDELYDCHELAKKFRAILQSTERKVDGLKKKGTFLIQLAAKTFPKPLHCLSLQLAADYFILGFNEEDAVKEDVSQKKLEDPSLYHYAIFSDNVLATSVVVNSTVLNAKEPQRHVFHIVTDKLNFGAMKMWFRINAPADATIQVENINDFKWLNSSYCSVLRQLESARLKEYYFKANHPSSISAGADNLKYRNPKYLSMLNHLRFYLPEVYPKLEKILFLDDDIVVQKDLAPLWEIDMQGKVNGAVETCKESFHRFDKYLNFSNPKISENFDAGACGWAFGMNMFDLKEWRKRNITGIYHYWQDLNEDRTLWKLGSLPPGLITFYNLTYAMDRSWHVLGLGYDPALNQTAIENAAVVHYNGNYKPWLGLAFAKYKPYWSKYVEYDNPYLRRCDINE

SEQ ID NO: 13787 - protein, 456 aa, Panicum virgatum
  misc_feature: Useful for making plants with altered carbohydrate content
MRDQMIMARIYSVLAKSRDKLDLYQELLARLKESQRSLGEATADAELPKSALERMKAMAQVLSKARDLLYDCKAITERLRVMLLSADEQVRSLKKQSTFLSQLAAKTIPNGIHCLSMRLTIDYYLLSPEKRKFPNSENLENPELYHYALFSDNVLAASVVVNSTIMNAKEPEKHVFHLVTDKLNFGAMNMWFLLNPPGDATIHVENVDDFKWLNSSYCPVLKQLESAAMKEYYFKADRPKTLSADSSNLKYRNPKYLSMLNHLRFYLPQVYPKLNKILFLDDDIVVQRDLTGLWEVDLNGNVNGAVETCGESFHRFDKYLNFSNPNISQNFDPNACGWAYGMNMFDLEEWKRKDITGIYHKWQNMNENRLLWKLGTLPPGLLTFYKLTHPLDKSWHVLGLGYNPTIERSEIDNAAVIHYNGNMKPWLEIAMTKYRPYWTKYINYEHPYIHGCKVSQ

SEQ ID NO: 13788 - protein, 347 aa, Arabidopsis thaliana
  misc_feature: Useful for making plants with altered cell wall content and/or composition
MEKPESEKKSAVSDVGAWAMNVISSVGIIMANKQLMSSSGFGFGFATTLTGFHFAFTALVGMVSNATGLSASKHVPLWELLWFSIVANISIAAMNFSLMLNSVGFYQISKLSMIPVVCVLEWILHSKHYCKEVKASVMVVVIGVGICTVTDVKVNAKGFICACTAVFSTSLQQISIGSLQKKYSVGSFELLSKTAPIQAISLLICGPFVDYLLSGKFISTYQMTYGAIFCILLSCALAVFCNISQYLCIGRFSATSFQVLGHMKTVCVLTLGWLLFDSEMTFKNIAGMAIAIVGMVIYSWAVDIEKQRNAKSTPHGKHSMTEDEIKLLKEGVEHIDLKDVELGDTKP

SEQ ID NO: 13789 - protein, 214 aa, Panicum virgatum
  misc_feature: Useful for making plants with altered carbohydrate content
MAGRIAVAAAFLALAVVPAALAQAPGPAAAPSGPPNMTAILEKGGQYTTFIRLMKETQQDTQLNSQLNSSFGNNGGGYTVFAPTDNAFNNLKPGTLNSLTQQQQVSLVQGHILPSFYSMDSFQTASNPVRTQASGRDGPYTLNITSDTNNQVNVSSGVVEVRINNALYSAKPLAVYSVDKVLLPMELFGAKAPAAAPTASEGKPKKGGSSDASS

SEQ ID NO: 13790 - protein, 667 aa, Panicum virgatum
  misc_feature: Useful for making plants with altered carbohydrate content
MAASAAPQVVVLGLLLLAGLAAAQRGTTPAAAAPAPDPGCNGIQLTYSFQGRTKIRPFVSDINKQPYAFRANATVLNSGTRPLKSWAILVEFAHGEILVGVDGAVLTGGGELPYNTTEDAGNATSFSGYPQTDLLTPIATAGDLSQIQASVGIVGTLFAGPDPFDPFPTKLSLDNPDYACPAARNATPATLSTCCVLTPEAEANATVIDANATDPTKNFLPRGTGDLVITYDVLQAYPSSYLALVTLENNAKLGRLDNWRLSWEWRRGEFIYSMKGAHTSEVDTSGCIYGAQGQYYQSLDFSQVLNCDRKPVILDLPLSRYNDTQIGKIDNCCRNGTILPKSMDEKQSKSAFQMQVFKMPPDLNRTKLFPPANFKIAGASSLNPDYTCGQPVPVSPTAIPDPSGLDSTTLAVATWQVVCNITRTKEAKPKCCVTFSAYYNDSVIPCNTCACGCPANRRGPTCSTTAQSMLLPPEALLVPFDNRTQKAMVWAELKHHNVPRPMPCGDFCGVSINWHVSTDYTKGWSARVTLFNWEDVDMANWFAAIVMDKAYDGFEKAYSFNATAVGKNTIFVQGLEGLNYLGKQTNMSGTDYLVPGKQQSVLSFTKKLTPGIDVVAGDGFPTKVFFNGDECAMPQRIPMSSGFRTRLSSAFALVLVLAASAFLLLQQ

SEQ ID NO: 13791 - protein, 661 aa, Arabidopsis thaliana
  misc_feature: Useful for making plants with altered cell wall content and/or composition
MDSAPNFIPRLLLLSLLIVSIPLTSSQSDANTTNPSPSPPSDSDLCNGVFVSYTHTKGSKIPPNDTANQPYRFESVITVLNHGRDELKSWRVFVKFAHREILVSASNAVLSDGSSLPVSVENGTVFAGYPSSDLKSAIQTAGDVTQMQARVELVGTQFGVAPPNVPLPKNITLATDGWKCPKATQKGTNVLQVCCIPDPDYDNREIIDNEFLPRKDGDLTIMYDVVRSYSSNYMAQVTMENHNPLGRLDNWKLSFDWMRDEFIYTMKGAYPSIVDSSDCVDGPQAKHYQDLDFSNVLSCARRPTVIDLPPTKYNDSTFGLIPFCCRNGTILPRSMDPSKSSSVFQMQVYKMPPDLNISALSPPQNWRINGTLNPDYKCGPPVRVSPSQFVDPSGLPSNRTAFASWQVVCNITQPKDASPRCCVSFSAYFNDSIVPCKTCACGCSSNKAARACSATAPSLLLPQQALLVPFENRTELTVAWAYLKQRPVPNPMPCGDNCGVSINWHLATDYRGGWTARVTVFNWGETDFVDWFTAVQMKNAAPGFEKAYSFNASTIGINGKNNTIFMEGLPGLNYLVAERDGENPLKNPRIPGKQQSVMSFTKKLTPGINVPGGDGFPSKVFFNGEECSLPTILPMRSSQHRKHISVFLLALPVLALLILRA

SEQ ID NO: 13792 - protein, 361 aa, Arabidopsis thaliana
  misc_feature: Useful for making plants with altered cell wall content and/or composition
MVEAQSWTTRRMSNPRFDAAATAAPTIVDIPGTPPHSSASSPLKPFFLSSPTVSPTILTAAIIAAWFGSNIGVLLLNKYLLFYYGFRYPIFLTMTHMLSCAAYSSAVINIAGIVPRQHILSRRQFLKILSLSAIFCLSVVCGNTSLRYIPVSFNQAIGATTPFFTAVFSFLITCKTESTEVYLALLPVVSGIVLASNSEPSFHLFGFLICVASTAGRALKSVVQGIILTSESEKLHSMNLLLYMAPMAACILLPFTLYIEGNVLRVLIEKARTDPLIIFLLAGNATVAYLVNLTNFLVTKHTSALTLQVLGNGKAAVAAGVSVLIFRNPVTVMGIAGFGVTIMGVVLYSEARKRSKLLNQK

SEQ ID NO: 13793 - protein, 250 aa, Arabidopsis thaliana
  misc_feature: Useful for making plants with modulated heat sensitivity
MTKNYPTVSEDYKKAVEKCRRKLRGLIAEKNCAPIMVRLAWHSAGTFDCQSRTGGPFGTMRFDAEQAHGANSGIHIALRLLDPIREQFPTISFADFHQLAGVVAVEVTGGPDIPFHPGREDKPQPPPEGRLPDATKGCDHLRDVFAKQMGLSDKDIVALSGAHTLGRCHKDRSGFEGAWTSNPLIFDNSYFKELLSGEKEGLLQLVSDKALLDDPVFRPLVEKYAADEDAFFADYAEAHMKLSELGFADA

SEQ ID NO: 13794 - protein, 251 aa, Arabidopsis thaliana
  misc_feature: Useful for making plants with modulated water use efficiency
MVKKSYPEVKEEYKKAVQRCKRKLRGLIAEKHCAPIVLRLAWHSAGTFDVKTKTGGPFGTIRHPQELAHDANNGLDIAVRLLDPIKELFPILSYADFYQLAGVVAVEITGGPEIPFHPGRLDKVEPPPEGRLPQATKGVDHLRDVFGRMGLNDKDIVALSGGHTLGRCHKERSGFEGAWTPNPLIFDNSYFKEILSGEKEGLLQLPTDKALLDDPLFLPFVEKYAADEDAFFEDYTEAHLKLSELGFADKE

SEQ ID NO: 13795 - protein, 289 aa, Panicum virgatum
  misc_feature: Useful for making plants with altered carbohydrate content
MAAPVVDAEYLRQVDRARRQLRALISNKGCAPIMLRLAWHDAGTYDVKTKTGGANGSIRFEEEYTHGSNAGLKIAIDLLEPIKAKNPKITYADLYQLAGVVAVEVTGGPTIEFVPGRRDSSVCPREGRLPDAKKGAPHLRDIFYRMGLTDKDIVALSGGHTLGKAHPERSGFEGAWTQEPLKFDNSYFLELLKGASEGLLQLPTDKALLSDPEFRHYVELYAKDEDAFFKDYAESHKKLSELGFAPRSAASAKSDLPTGAVLAQGAFGVAVAAAVVVAGYLYEASRKAK

SEQ ID NO: 13796 - protein, 279 aa, Arabidopsis thaliana
  misc_feature: Useful for making plants with altered cell wall content and/or composition
MAVNVDAEYLKEIEKTRRDLRALISSRNCAPIMLRLAWHDAGTYDAKKKTGGANGSIRFKEELNRPHNKGLEKAVAFCEEVKAKHPRVSYADLYQLAGVVAVEVTGGPAIPFTPGRKDADSADDGELPNPNEGASHLRTLFSRMGLLDRDIVALSGGHTLGRAHKERSDFEGPWTQDPLKFDNSYFVELLKGETPGLLQLKTDKALLDDPKFHPFVKLYAKDEDMFFKAYAISHKKLSELGFNPPRRIPSAVTQQTLGIAVAAAVVIFTICYEASRRGK

SEQ ID NO: 13797 - protein, 222 aa, Panicum virgatum
  misc_feature: Useful for making plants with altered carbohydrate content
MEVPPLPAAAEEERRGAATGSCLHKLVSGVLSGALTGLFAVAGGLTGAFTGALAGRASDSGVLRGAGLGAFAGAVLSIEVLEASRAYWSTDRSSPQSTSSMGDFIEQLLHARFVQDQYEPSAYMAYRWQVGIADNDDLFDVLEEVLSDGLSQDTLKKLPHHVVTDQKQESIGENLSCAICLQDIVAGETVRKLPKCSHTFHQPCVDRWFIDHGSCPVCRQDV

SEQ ID NO: 13798 - protein, 355 aa, Arabidopsis thaliana
  misc_feature: Useful for making plants with altered cell wall content and/or composition
MSSSESVENECMCWAARDPSGLLSPHTITRRSVTTDDVSLTITHCGVCYADVIWSRNQHGDSKYPLVPGHEIAGIVTKVGPNVQRFKVGDHVGVGTYVNSCRECEYCNEGQEVNCAKGVFTFNGIDHDGSVTKGGYSSHIVVHERYCYKIPVDYPLESAAPLLCAGITVYAPMMRHNMNQPGKSLGVIGLGGLGHMAVKFGKAFGLSVTVFSTSISKKEEALNLLGAENFVISSDHDQMKALEKSLDFLVDTASGDHAFDPYMSLLKIAGTYVLVGFPSEIKISPANLNLGMRMLAGSVTGGTKITQQMLDFCAAHKIYPNIEVIPIQKINEALERVVKKDIKYRFVIDIKNSLK

SEQ ID NO: 13799 - protein, 258 aa, Panicum virgatum
  misc_feature: Useful for making plants with altered carbohydrate content
MASTAAEAAKAAEQPANGNSEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGTFDFAFVDADKDNYLNYHERLLKLVKLGGLIGYDNTLWNGSVVLPDDAPMRKYIRYYRDFVLVLNKALAADERVEICQLPVGDGVTLCRRVK

SEQ ID NO: 13800 - protein, 400 aa, Panicum virgatum
  misc_feature: Useful for making plants with altered carbohydrate content
NSPSSDPTNAAVSAPVPASRAGEEDRPAGPPAAMPSSPKVFFASSTPSSRRAGALRRLLSSPAFSVACLLFGLAGFLAAALTLSASPPAARSRCPDSSRPLSVSVAWDRRPGDVSSAGSAELPAHLTTGSRGRHKVMAFVGIFTGFSSIGRRRALRRTWLPADRQGLLRLEEATGLAFRFVIGKSNSKNKMAVLDREVEEFDDFVLLDIEEEYSRLPYKTLAFFKAAYALYDSDFYVKADDDIYLRPDRLSLLLAKERSHPQTYIGCMKKGPVFTDPKLKWYEPQSFLLGSEYFLHAYGPIYALSADVVASLVALRNNSFRMFSNEDVTIGSWMLAMNVNHENTHALCEPDCTESSIAVWDIPKCSGLCHPEVKMLELHQRKECTGGPTVAAEVSESDDR

SEQ ID NO: 13801 - protein, 123 aa, Glycine max
  misc_feature: Useful for making plants with modulated biomass
  misc_feature: Useful for making plants with modulated flowering time
MYLGVRKRPWGRYAAEIRNPYTKERHWLGTFDTAEEAAIAYDLSSIKICGINARTNFHYPFVSLPPLPMSSLPPPPPPPTPELDPSVEVCLEMMNAASYDGDDESLVIASILQSFSNSGNCSF

SEQ ID NO: 13802 - protein, 373 aa, Panicum virgatum
  misc_feature: Useful for making plants with altered carbohydrate content
MAHSNGAAAGGGGGGGEAAPVPRPLAPARKAALITGITGQDGSYLTELLLSKGYEVHGLIRRSSNFNTQRLDHIYHDPHAVPSAPRPPMRLHYADLSDSSSLRRALDAIAPDEVYNLAAQSHVAVSFEIPDYTADVTATGALRLLEAVRLARKPMRYYQAGSSEMFGSTPPPQSEDTPFHPRSPYAAAKVAAHWYTVNYREAYGLFACNGVLFNHESPRRGENFVTRKITRAVGRIKVGLQTKVFLGNLSAARDWGFAGDYVEAMWLMLQQDQPGDYVVATEESHTVEEFLQAAFGYAGLNWKDHVVIDKKYFRPAEVDSLKGDSTKARRVLKWKPKVGFQQLVEMMVDHDIELAKKEKVLVDAGYRDPKQQP

SEQ ID NO: 13803 - protein, 361 aa, Arabidopsis thaliana
  misc_feature: Useful for making plants with altered cell wall content and/or composition
MASRSLNGDSDIVKPRKIALVTGITGQDGSYLTEFLLEKGYEVHGLIRRSSNFNTQRLNHIYVDPHNVNKALMKLHYGDLSDASSLRRWLDVIKPDEVYNLAAQSHVAVSFEIPDYTADVVATGALRLLEAVRSHNIDNGRAIKYYQAGSSEMFGSTPPPQSETTPFHPRSPYAASKCAAHWYTVNYREAYGLYACNGILFNHESPRRGENFVTRKITRALGRIKVGLQTKLFLGNIQASRDWGFAGDYVEAMWLMLQQEKPDDYVVATEESHTVKEFLDVSFGYVGLNWKDHVEIDKRYFRPTEVDNLKGDASKAKEMLGWKPKVGFEKLVKMMVDEDLELAKREKVLADAGYMDAQQQP

SEQ ID NO: 13804 - protein, 161 aa, Arabidopsis thaliana
  misc_feature: Useful for making plants with modulated biotic stress sensitivity
MNFTGYSRFLIVFVALVGALVLPSKAQDSPQDYLRVHNQARGAVGVGPMQWDERVAAYARSYAEQLRGNCRLIHSGGPYGENLAWGSGDLSGVSAVNMWVSEKANYNYAANTCNGVCGHYTQVVWRKSVRLGCAKVRCNNGGTIISCNYDPRGNYVNEKPY

SEQ ID NO: 13805 - protein, 297 aa, Panicum virgatum
  misc_feature: Useful for making plants with altered carbohydrate content
MAAARWLLVAAVAVAALAAKRAAAAAPRKPVDVPFQRNYVPTWAADHIRYVDGGREVQLYLDKSTGTGFQTRGSYLFGHFSMHMKLVGGDSAGIVTAFYLSSQNSEHDEIDFEFLGNRTGQPYILQTNVFTGGKGDREQRIYLWFDPTKEYHSYSVLWNLYMIAFFVDDVPIRMFRNSSGDLGVRYPFSQPMKLYSSLWNADDWATRGGREKTDWSNAPFVASYRGFHVDGCEASAEARFCATQGARWWDQPEFRDLDAAQYRKLREVRQRYTIYNYCTDRDRYAAMPPECARDRDV

SEQ ID NO: 13806 - protein, 293 aa, Arabidopsis thaliana
  misc_feature: Useful for making plants with altered cell wall content and/or composition
MGRLSSTLCLTFLILATVAFGVPPKKSINVPFGRNYFPTWAFDHIKYLNGGSEVHLVLDKYTGTGFQSKGSYLFGHFSMHIKMVAGDSAGTVTAFYLSSQNSEHDEIDFEFLGNRTGQPYILQTNVFTGGAGNREQRINLWFDPSKDYHSYSVLWNMYQIVFFVDDVPIRVFKNSKDVGVKFPFNQPMKIYSSLWNADDWATRGGLEKTNWEKAPFVASYRGFHVDGCEASVNAKFCETQGKRWWDQKEFQDLDANQYKRLKWVRKRYTIYNYCTDRVRFPVPPPECRRDRDI

SEQ ID NO: 13807 - protein, 104 aa, Glycine max
  misc_feature: Useful for making plants with modulated nitrogen use efficiency
  misc_feature (82)..(82): Xaa is any aa, unknown, or other
  misc_feature (83)..(83): Xaa is any aa, unknown, or other
  misc_feature (84)..(84): Xaa is any aa, unknown, or other
MGRQPCCDKVGLKKGPWTAEEDKKLINFILTNGQCCWRAVPKLAGLLRCGKSCRLRWTNYLRPDLKERPSIRIMKRKWSLIXXXNLAIDGLRLLLISQEELIMR

SEQ ID NO: 13808 - protein, 481 aa, Arabidopsis thaliana
  misc_feature: Useful for making plants with modulated nitrogen use efficiency
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSDPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 13809 - protein, 469 aa, Panicum virgatum
  misc_feature: Useful for making plants with altered carbohydrate content
MGWSVGLCWWLVAAAAAAGAAEGEVGAVAGAAAPRRHAYAAMMYMGTPRDYEFYVATRVMMRSLGRLSATADRVVIASLDVPPRWVQALKDDGVKVVSVENLKNPYEKQENFNMRFKLTLNKLYAWSLVSYERVVMLDSDNIFLQNTDELFQCGRFCAVFINPCIFHTGLFVLKPSMDVFKNMLHELAVGRENPDGADQGFLASYFPDLLDQPMFHPPANGTKLEGTYRLPLGYQMDASYYYLKLRWSIPCGPNSVITFPSAPWFKPWYWWSWPVLPLGLSWHEQRRENLGYSSEIPVVLIQAVLYIGVIAVTRLARPSLSKMCYNRRMEKSTMFLLSLLRVVVAWSILAAYTIPFFIIPRTVHPLLGWPLYLLGSFSLSSIVINIFLLHPFSVLTTWFGIVGALFVMSFPWYLNGIVRALVVFAYAFCCAPLVWASLVKTMSSLQVLVERDAFRLGEPNQNAEFTKLY

SEQ ID NO: 13810 - protein, 497 aa, Arabidopsis thaliana
  misc_feature: Useful for making plants with altered cell wall content and/or composition
MDLQRGFVFLSLVLSFMIIETTAYRERQLLLLQPPQETAIDTANAVVTVQDRGLKTRRPEHKNAYATMMYMGTPRDYEFYVATRVLIRSLRSLHVEADLVVIASLDVPLRWVQTLEEEDGAKVVRVENVDNPYRRQTNFNSRFKLTLNKLYAWALSDYDRVVMLDADNLFLKKADELFQCGRFCAVFINPCIFHTGLFVLQPSVEVFKDMLHELQVGRKNPDGADQGFLVSYFSDLLDQPLFSPPSNGSVLNGHLRLPLGYQMDASYFYLKLRWNIPCGPNSVITFPGAVWLKPWYWWSWPVLPLGFSWHEQRRATIGYSAEMPLVIIQAMFYLGIIVVTRLARPNITKLCYRRSDRNLTTIQAGFKLIALLSVVAAYIFPFFTIPHTIHPLIGWSLYLMASFALSSISINTLLLPTLPVLTPWLGILGTLLVMAFPWYPDGVVRALSVFAYAFCCAPFVWVSFRKITSHLQVLIEKEVLFPRLGDSGVTSGFSKLY

SEQ ID NO: 13811 - protein, 95 aa, Arabidopsis thaliana
  misc_feature: Useful for making plants with modulated nitrogen use efficiency
MALVRSLFVSNKILGGSLAGMRKSTSAPKGFLAVYVGESQKKQRYLVLVSYLSQPLFQDLLSKSEEEFGFDHPMGGLTIPCPEDTFLTVTSRIQG

SEQ ID NO: 13812 - protein, 385 aa, Panicum virgatum
  misc_feature: Useful for making plants with altered carbohydrate content
MMAAAALRPHKAPPARVPTRWVAALCAACFLLGVCVVNRYWPVPEHPGCPDMASSDHSRAALNQVSQTREVIMALDKTISDIEMRLAAARAAQAMSQGMSPSDSEGDQGSMRHRMSFVMGVFTTFANRKRRDSIRQTWMPQGDQLRRLEEKGAVIRFVIGRSENPNPDNDLDRAIDAEDKEYNDILRLNHVEGYGGLPMKIQMFLSTALTTWDADFYVKVDDNVHVNIGITRLILARHRMKPRVYIGCMKSGPVVAKNDSKYYEPDHWKFGTEGNNYFRHATRQLYAVTRDLATYISANRHILHKYSNEDVSFGSWLIGLEVEHVDERSLCCGTPPDCEWKAQAGNPCAASFDWNCTGICNPVERMAEVHRRCWEGRGAEGHAQF

SEQ ID NO: 13813 - protein, 108 aa, Arabidopsis thaliana
  misc_feature: Useful for making plants with modulated cold sensitivity
  misc_feature: Useful for making plants with modulated salt sensitivity
MGLMRSMLPNAKQIFKSQSMRNKNGSSSPSTTTTTSGLVPKGHVAVYVGEQMEKKRFVVPISYLNHPLFREFLNRAEEECGFHHSMGGLTIPCREESFLYLITSHQLH

SEQ ID NO: 13814 - protein, 346 aa, Arabidopsis thaliana
  misc_feature: Useful for making plants with altered cell wall content and/or composition
MAISKLIPTLVLFVLFSFDVSVAHPGLGFGWGSNSPIGGSFYSNLYPQFYQFSCPQADEIVMTVLEKAIAKEPRMAASLLRLHFHDCFVQGCDASILLDDSATIRSEKNAGPNKNSVRGFQVIDEIKAKLEQACPQTVSCADILALAARGSTILSGGPSWELPLGRRDSRTASLNGANTNIPAPNSTIQNLLTMFQRKGLNEEDLVSLSGGHTIGVARCTTFKQRLYNQNGNNQPDETLERSYYYGLRSICPPTGGDNNISPLDLASPARFDNTYFKLLLWGKGLLTSDEVLLTGNVGKTGALVKAYAEDERLFFQQFAKSMVNMGNIQPLTGFNGEIRKSCHVIN

SEQ ID NO: 13815 - protein, 334 aa, Panicum virgatum
  misc_feature: Useful for making plants with altered carbohydrate content
  misc_feature (192)..(192): Xaa is any aa, unknown, or other
MATSMGCLVLLCLVSPLFLASAVHGHPWGGLFPQFYDHSCPKAKEIVQSIVAQAVAKETRMAASLVRLHFHDCFVKGCDASVLLDNSSSIVSEKGSNPNRNSLRGFEVVDQIKAALEAACPGTVSCADILALAARDSTVLVGGPYWDVPLGRRDSLGASIQGSNNDIPAPNNTLPTIITKFKRQGLNVVDVXALSGGHTIGMSRCTSFRQRLYNQTGNGMADSTLDVSYVAQLRQGCPRSGGDNNLFPLDFVTPAKFDNFYYKNLLAGKGLLSSDEVLLTKSAETATLVKAYAADVNLFFQHFAQSMVNMGNISPLTGSQGEIRKNCRRLNNDH

SEQ ID NO: 13816 - protein, 83 aa, Arabidopsis thaliana
  misc_feature: Useful for making plants with altered cell wall content and/or composition
  misc_feature: Useful for making plants with modulated light quality response
KTPAYFDNHYFINLLEGRGLLISDNVLVSEDHEGEIFQKVWEYAVNQDLFFIDFVESMLKMGNINVLTGIEGEIRENCRFVNI

SEQ ID NO: 13817 - protein, 339 aa, Panicum virgatum
  misc_feature: Useful for making plants with altered carbohydrate content
MSSLSSSYSKASNGGEPQLVCVTGAGGFIGSWVVKELLLRGYRVRGTARDPADSKNAHLLALEGARERLTLCRADVLDYDSLRAAFTGCHGVLHVASPVSNNPELVTVAVDGTRNAINAAADEGVRRVVFTSSYGAVHMDPNRSPDAVLDETCWSDYEFCEQTNNLYCCAKMMAEITAVETAAARGLPLAVVVPSVTTGPLLQQALNVSSNHVARYLMGTKRTYPNAVAAYVDVRDVARAHVLAYERPDARGRYLCIGTVLHRAQLIAVLRELFPQYPVTAKCEDDGKPMAKPYKFSNQRARELGLEFTPLKKSLYEAVVCMQQKGHLPVISQQQHSYL

SEQ ID NO: 13818 - protein, 344 aa, Arabidopsis thaliana
  misc_feature: Useful for making plants with altered cell wall content and/or composition
  misc_feature: Useful for making plants with altered lignin content
MPVDVASPAGKTVCVTGAGGYIASWIVKILLERGYTVKGTVRNPDDPKNTHLRELEGGKERLILCKADLQDYEALKAAIDGCDGVFHTASPVTDDPEQMVEPAVNGAKFVINAAAEAKVKRVVITSSIGAVYMDPNRDPEAVVDESCWSDLDFCKNTKNWYCYGKMVAEQAAWETAKEKGVDLVVLNPVLVLGPPLQPTINASLYHVLKYLTGSAKTYANLTQAYVDVRDVALAHVLVYEAPSASGRYLLAESARHRGEVVEILAKLFPEYPLPTKCKDEKNPRAKPYKFTNQKIKDLGLEFTSTKQSLYDTVKSLQEKGHLAPPPPPPSASQESVENGIKIGS

SEQ ID NO: 13819 - protein, 336 aa, Arabidopsis thaliana
  misc_feature: Useful for making plants with altered cell wall content and/or composition
MAKSLNILIAALSLIAFSPFCLCSKAYGSGGYLFPQFYDQSCPKAQEIVQSIVAKAFEHDPRMPASLLRLHFHDCFVKGCDASILLDSSGTIISEKRSNPNRNSARGFELIEEIKHALEQECPETVSCADILALAARDSTVITGGPSWEVPLGRRDARGASLSGSNNDIPAPNNTFQTILTKFKRQGLDLVDLVSLSGSHTIGNSRCTSFRQRLYNQSGNGKPDMTLSQYYATLLRQRCPRSGGDQTLFFLDFATPFKFDNHYFKNLIMYKGLLSSDEILFTKNKQSKELVELYAENQEAFFEQFAKSMVKMGNISPLTGAKGEIRRICRRVNHAY

SEQ ID NO: 13820 - protein, 340 aa, Zea mays
  misc_feature: Useful for making plants with modulated nitrogen use efficiency
MVSSSSSPSATAAAAAAVVLAVALMTTTCFHGATAQLCEDYYDSTCPDAYDIVNQVLVDAVQSDTRIFASLIRLHFHDCFVQGCDASLLLDSVPGMPSEKTSAPNNGSARGFGVVDAAKAALESACPGVVSCADILAIAAEISVELSGGPSWGVLLGRLDSKTSDFNGSLDLPEPTDNLTILQQKFSNLSLNDVDLVALSGGHTFGRVQCKFITDRLYNFSGTNMPDPTLDASYRAFLTQRCPRNGDPTALNDLDPTTPDTFDNNYYTNIEVNRGILNSDQELKSSPLAQGTTAPIVDQFAASQDDFFASFAQSMINMGNIKPLTDPSRGEVRTNCRRVN

SEQ ID NO: 13821 - protein, 170 aa, Arabidopsis thaliana
  misc_feature: Useful for biocontainment applications
  misc_feature: Useful for making plants with modulated biomass
  misc_feature: Useful for making plants with modulated flowering time
  misc_feature: Useful for making plants with modulated light quality response
MATQDSQGIKLFGKTIAFNTRTIKNEEETHPPEQEATIAVRSSSSSDLTAEKRPDKIIACPRCKSMETKFCYFNNYNVNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 13822 - protein, 375 aa, Arabidopsis thaliana
  misc_feature: Useful for making plants with altered cell wall content and/or composition
LVVTSPSQLLMVPLTLIQAAASKGAVCLDGTLPGYHLHPGSGSGANRWLIQLEGGGWCNTRRSCIFRKTTRRGSSNHMEKVLAFTGILSNKSNENPDFFNWNRVKLRYCDGASFTGDSQDESSQLYYRGQRIWHSAMEELLSKGMQKAEQALLSGCSAGGLASILHCDQFKELFPGTTTVKCLSDAGMFMDAVDVSGGHSLRKMFQGVVTVQNLQKELSTACTKHLDPTSCFFPQNLVSGIKTPMFLLNAAYDAWQVQESLAPPSVDLSGSWKACKSDHSHCNSSQIQFFQDFRTHMVDAVKSFATSTHNGVFINSCFAHCQSERQDTWYAPDSPTLHGKTVAESVGDWYFDRTTVKAIDCPYPCDKTCHNLIFK

SEQ ID NO: 13823 - protein, 413 aa, Panicum virgatum
  misc_feature: Useful for making plants with altered carbohydrate content
MASRVVAVILVAVLVGASAAHGSEPWWNETQVYGTNANSGRSTGVFVGLTLIQSAAAKGAVCLDGSLPGYHLHRGFGSGANSWLVNLEGGGWCNDVSSCVFRKSSRRGSSNHMERQLQFTGIMSNRPEENPDFYNWNRVKVRYCDGGSFTGDSSNAAAGLYFRGQRIWQAAMDDLMAQGMRYANQALLAGCSAGGVSTILHCDEFRGLFPSNTKVKCLADAGMFLDTVDVSGRREMRSFFNGIVRLQGSGRSLPRSCTSRMDKTSCFFPQNVVPNIQTPTFILNTAYDVWQLQQSVAPKTADPQGLWSKCRTNHAYCNSNQLQFLQGFRNQMLDSVRGFSASRQNGVFINSCFAHCQSERQDTWYTNNSPRLGNKRIAEAVGDWFFGRGDAKYTDCAYPCDNTCHHLVFRGDH

SEQ ID NO: 13824 - protein, 445 aa, Arabidopsis thaliana
  misc_feature: Useful for making plants with altered cell wall content and/or composition
MASELINRRHETDQPTADAYYPKPIKPWFTVTRPMRYMLREQRLIFVLVGIAIATLVFTIFPRSTQSTPYSDPFSGYGIRPDESYVPAIQAQRKPSLEYLNRIGATGGKIPLGLKRKGLRVVVTGGAGFVGSHLVDRLMARGDTVIVVDNFFTGRKENVMHHFSNPNFEMIRHDVVEPILLEVDQIYHLACPASPVHYKFNPVKTIITNVVGTLNMLGLAKRVGARFLLTSTSEVYGDPLQHPQVETYWGNVNPIGVRSCYDEGKRTAETLTMDYHRGANVEVRIARIFNTYGPRMCIDDGRVVSNFVAQALRKEPLTVYGDGKQTRSFQFVSDLVEGLMRLMEGEHVGPFNLGNPGEFTMLELAKVVQETIDPNANIEFRPNTEDDPHKRKPDITKAKELLGWEPKVSLRQGLPLMVKDFRQRVFGDQKEGSSAAATTTKTTSA

SEQ ID NO: 13825 - protein, 325 aa, Arabidopsis thaliana
  misc_feature: Useful for making plants with altered cell wall content and/or composition
MLTRFKKQNNKMVRANIVSMVLLMHAIVGFPFHARGLSMTYYMMSCPFAEQIVKNSVNNALQADPTLAAGLIRMLFHDCFIEGCDASILLDSTKDNTAEKDSPANLSLRGYEIIDDAKEKIENRCPGVVSCADIVAMAARDAVFWAGGPYYDIPKGRFDGKRSKIEDTRNLPSPFLNASQLIQTFGQRGFTPQDVVALSGAHTLGVARCSSFKARLTVPDSSLDSTFANTLSKTCSAGDNAEQPFDATRNDFDNAYFNALQMKSGVLFSDQTLFNTPRTRNLVNGYALNQAKFFFDFQQAMRKMSNLDVKLGSQGEVRQNCRSIN

SEQ ID NO: 13826 - protein, 117 aa, Arabidopsis thaliana
  misc_feature: Useful for making plants with altered alkaloid content
MSTAAHHHQESSFFFPVAARLAGEILPVIRFSELTRPGFGSGSDCCAVCLHEFENEDEIRRLTNCQHIFHRSCLDRWMMGYNQMTCPLCRTPFISDELQVAFNQRVWSESELLAESN

SEQ ID NO: 13827 - protein, 1043 aa, Arabidopsis thaliana
  misc_feature: Useful for making plants with altered cell wall content and/or composition
  misc_feature: Useful for making plants with modulated biomass
  misc_feature: Useful for making plants with modulated carbohydrate content
MAGNDWVNSYLEAILDVGQGLDDARSSPSLLLRERGRFTPSRYFVEEVITGYDETDLHRSWVKAVATRSPQERNTRLENMCWRIWNLARQKKQHEEKEAQRLAKRRLEREKGRREATADMSEEFSEGEKGDIISDISTHGESTKPRLPRINSAESMELWASQQKGNKLYLVLISLHGLIRGENMELGRDSDTGGQVKYVVELARALGSMPGVYRVDLLTRQVSSPDVDYSYGEPTEMLTPRDSEDFSDEMGESSGAYIVRIPFGPKDKYIPKELLWPHIPEFVDGAMSHIMQMSNVLGEQVGVGKPIWPSAIHGHYADAGDATALLSGALNVPMLLTGHSLGRDKLEQLLRQGRLSKEEINSTYKIMRRIEGEELSLDVSEMVITSTRQEIDEQWRLYDGFDPILERKLRARIKRNVSCYGRFMPRMVKIPPGMEFNHIVPHGGDMEDTDGNEEHPTSPDPPIWAEIMRFFSNSRKPMILALARPDPKKNITTLVKAFGECRPLRELANLALIMGNRDGIDEMSSTSSSVLLSVLKLIDKYDLYGQVAYPKHHKQSDVPDIYRLAAKSKGVFINPAIIEPFGLTLIEAAAHGLPMVATKNGGPVDIHRVLDNGLLVDPHDQQSISEALLKLVADKHLWAKCRQNGLKNIHQFSWPEHCKTYLSRITSFKPRHPQWQSDDGGDNSEPESPSDSLRDIQDISLNLKFSFDGSGNDNYMNQEGSSMDRKSKIEAAVQNWSKGKDSRKMGSLERSEVNSGKFPAVRRRKFIVVIALDFDGEEDTLEATKRILDAVEKERAEGSVGFILSTSLTISEVQSFLVSGGLNPNDFDAFICNSGSDLHYTSLNNEDGPFVVDFYYHSHIEYRWGGEGLRKTLIRWASSLNEKKADNDEQIVTLAEHLSTDYCYTFTVKKPAAVPPVRELRKLLRIQALRCHVVYSQNGTRINVIPVLASRIQALRYLFVRWGIDMAKMAVFVGESGDTDYEGLLGGLHKSVVLKGVSCSACLHANRSYPLTDVISFESNNVVHASPDSDVRDALKKLELLKD

SEQ ID NO: 13828 - protein, 175 aa, Panicum virgatum
  misc_feature: Useful for making plants with altered carbohydrate content
MPRMVVIPPGMDFSNVFPEDIDGDGDGKDDIISLEGASPKSMPPIWAEVMRFLTNPHKPMILALSRPDPKKNITTLVKAFGECRPLRELANLTLIMGNRDDIDEMSAGNASVLTTVLKLIDKYDLYGSVAFPKHHNQADVPEIYRLAAKMKGVFIHPALVESFWPPLDRGCGTRT

SEQ ID NO: 13829 - protein, 581 aa, Panicum virgatum
  misc_feature: Useful for making plants with altered carbohydrate content
MGTPQRVLLAPWALLAVVALQLAGASHVIHWSLEAEAAPPPSVPASIVSPLLKTGYHFQPPRNWINDPNAPMYYKGWYHLFYQYNPKGAVWGNIVWAHSVSRDLINWIALEPAIYPSIPSDQFGCWSGSATLLPDGTPAITYTGISRSDINYQVQNVAFPKNASDPLLREWVKPAELNPIAVPEGGINATQFRDPTTAWYADGHWRMLVGGVRGGARGLAFVYRSRDFRRWRRARKPLHSAATGMWECPDFFPVSGAGLENGLDTSEAGPKYVLKNSLDLTRYDYYTVGSYDRRRDRYVPDDPAGDERRRRYDYGNFYASKTFYDPAKRRRVLLGWANESDSVPDDKAKGWAGIHAIPRKIWLDPSGKQLLQWPVEEVEKLRGKPVSVAGKVVKPGQHFEVTGLATYQADVEVSFEVSSLDRAEPFDAAYANDAQKLCGVKGADAKGGVGPFGLWVLASADLQEKTAVFFRVFKDGYGKPKVLMCTDPTKSSLSPDLYKPTFAGFVDTDISSGKITLRSLIDRSVVESFGAGGRTCILSRVYPSIAVGKDAHLYVFNNGEADIKVSHLTAWEMKKPLMNGA

SEQ ID NO: 13830 - protein, 770 aa, Arabidopsis thaliana
  misc_feature: Useful for making plants with modulated water use efficiency
MVAPALLPELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 13831 - protein, 428 aa, Arabidopsis thaliana
  misc_feature: Useful for making plants with modulated nitrogen use efficiency
MSSRICAMAKPNDAETLSSSVDMSLSPRVQSLKPSKTMVITDLAATLVQSGVPVIRLAAGEPDFDTPKVVAEAGINAIREGFTRYTLNAGITELREAICRKLKEENGLSYAPDQILVSNGAKQSLLQAVLAVCSPGDEVIIPAPYWVSYTEQARLADATPVVIPTKISNNFLLDPKDLESKLTEKSRLLILCSPSNPTGSVYPKSLLEEIARIIAKHPRLLVLSDEIYEHIIYAPATHTSFASLPDMYERTLTVNGFSKAFAMTGWRLGYLAGPKHIVAACSKLQGQVSSGASSIAQKAGVAALGLGKAGGETVAEMVKAYRERRDFLVKSLGDIKGVKISEPQGAFYLFIDFSAYYGSEAEGFGLINDSSSLALYFLDKFQVAMVPGDAFGDDSCIRISYATSLDVLQAAVEKIRKALEPLRATVSV

SEQ ID NO: 13832 - protein, 474 aa, Panicum virgatum
  misc_feature: Useful for making plants with altered carbohydrate content
VGGALASPPSRSWPPPTPRRSRGRARRPSSSSSPCSPPPTSPSRASVRAPDRAPSSCSPRRTHHHQQLRRVLRRRAAFPRRLRSSAAFRRAVAELDERARGGGGRGARLEVPPGRWLTGSFNLTSRFTLFLHQGAVILGSQDLEEWPLIAPLPSYGRGRERLGPRHISLIHGEGLNDVVVTGNNGTIDGQGEMWWEMWWNRTLNYTRGHLVELANSTNILISNITLRNSPFWTVHPVYSSNVVIKGLTILAPLNAPNTDGIDPDSSSEVCIDDCYIESGDDLVAVKSGWDQYGISVGKPSTNIVIQRVSGTTPMCSGVGFGSEMSGGISNVLVRDLHVWNSAQAVRLKTDVGQGGYITNITITKVTMEKVKVPIRFSRGADDHSDDNYDRTALPRISNVLISGIVGVDLQRAPMLEAVAGAVYEGICFRNVSLRGIRRQGRWHCESVYGAAHGVFPAPCEELRKNRSSSWCGFS

SEQ ID NO: 13833 - protein, 475 aa, Arabidopsis thaliana
  misc_feature: Useful for making plants with altered cell wall content and/or composition
MEPEKNPTTVLSAITRPSWAFLLLVFTVLAILSLQISSNSFLPLWIPTSQYDDPVTCSGFFNHDPFPNRIVMSITDFGGVGDGKTSNTAAFRRAVRHLEGFAAEGGAQLNVPEGTWLSGSFNLTSNFTLFLERGALILGSKDLDEWPIIEPLPSYGRGRERPGGRHISLIHGDNLTNVVITGENGTIDGQGKMWWELWWNRTLVHTRGHLIELKNSHNILISNLTLLNSPFWTIHPVYCSNVVIRNMTILAPMNAPNTDGIDPDSSTNVCIEDCYIESGDDLVAVKSGWDQYGMAVARPSSNIVIRRISGTTRTCSGVGIGSEMSGGIFNITVEDIHVWDSAAGLRIKTDKGRGGYISNITFNNVLLEKVKVPIRFSSGSNDHSDDKWDPKALPRVKGIYISNVVSLNSRKAPMLLGVEGTSFQDVCLRNVTLLGLPKTEKWKCKDVSGYASDVFPLSCPQLLQKKGSIAQCSYR

SEQ ID NO: 13834 - protein, 851 aa, Arabidopsis thaliana
  misc_feature: Useful for making plants with altered cell wall content and/or composition
MAIPRFSSLLRCRKWAKSDWLVASIGCVLIVFFLSFFFDPTSDSVPSVDRSRPIISPSDLVKLKLSSVAKERGAFCLDGSLPGYHFHEGSGSGSQSWLVHLEGGGWCNTVASCSARALTKLGSSNYFEQEVAFQGVLSSDPSQNPEFFNWNKVAIRYCDGASFSGRPEAEFKNGTRLFFRGQLIWEAIIDELLSMGMSDAKQAILTGCSAGGLASLIHCDYFRDHLPKDAAVKCVSDGGYFLNVPDVLGNPTMRSFYHDVVNLQGVEKSLDQKCVAKTEPSKCMFPQEFLKNIRTPVFLVNPAYDFWQIQHVLVPTSADPDKSWAKCRLNIKECDAEQIKVLHGFRSSMMTAIGEFHQNKDGGMFIDSCYAHCQTVMSVTWHSLTSPRIENKKTGEANRLSIPVQSFLLQHEFHMNLPYILILPLPLLVDFFDSPEASSAREQSLPQNSQSGTWSKSDWLLASIGIVLIVYSFSLSFNSTSDSIPSVDRSDLVKLKLSSKAKERGAFCLDGSLPGYHFHKGSGSGSNSWLLYLEGGGGCRTIESCSARAMTRLGSSNFFEHEVPFFGVLSSDPSQNPDFFNWNRVMIRYCDGACFSGHPEAEFKNETRLFFRGQLIWEAIMDELLSMGMSHAKRAMLTGCSAGGLSTLIHCDYFRDHLPKDATVKCVSDGGYILNVLDVLGNPTMGSFFHDVVTLQSVDKSLDQNCVAKMEPSKCMFPQESLKNIRTPVFLVNTAYDYWQIQNGLVPDSPDLDERWKICRLNIQECDAAQMKVLHGFRSSLIDAIGEFHVNKEGGMFINSCNSHCQIRESWHSATSTRIENKTIAESVGDWYFNRKPVKLIDCPYPCNASC

SEQ ID NO: 13835 - protein, 528 aa, Panicum virgatum
  misc_feature: Useful for making plants with altered carbohydrate content
MAPAARLLLALLAAAAVGPCAGAGSGRVDLWPMPASVARGAQTLLVSRDLKLSTAGSNYSDGRGILREAFQRMLAVVELDHVVNGSYGGRGSPVLAGVRVVVRSPNDELNFGVDESYKLSVPATGNPLYAQIEAQTVFGALHALETFSQLCKFDFNARLIELHSAPWTIMDVPRFHYRGLLIDTSRHYLPVPVIKSVIDSMTFSKLNVLHWHIVDEQSFPLQIPSYPKLWNGAYSYSERYTFDDAIDIVQYAEKRGVNVLAEIDVPGHALSWGVGYPSLWPSATCKEPLDVSNDFTFQVINGILSDFGKIFKFKFVHLGGDEVNTSCWTTTPRIKSWLIQHGMNESDAYRYFVLRAQKIAISHGYDIINWEETFNNFGDKLDRKTVVHNWLGSGVAQKVVTAGLRCIVSNQDKWYLDHLDATWEGFYMNEPLTNIYNPEQQRLVLGGEVCMWGEHIDASDIQQTIWPRAAAAAERLWTPIEKLAKDPGSVAARLARFRCLLNQRGVAAAPLAGYGRSAPSEPGSCLRQ

SEQ ID NO: 13836 - protein, 439 aa, Panicum virgatum
  misc_feature: Useful for making plants with altered carbohydrate content
MIRPQAGLLLRSLGAGGARPTAASMRSATSLLLGAALATAFFLLYTALCRDIGGSPGTPPPPRWEREAGKAVDTGGATAADREVRRDLNPKQRQHAAEEEGRKEEVTTRGDGGGGGHGGGGEDEESGRDSKQEEQPQQIVMPATWTPTTKQQQEQQTQDDDLADLLRRAATADKTVLMTAINEAWAAPGSFLDLFLESFRHGEGTADLPRHLLIVAMDGKAFRRCVAVHAFCYWFRVAGLDFAGEQKYMKGDYLEMMWRRNGLQRRVLELGYSFLFTDVDILWFRSPFPRLPAGAQVVMSSDFFVGDPASPNNYPNGGLLYARSSPAAVAFYEHWQAARARFPGKHEQYVFDMIVKEGAPAAVGAAVRFLDTAVFGGFCQHSKDLGRVATMHANCCVGLENKLFDLKNVLDDWKAYRARVAAGDDARGFSWRVPGRCIH

SEQ ID NO: 13837 - protein, 249 aa, Zea mays
  misc_feature: Useful for making plants with altered terpenoid content
MTSSRQMELHYINTGFPYTITESFMDFFEGLTYAHADFALMDGFQDQGNPYWTMMHTNSYKYGYSGSGNYYSYAHAYDIDDYMHRTDGGRRTWDNTTPVNNVDSANVVLQGGEAPRTTANTTSEDCIQQVHQSPGSPQVVWQDNIDPDNMTYEELLDLGEAVGTQSRGLSQECISLLPITKYKCGFFSRKKTRRERCVICQMEYRRGNLQITLPCKHVYHASCVTRWLSINKVCPVCFAEVPGEDSLRQ

SEQ ID NO: 13838 - protein, 673 aa, Arabidopsis thaliana
  misc_feature: Useful for making plants with altered cell wall content and/or composition
MALKRGLSGVNRIRGSGGGSRSVLVLLIFFCVFAPLCFFVGRGVYIDSSNDYSIVSVKQNLDWRERLAMQSVRSLFSKEILDVIATSTADLGPLSLDSFKKNNLSASWRGTGVDPSFRHSENPATPDVKSNNLNEKRDSISKDSIHQKVETPTKIHRRQLREKRREMRANELVQHNDDTILKLENAAIERSKSVDSAVLGKYSIWRRENENDNSDSNIRLMRDQVIMARVYSGIAKLKNKNDLLQELQARLKDSQRVLGEATSDADLPRSAHEKLRAMGQVLAKAKMQLYDCKLVTGKLRAMLQTADEQVRSLKKQSTFLAQLAAKTIPNPIHCLSMRLTIDYYLLSPEKRKFPRSENLENPNLYHYALFSDNVLAASVVVNSTIMNAKDPSKHVFHLVTDKLNFGAMNMWFLLNPPGKATIHVENVDEFKWLNSSYCPVLRQLESAAMREYYFKADHPTSGSSNLKYRNPKYLSMLNHLRFYLPEVYPKLNKILFLDDDIIVQKDLTPLWEVNLNGKVNGAVETCGESFHRFDKYLNFSNPHIARNFNPNACGWAYGMNMFDLKEWKKRDITGIYHKWQNMNENRTLWKLGTLPPGLITFYGLTHPLNKAWHVLGLGYNPSIDKKDIENAAVVHYNGNMKPWLELAMSKYRPYWTKYIKFDHPYLRRCNLHE

SEQ ID NO: 13839 - protein, 525 aa, Arabidopsis thaliana
  misc_feature: Useful for making plants with altered cell wall content and/or composition
MEEKSKSRGWCGWFIAIIVLASVILAVVYTVKLRTKKSGDDDGGGPVPGPPGAIDKKYADALKLALQFFDIQKSGKLENNKIPWRGDSGLKDGSEDNLDLSKGLYDAGDHIKFGFPMAFTATVLSWSILEYGDQMNAVNQLDPAKDSLRWITDYLIKAHPSDNVLYIQVGDPKVDHPCWERPEDMKEKRPLTKIDVDTPGTEVAAETAAAMASASLVFKDSDPTYSATLLKHAKQLFNFADTKRGSYSVNIPEVQKFYNSTGYGDELLWAASWLYHATEDKTYLDYVSNHGKEFASFGNPTWFSWDNKLAGTQVLLSRLLFFKKDLSGSKGLGNYRNTAKAVMCGLLPKSPTSTASRTNGGLIWVSEWNSMQQSVSSAFLASLFSDYMLTSRIHKISCDGKIFKATELRDFAKSQADYMLGKNPLGTSFVVGYGDKYPQFVHHRGASIPADATTGCLDGFKWFNSTKPNPNIAYGALVGGPFFNETFTDSRENPMQNEPTTYNNALLVGLLSSLVTTSSTLQSLK

SEQ ID NO: 13840 - protein, 475 aa, Arabidopsis thaliana
  misc_feature: Useful for making plants with altered cell wall content and/or composition
MSSNQHDYSDALSKSILFFEGQRSGYLPNDQRMTWRRNSGLSDGWTHNIDLTGGYYDAGDNVKFNFPMAFTTTMLAWSVIEFGEFMPSSELRNSLVALRWSSNYLLKSVSQLPNRIFVQVGDPIADHNCWERPEDMDTPRTAYAVNAPNPASEVAGETTAALSAASIAFRSSDPGYSQTLLQNAVKTFQFADMYRGAYSSNDDIKNDVCPFYCDFNGFQDELLWGAAWLRKATGDESYLNYIESNREPFGANDNVDEFGWDNKVGGLNVLVSKEVIEGNMYNLEAYKASAESFMCSLVPESSGPHVEYTSAGLLYKPGGSQLQHATTISFLLLVYAQYLSRSSLSLNCGTLTVPPDYLRRLAKKQVDYILGNNPMGLSYMVGYGERYPKRIHHRGSSLPSIVDHPEAIRCKDGSVYFNSTEPNPNVLIGAVVGGPGEDDMYDDDRSDFRKSEPTTYINAPFVGVLAYFAANPGSS

SEQ ID NO: 13841 - protein, 408 aa, Panicum virgatum
  misc_feature: Useful for making plants with altered carbohydrate content
MSISVNGQSVVPPGFRFHPTEEELLTYYLKKKVASERIDLDVIRDVDLNKLEPWDIQEKCRIGSGPQNDWYFFSHKDKKYPTGTRTNRATAAGFWKATGRDKAIHTSARRIGMRKTLVFYKGRAPHGQKSDWIMHEYRLELDDAAHPATAAGDPYYPSPPPSAAIRAGDQAAAQEQEGWVICRVFKKKNLLHHGQSSGGGGATASATDGAHAAASKMAAPMEGSPSNCSSVTVSDHAKAPQVLHHSASDDALDHILQYMGTCRPCSSSKHHQADTKPALLDHHHLAATTTAAACHGSSLYGRFMKLPPLEHAGGGGALLPSPGEYGPADASGIADWDTLDRLAASYELNGLSDASKTMAAFFDDPTGTAGAAAFSAAAAHATVAGDGDLWSLARSVSSSLHADLMNNV

SEQ ID NO: 13842 - protein, 310 aa, Panicum virgatum
  misc_feature: Useful for making plants with altered carbohydrate content
MARPVQQAAALLPLLLACTLALLTLQLRPCAGQQQPPSPGYYPSATLRPLAFSEGYRTLWGPQHQTVSPDGRSLTLWMDRSSGSGFKSARAYRNGYFGASVRVQPGYTAGVNTAFYLSNSEEYPGHHDEIDMELLGTVPGEPYTLQTNVYVRGSGDGTIVGREMRFHLWFDPTADFHHYAIIWNPDQILFLVDDVPIRRYERKTEATFPDREMWAYGSIWDASDWATDGGRYRADYRYQPFVSRFADLKIGGCAADAPAGGCRPVPASPSGSAAALSPQQEAAMRWAQRNSMVYYYCLDSSRDHALYPEC

SEQ ID NO: 13843 - protein, 299 aa, Arabidopsis thaliana
  misc_feature: Useful for making plants with altered cell wall content and/or composition
MGNSLISLLSIFHLLVLWGSSVNAYWPPSPGYWPSSKVGSLNFYKGFRNLWGPQHQRMDQNALTIWLDRTSGSGFKSVKPFRSGYFGANIKLQPGYTAGVITSLYLSNNEAHPGFHDEVDIEFLGTTFGKPYTLQTNVYIRGSGDGKIIGREMKFRLWFDPTKDFHHYAILWSPREIIFLVDDIPIRRYPKKSASTFPLRPMWLYGSIWDASSWATEDGKYKADYKYQPFTAKYTNFKALGCTAYSSARCYPLSASPYRSGGLTRQQHQAMRWVQTHSMVYNYCKDYKRDHSLTPECWR

SEQ ID NO: 13844 - protein, 260 aa, Arabidopsis thaliana
  misc_feature: Useful for making plants with modulated light quality sensitivity
  misc_feature (18)..(18): Xaa is any aa, unknown, or other
MDIEQKQAEIIDQLVKRXSTCKSEALGPLIIEATSHPSLFAFSEILALPNVAQLEGTTDSVYLDLLRLFAHGTWGDYKCNATRLPHLSPDQILKLKQLTVLTLAESNKVLPYDTLMVELDVSNVRELEDFLINECMYAGIVRGKLDQLKRCFEVPFAAGRDLRPGQLGNMLHTLSNWLNTSENLLISIQDKIKWADNMSEMDKKHRKEAEEGVEEVKKSLSMKGDVDIRGNKEMFGEPSGVMDYEEDGIRPKRRRHPVTR

SEQ ID NO: 13845 - protein, 623 aa, Arabidopsis thaliana
  misc_feature: Useful for making plants with altered cell wall content and/or composition
MMRGRSDGGLKKRLIASVCVVALFVCFLFMYYGSSSQGASALEYGRSLRKLGSSYLSGDDDNGDTKQDDSVANAEDSLVVAKSFPVCDDRHSEIIPCLDRNFIYQMRLKLDLSLMEHYERHCPPPERRFNCLIPPPSGYKVPIKWPKSRDEVWKANIPHTHLAKEKSDQNWMVEKGEKISFPGGGTHFHYGADKYIASIANMLNFSNDVLNDEGRLRTVLDVGCGVASFGAYLLASDIMTMSLAPNDVHQNQIQFALERGIPAYLGVLGTKRLPYPSRSFEFAHCSRCRIDWLQRDGLLLLELDRVLRPGGYFAYSSPEAYAQDEENLKIWKEMSALVERMCWRIAVKRNQTVVWQKPLSNDCYLEREPGTQPPLCRSDADPDAVAGVSMEACITPYSKHDHKTKGSGLAPWPARLTSSPPRLADFGYSTDMFEKDTELWKQQVDSYWNLMSSKVKSNTVRNIMDMKAHMGSFAAALKDKDVWVMNVVSPDGPNTLKLIYDRGLIGTNHNWCEAFSTYPRTYDLLHAWSIFSDIKSKGCSAEDLLIEMDRILRPTGFVIIRDKQSVVESIKKYLQALHWETVASEKVNTSSELDQDSEDGENNVVFIVQKKLWLTSESLRDSE

SEQ ID NO: 13846 - protein, 97 aa, Arabidopsis thaliana
  misc_feature: Useful for making plants with modulated drought sensitivity
MENTDELVSIELPAPASWKKLFYPKRAGTPRKTEIVFVAPTGEEISSRKQLEQYLKAHPGNPVISEFEWTTGETPRRSSRISQKVRLQRLLLTKSPS

SEQ ID NO: 13847 - protein, 381 aa, Panicum virgatum
  misc_feature: Useful for making plants with altered carbohydrate content
MDGDRVPSGESTRRSLFGYIGFLLAIALVVFVGFVKGAISCYIPPSFWVFQTRRTELSRILPVHRFNQKVRRYSTNISRYFSATKTRLNEKTWSNMLFFWVVALIGIVNVCIAVHFLFSGIGAEEAYTYKGQHSQFTMVTMTYEARLWNLKLFVEHYSRCESVREIVVVWNKGNPPSSDAFDSTVPVRIRVEEINSLNNRFRVDPLIKTRAVFELDDDIMMTCSDLEKGFRVWREHPERMVGFYPRMIDGNPLQYRNERYARGKRGYNLILTGAAFMDSEFAFKKYWSEEAREGRDYVHKNFNCEDLLMNFLYANASSSRTVEYVHPAWAIDTSKLSSVAISRNTQKHYDIRTNCLAKFSSIYGPLPQKWEFGMREDRWDT

SEQ ID NO: 13848 - protein, 136 aa, Arabidopsis thaliana
  misc_feature: Useful for making plants with altered alkaloid content
MAFCNKLSGILRQGVSHSSNGPVTSMLGSLRYMSSKLFVGGLSWGTDDSSLKQAFTSFGEVTEATVIADRETGRSRGFGFVSFSCEDSANNAIKEMDGKELNGRQIRVNLATERSSAPRSSFGGGGGYGGGGGGGY

SEQ ID NO: 13849 - protein, 487 aa, Panicum virgatum
  misc_feature: Useful for making plants with altered carbohydrate content
MTSGLRAHAGTIHKAATQHSGPLPAPAPDDRQPPARPAMESAACPARAAASVDLRWLLSVAAGGLFALLLLLAASPFQLPSSSRLFLSPASSSTQQRPPPPLYVESTLSRAAPPAASLPPRFAYLISGSAGDAGMMRRCLLALYHPRNRYILHLDAEAPDADRAGLAAFVAAHPVLSAAGNVRVIEKANLVTYRGPTMVTTTLHAAAAFLWGEGHGRGADWDWFINLSASDYPLVTQDDLMHVFSKLPRDLNFIDHTSNISWKAFARAMPVIIDPALYMKTKGDLFWVPEKRSLPTAFKLFTGSAWMVLSRAFVEYLIWGWDNLPRTVLMYYANFISSPEGYFHTVACNAAAFRNTTVNSDLHFISWDNPPMQHPHHLTLADWDRMLASGAPFARKFPRDDPVLDRIDADVLGRRPGAAGTVAPGGWCAAGGGEGDGSGAGGDPCAAVGDAAALRPGPGAERLQRLVTSLLSSENFRPRQCVVEEEN

SEQ ID NO: 13850 - protein, 570 aa, Panicum virgatum
  misc_feature: Useful for making plants with altered carbohydrate content
MRRPRHCGGLRPLLLLLPFAALLSVATFSLHSPDRLLVTVTARRPSSSPRHLHRLAVSSLEARALGLGGAPPLHADAARAFRSGGRLLRDVLSSPAPPPSAAAGATRRCPPSVVVSGARLRGTGGGGGGGVLSLPCGLALGSHVTVVGSPRRRGDVAQFAVELRGEGDGDAAPRILHFNPRLRGDWSGRPVIEQNTRFRGQWGPALRCEGRRSRPDEETVDGLVKCEEWSGNIGDTSKELKRLWLQNHITGQKSRNWIDWPYPFIEDELFVLTLSTGLDGYHFHVDGKHVTSFPYRFGFVLEDATILSVIGDIDVQSIVAGSLPTAHPSIVQRNLELLTELKAPPLSEENVELFIGILSAGNHFTERMAARRSWMSSVRNSSSTVARFFVAVNGRREVNEDLLKEADFFGDIVIVPFVDSYDLVVLKTIAICDYAACVVPAKYVMKCDDDTFVRLDSVMAEVKKISDGRSFYLGNMNYFHRPLREGKWAVSYEEWPIEEYPPYADGAGYIVSSDIANFVASEMEKGRLNVSSVSTYYLHFMTHFASNSRRDCAAGANRIGPTPALSNHLL

SEQ ID NO: 13851 - protein, 400 aa, Panicum virgatum
  misc_feature: Useful for making plants with altered carbohydrate content
MSWRRGGGGGGLSRRWAFLLCVGSFCLGLLFTNRMWTLPEASEIARPNANVEESNMPVAAECGSKKIQEKQDYRDVLQVQDAHHDVQSLDKTIASLETELSAARSLQESLLNGSPVAEEFKVSESIGRRKYLMVIGINTAFSSRKRRDSIRYTWMPQGEKRKNLEEEKGIIIRFVIGHSAISGGIVDRAIEAEDRKHGDFMRIDHVEGYLALSGKTKAYFATAVSLWDADFYVKVDDDVHVNIATLGQILSRLALKPRVYIGCMKSGPVLSEKGVRYYEPEHWKFGESGNKYFRHATGQLYAISKDLATYISINKHILHKYINEDVSLGSWFIGLDVEHIDDKRLCCGTPPDCEWKAQTGNICAASFDWRCSGICNSEGRIWEVHNKCAEGEKVLWNSTF

SEQ ID NO: 13852 - protein, 329 aa, Arabidopsis thaliana
  misc_feature: Useful for making plants with altered cell wall content and/or composition
MVVVNKTNLLLLLLSLCLTLDLSSAQLRRNFYAGSCPNVEQIVRNAVQKKVQQTFTTIPATLRLYFHDCFVNGCDASVMIASTNNNKAEKDHEENLSLAGDGFDTVIKAKEALDAVPNCRNKVSCADILTMATRDVVNLAGGPQYDVELGRLDGLSSTAASVGGKLPHPTDDVNKLTSLFAKNGLSLNDMIALSGAHTLGFAHCTKVFNRIYTFNKTTKVDPTVNKDYVTELKASCPRNIDPRVAINMDPTTPRQFDNVYYKNLQQGKGLFTSDQVLFTDRRSKPTVDLWANNGQLFNQAFINSMIKLGRVGVKTGSNGNIRRDCGAFN

SEQ ID NO: 13853 - protein, 324 aa, Panicum virgatum
  misc_feature: Useful for making plants with altered carbohydrate content
MGGSAAAAALLLVVAASAAACAAQLRRNYYAGVCPEAESIVRDAVARKYRETFITVGATLHLFFHDCFVEGCDASVVVASTPNNTAEKDHPVNLGLAGDGFDTVLRARAAVDAVPRCRGRVSCADVLAMAARDAIALAGGPSYAVELGRLDGLRSAASSVDGKLAPPSFDLDQLTALFASNGLSRTDMVALSAGHTVGFAHCGTFAGRIRGPAAPDPALNRSLAARLRAWCPAGVDPRVAVTMDVVTPRVFDNQYFRNLRDGMGLLASDQVLYTDPRSRPTVEAWAQSSEAFSRAFVTAITKMGRIGVKTGAQGNIRRNCAVLD

SEQ ID NO: 13854 - protein, 329 aa, Arabidopsis thaliana
  misc_feature: Useful for making plants with altered cell wall content and/or composition
MARFDIVLLIGLCLIISVFPDTTTAQLSRGFYSKTCPNVEQIVRNAVQKKIKKTFVAVPATLRLFFHDCFVNGCDASVMIQSTPKNKAEKDHPDNISLAGDGFDVVIQAKKALDSNPSCRNKVSCADILTLATRDVVVAAGGPSYEVELGRFDGLVSTASSVEGNLPGPSDNVDKLNALFTKNKLTQEDMIALSAAHTLGFAHCGKVFKRIHKFNGINSVDPTLNKAYAIELQKACPKNVDPRIAINMDPVTPKTFDNTYFKNLQQGKGLFTSDQVLFTDGRSRPTVNAWASNSTAFNRAFVIAMTKLGRVGVKNSSNGNIRRDCGAFN

SEQ ID NO: 13855 - protein, 693 aa, Panicum virgatum
  misc_feature: Useful for making plants with altered carbohydrate content
MAPWSGLWGGKAGGDAYRGTPVVVKMENPNWSISEISSPEDDDEDILAAAGRRKGGRSKNAKQIRWVLLLKAHRAAGCLASLASAAVALGGAARRRVAAGRTDAEAGVVTATGESPVVRSRFYAFIKAVLVVSLLLLAVEVAAYLNGWDLADSALALPVIGLESLYASWLRFRAAYVAPGIQFLTDACVVLFLIQSADRFIQCLGCFYIHLKRIKPKPKSPALPDAENPDAGYYPMVLVQIPMCNEKEVYQQSIAAVCSLDWPKSNFLVQVLDDSDDPLTQTLIREEVAKWQQQGARIVYRHRVLRDGYKAGNLKSAMSCSYVKDYEFVAIFDADFQPNPDFLKRTVPHFKDNDELGLVQARWSFVNRDENLLTRLQYINLCFHFEVEQQVNGVFLNFFGFNGTAGVWRIKALEDSGGWMERTTVEDMDIAVRAHLHGWKFIFLNDVECQCELPESYEAYRKQQHRWHSGPMQLFRLCLPDIIKCKIAVWKKANLIFLFFLLRKLILPFYSFTLFCIILPMTMFVPEAELPDWVVCYIPALMSLLNILPSPKSFPFIIPYLLFENTMSVTKFNAMISGLFQLGSAYEWVVTKKSGRSSEGDLISLAPPKELKHQKTGSAPNLDTVAKEQLASKKDAKKKHNRIYKKELALSMLLLTAAARSLLSKQGIHFYFLLFQGISFLLVGLDLIGEQVE

SEQ ID NO: 13856 - protein, 560 aa, Arabidopsis thaliana
  misc_feature: Useful for making plants with altered cell wall content and/or composition
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 13857 - protein, 347 aa, Panicum virgatum
  misc_feature: Useful for making plants with altered carbohydrate content
MLNARTLKEWIISSLGPQAVSKHMIAVSTNLKLVKEFGIDPNNAFAFWDWVGGRYSVCSAVGVLPLSLQYGFPIVQKFLEGASSIDNHFHSSSFEKNIPVLLGLLNVWNVSFLGYPARAILPYSQALEKLAPHIQQLSMESNGKGVSIDGVPLPLETGEIDFGKPGTNGQHSFYQLIHQGRVIPCDFIGVVKSQQPVYLKGETVSNHDELMSNFFAQPDALAYGKTPEQLHSEKVPEHLIPHKTFKGNRPSLSLLLPTLSAYEIGQLLSIYEHRIAVQGFVWGINSFDQWGVELGKSLASQVRKQLHGSRMEGKPVEGFNHSTSSLLARYLAVQPPTPYDSTVLPKV

SEQ ID NO: 13858 - protein, 261 aa, Zea mays
  misc_feature: Useful for making plants with modulated biomass
MASPSSTSNNSAFSPVAASAGTTMPGAGAPCAACKFLRRKCLPGCVFAPYFPPEEPQKFANVHKVFGASNVTKLLNELLPHQREDAVSSLAYEAEARVKDPVYGCVGAISVLQRQVHRLQKELDAAHAELLRYACGDVAAGIPTALPVVSAAPRLSTAPMTTTSPGQFAAGMYGSGRRLGVVDGLAAPPLPPSGGGGGCYFMRNHHNNVVISSSPGADVAPVLPYASVANWAVNAISASTTTTSGSESIGLDHKEGGDSSM

SEQ ID NO: 13859 - protein, 654 aa, Arabidopsis thaliana
  misc_feature: Useful for making plants with altered cell wall content and/or composition
MDYLSQEEDLQFFDANEEMMALNPSGFGFDVWNDSPGSVVERRRKFLEWMGVEEEGRVETKDSVSGSSVESCFDGGEENSVEAEERSGECSSSSSEVSLSGSSVEVSEELSLRVDRNVGGCDVTRRQSSSMASCSSSRYCQVKETEKQRNIAGLVTSFKKGWLSRLRSMGCTADTNIESGGRMRASSGYGDVISRVKVKHCKKQAKELSALYQSQDIKAHDGAILAMKFSNDGKFLASSGEDGIVRVWKVVEDKKSRLRRDCLNEIDPSCMYFEVNDLSQLKPVLVNEEKPKKTTESFRKTSDSACVVFPPKVFRIMEKPLYEFRGHTGEVLDISWSKDNYLLSASMDKTVRLWKVGSNDCLGVFAHNSYVTSVQFNPVNENYFMSGSIDGKVRIWNISGCSVVDWADLKDIISAVCYRPDGQGGIIGSLNGSCRFFNMSGEFLELDSQIHLHNKKKSSNKRITGFQFLPQEPTKVLVVSADSKVRILQGNNVVRKYKGVCKTRSLTSASLTSDGKHIVSACEDSNVYIWSNDEESETKKIRSFERFSANASVAATWCGFSDHNTTLPFSSPSCLSHNEGFVPGSISKGSATWPEENLPANPLSTSAMNASHYKFLKSSYQRASSSLSWGMVIVTGGWDGQIRTFQNYGLPVTT

SEQ ID NO: 13860 - protein, 228 aa, Oryza sativa subsp. japonica
  misc_feature: Useful for making plants with modulated water use efficiency
MDAASFSDYSSGTPSPVGGVSGGVDGDDGGSSSSYMTVSSAPPKRRAGRTKFKETRHPVYKGVRRRNPGRWVCEVREPHGKQRIWLGTFETAEMAARAHDVAALALRGRAACLNFADSPRLLRVPPMGSGHDEIRRAAAVAADQFRPAPDRQGNVATAEEAADTTPLDATTQSVVDDPYCIIDDRLDFGMQGYLDMAQGMLIDPPPMAGSSTSGGDDDDDGEVKLWSY

SEQ ID NO: 13861 - protein, 275 aa, Arabidopsis thaliana
  misc_feature: Useful for making plants with modulated water use efficiency
MATTTAAAAGIFGIRIQDPRPGTGRVQARFGFSFGKKKPAPPPKKSRQVQDDGDRLVWFPGANPPEWLDGSMIGDRGFDPFGLGKPAEYLQYDFDGLDQNLAKNVAGDIIGIIQESSEIKPTPFQPYTEVFGIQRFRECELIHGRWAMLGTLGAIAVEALTGIAWQDAGKVELVEGSSYLGQPLPFSLTTLIWIEVLVVGYIEFQRNSELDPEKRIYPGGYFDPLGLAADPEKLDTLKLAEIKHSRLAMVAFLIFALQAAFTGKGPVSFLATFNN

SEQ ID NO: 13862 - protein, 260 aa, Arabidopsis thaliana
  misc_feature: Useful for making plants with altered cell wall content and/or composition
MEGGSITPGEDKPEIQSPIPPNQIFILSGQSNMAGRGGVFKDHHNNRWVWDKILPPECAPNSSILRLSADLRWEEAHEPLHVDIDTGKVCGVGPGMAFANAVKNRLETDSAVIGLVPCASGGTAIKEWERGSHLYERMVKRTEESRKCGGEIKAVLWYQGESDVLDIHDAESYGNNMDRLIKNLRHDLNLPSLPIIQVAIASGGGYIDKVREAQLGLKLSNVVCVDAKGLPLKSDNLHLTTEAQVQLGLSLAQAYLSNFC

SEQ ID NO: 13863 - protein, 70 aa, Arabidopsis thaliana
  misc_feature: Useful for making plants with altered cell wall content and/or composition
MVLNWGPVLMSVFLFIVLTPGVLFQLPGKTKVVEFGGFQTSGAAIVIHTLIFFACITVSIIALHIHIYVA

SEQ ID NO: 13864 - protein, 415 aa, Arabidopsis thaliana
  misc_feature: Useful for making plants with altered cell wall content and/or composition
MKLSSCVLIFLLCNTFSSISAFRLSRSQPTERISGSAGDVLEDDPVGRLKVFVYELPSKYNKKILQKDPRCLNHMFAAEIYMQRFLLSSPVRTLNPEEADWFYVPVYTTCDLTPNGLPLPFKSPRMMRSAIQLIASNWPYWNRTEGADHFFVVPHDFGACFHYQEEKAIGRGILPLLQRATLVQTFGQRNHVCLKEGSITVPPYAPPQKMQSHLIPEKTPRSIFVYFRGLFYDVGNDPEGGYYARGARAAVWENFKDNPLFDISTEHPTTYYEDMQRAIFCLCPLGWAPWSPRLVEAVIFGCIPVIIADDIVLPFADAIPWEDIGVFVDEKDVPYLDTILTSIPPEVILRKQRLLANPSMKQAMLFPQPAQPGDAFHQVLNGLARKLPHERSVYLRPGEKLLNWTAGPVADLKPW

SEQ ID NO: 13865 - protein, 208 aa, Arabidopsis thaliana
  misc_feature: Useful for making plants with altered cell wall content and/or composition
MTKIFYYFFIIIFLQSPPHLQSQTITRNISIFILAGQSNMAGRGGVYNDTATNTTVWDGVIPPECRSNPSILRLTSKLEWKEAKEPLHVDIDINKTNGVGPGMPFANRVVNRFGQVGLVPCSIGGTKLSQWQKGEFLYEETVKRAKAAMASGGGGSYRAVLWYQGESDTVDMVDASVYKKRLVKFFSDLRNDLQHPNLPIIQVRCLNT

SEQ ID NO: 13866 - protein, 484 aa, Panicum virgatum
  misc_feature: Useful for making plants with altered carbohydrate content
MALPRRALLVAGMLAAALPLLLLRPAEAGTVGVNYGRVANNLPNPAAVVQLLKQQGITQVKLYDTDPTVLRALANTGIKVVVALPNEQLAAAASRASYALLWVRRNVAAYYPATQIQGIAVGNEVFATAKNVTAQLVPAMVNVHAALARLNLDKAVKVSSPIALTALATSYPSSAGAFREDLAQPVMKPLLDFLAQTGSYLMVNAYPFFAYSGNAGDISLDYALFRPNDGVQDPGNGLKYYNLLDAQLDAVFAAVSRLGNYNGVRVVVSETGWPSKGDASEVGASAANAAAYNGNLARRVLSGNAGTPRRPDADIDVYLFALFNENQKPGPTSERNYGVFYPNQQKVYDVEFVLGGGGGAAGGGSQGSGGLGWQKNGGPASGNPPSGVKVTTGEAWCVANAMVGEQRLQAALNYACGEGGADCKAIQPGAACFEPNTMVAHASYAFNDYYQRKGRSIGTCDFAGAAHVVNQSPKMGKCDLPSTV

SEQ ID NO: 13867 - protein, 759 aa, Arabidopsis thaliana
  misc_feature: Useful for making plants with altered cell wall content and/or composition
MRGLLRASSLLLCGVILIQLLAAQIHAQSKKPKSPWPTLTGDPPLVIARGGFSGLFPDSSYDAYNFAILTSVPDAVLWCDVQLTKDALGICFPDLTMRNSSSIEAVYPTRQKSYPVNGVPTSGWFTIDFSLKDLKDVNLIRGILSRSEKFDGNSNPIMTVQSVSTQMKPSFFWLNVQHDAFYAQHNLSMSSFLVAASKTVLIDFISSPEVNFFKKIAGRFGRNGPSLVFRFLGQDEFEPTTNRTYGSILSNLTFVKTFASGILVPKSYILPLDDQQYLLPHTSLVQDAHKAGLEVFVSGFANDIDIAHDYSFDPVSEYLSFVDNGNFSVDGVLSDFPITASASLDCFSHVGRNATKQVDFLVITKDGASGDYPGCTDLAYKKAIKDGADVIDCSVQLSSDGTPFCLSSIDLGNSTTVSLTAFRNRSTTVPELGSLGAIYTFSLTWAEIQTLTPAISNPYRVTSLFRNPKQKNAGKLFSLSDFLSLAKNSTSLSGVLISVENAAYLREEQGLDVVKAVLDTLTQTGYSNSTATKVMIQSTNSSVLVDFKKQSQYETVYKVEENIRDILDSAIEDIKKFADAVVIQKLSVFPVAQSFITTQTNVVEKLQKSQLPVYVELFQNEFLSQPYDFFADATVEINSYITGAGINGTITEFPFTAARYKRNLCLGRKETIPYMAPAQPGALLTLVSPTAFPPAEAPNPVFTDADVTEPPLPPVTAKAPTSSPGTPSTNAQAPSGQTRITLSLLLSVFAMVLASLLLL

SEQ ID NO: 13868 - protein, 387 aa, Panicum virgatum
  misc_feature: Useful for making plants with altered carbohydrate content
MEAGYCNRKKTDICEGVCDTEYGSKSVLSMSRLKCTLRGFDLRALLILLIGIPIMIFVIYVHGQKVTYFLRPIWEKPPKPFTIHPHYYHENVSMDNLCKLHGWKVRESPRRVFDAVLFSNELDILDIRWHELSPYVDEFVLLESNSTFTGIKKELHFKENRQRFEFAESRLTYGMIGGRFVKGENPFVEESYQRVALDQLIKIAGITDDDLLIMSDVDEIPSGHTINLLRWCDDIPEILHLQLRNYLYSFQFLLDDKSWRASVHRYRAGKTRYAHFRQTDDLLADSGWHCSFCFRYINDFIFKMKAYSHVDRIRFKYFLNPKRIQHVICEGSDLFDMLPEEYTFQEIIAKLGPIPSTYSAVHLPAYLLEQTDRYRYLLPGNCMRESG

SEQ ID NO: 13869 - protein, 317 aa, Arabidopsis thaliana
  misc_feature: Useful for making plants with modulated water use efficiency
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 13870 - protein, 317 aa, Arabidopsis thaliana; identical to SEQ ID NO: 13869
  misc_feature: Useful for making plants with modulated light quality response

SEQ ID NO: 13871 - protein, 110 aa, Glycine max
  misc_feature: Useful for biocontainment applications
MSKRVRSPRLELRLNLSPPRAAATSIISSSELSPTESSMSSPVSVQSLESSCVSSEAEETRAMLLVGCPRCLMYVMLSEVDPKCPKCKSTVLLDFLNNEENNNTKKSSSE

SEQ ID NO: 13872 - protein, 720 aa, Panicum virgatum
  misc_feature: Useful for making plants with altered carbohydrate content
MATTALDFLPAPLRSLRLKTKQQELLLRVSALALIYVLAFAVRLFSVLRYESMIHEFDPYFNYRTTLFLSENGFSEFWNWFDFESWYPLGRVVGGTLFPGLMVTAALLHRLLRALSLAVHIREVCVLTAPFFAANTTLVAYAFGREIWDSGAGLVAAALIAIVPGYISRSVAGSYDNEGVAIFALLLTFYLFVRAVNTGSLAWALASAFGYFYMVSAWGGYVFIINLVPLYVLVLLVTGRYSQRLYVAYNCMYVLGMLLAMQIRFVGFQHVQSGEHMAAMGVFFLLQVFFFLDWVKYLLNDARLFKSFLRITLTCVITVGTLALGIGTASGYISPWTGRFYSLLDPTYAKDHIPIIASVSEHQPTAWSSFMFDFHILLFLFPAGLYFCFKRLSDATIFIVMYGLTSMYFAGVMVRLILVAAPAVCLISAIAASATIKNLTTLIRTKSKSPQATSGKTTGSKAAAKGAVDQSLPFQHNAAIVLLLGAFYLLSRYAIHCTWVTSEAYSSPSIVLAARGHNGGRVIFDDYREAYYWLRQNTPPDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRVDKGAAPKMLNCLMYKLCYYRFGELTTEYGKPPGYDRVRGVEIGNKDIKLEYLEEAFTTSNWIVRIYKVKPPKNRS

SEQ ID NO: 13873 - protein, 627 aa, Arabidopsis thaliana
  misc_feature: Useful for making plants with altered cell wall content and/or composition
MRKFGGSLFGVSLLLSVLLAAATAAAEYYNYGSALDKTFLFFEAQRSGKLPAAQRVKWRGPSGLKDGLAQGVSLEGGYYDAGDHVKFGLPMAFAVTMLSWAAVDNRKELSSSNQMQQTLWSIRWGTDYFIKAHPQPNVLWGQVGDGESDHYCWERPEDMTTSRTAYKLDPYHPGSDLAGETAAALAAASLAFKPFNSSYSALLLSHAKELFSFADKYRGLYTNSIPNAKAFYMSSGYSDELLWAAAWLHRATGDQYYLKYAMDNSGYMGGTGWGVKEFSWDNKYAGVQILLSKILLEGKGGIYTSTLKQYQTKADYFACACLKKNGGYNIQTTPGGLMYVREWNNLQYASAAAYLLAVYSDYLSAANAKLNCPDGLVQPQGLLDFARSQADYILGKNRQGMSYVVGYGPKYPIRVHHRGSSIPSIFAQRSSVSCVQGFDSWYRRSQGDPNVIYGALVGGPDENDNYSDDRSNYEQSEPTLSGTAPLVGLFAKLYGGSLGSYGGGSYKPYETTKPAASSYKATPTTYSPKQSGAQIEFLHSITSNWIAGNTRYYRHKVIIKNNSQKPISDLKLKIEDLSGPIWGLNPTGQKYTYQLPQWQKTLRAGQAYDFVYVQGGPQAKVSVLSYN

SEQ ID NO: 13874 - protein, 554 aa, Panicum virgatum
  misc_feature: Useful for making plants with altered carbohydrate content
MRITGSGAATATAAAAEAAGLWLRPGRLGEVLAVALFFASAALSLAGAESPPPAAGPASASARHDYEDALRKSLLYFEAQRSGRLPHGQRVAWRDHSGLTDGLEQGVDLVGGYYDAGDHVKFGLPMAFTVTMLSWSLLEYGADVADAGELAHALESIKWGTDYFIKAHTQPDELWAEVGDGDTDHYCWQRPEDMTTSRQAYKVDRERPGSDVAGETAAAMAAASMVFREHNPHYASLLLHHALQLFEFADKYRGKYDSSIAEVKSYYASVSGYHDELLWAALWLHRATGRAEFLDYAVDNAHAFGGTGWAITEFSWDVKYAGVQILAARLLLSGEHAPRHRETLERYRAKAEHYVCACLGRNAAGGADANVERSPGGMLYVRQWNNMQYVTSAAFLLSAYSGYLSSAGEAVACAGGGAASAGEVFAMARSQVDYVLGSNPRGMSYLVGYGARFPARVHHRAASIVPYKHSKEFIGCAQGFDDWFVRRGANPNVVVGAIVGGPDRRDRFRDHRENYMQTEACTYNTAPMVGMFAMLNRLARDEAVAAAADPSVNR

SEQ ID NO: 13875 - protein, 525 aa, Arabidopsis thaliana
  misc_feature: Useful for making plants with altered cell wall content and/or composition
  misc_feature: Useful for making plants with altered lignin content
MTVMNHRHKQCHFLLLLLITVFSAALDGVSSETDVGGFDYGEALSKSLLYFEAQRSGRLPYNQRVTWRDHSGLTDGLEQGVDLVGGYHDAGDHVKFGLPMAFTVTMLSWSVIEYGDSLASTGELSHALEAIKWGTDYFIKAHTSPNVLWAEVGDGDTDHYCWQRPEDMTTSRRAFKIDENNPGSDIAGETAAAMAAASIVFRSTNPHYSHLLLHHAQQLFEFGDKYRGKYDESLKVVKSYYASVSGYMDELLWGATWLYRATDNEHYMSYVVDMAHQLGGLSWAMSEFSWDVKFAGVQLLASMLLKEEKHKQHSKVLQQYKSKADHYLCSILNKNINGTNVQRTPAGLLYVRQWNNMQYVSTASFLLTVYSDHLRKSNTDLECHEGTVTPDEMLGFAKSQIDYILGSNPMETSYLVGYGPKYPIRVHHRGASIASFKEHKGFIGCTQGYDNWYGRSEPNPSVLVGALVGGPDHQDDFDDRRGNYVQTEACTYNTAPLVGVFARLIELEEQKLEEEDVSLVATYKR

SEQ ID NO: 13876 - protein, 477 aa, Arabidopsis thaliana
  misc_feature: Useful for making plants with altered cell wall content and/or composition
MVPKIASMASTRPLCSIPSIFLSFSLLFVVSLLFFFSNSLISNPNPSISHNTLQNGINVYVAELPRSLNYGLIDKYWSSSTPDSRIPSDPDHPTRKTHSPDKYPPYPENPLIKQYSAEYWIMGDLETSPEKRIGSFAKRVFSESDADVVFVPFFATLSAEMELGNGKGSFRKKSGNEDYQRQRQVLDFVKNTKAWKRSNGRDHVFVLTDPVAMWHVREEIALSILLVVDFGGWFRQDSKSSNGTSLPERIQHTQVSVIKDVIVPYTHLLPRLDLSQNQRRHSLLYFKGAKHRHRGGLIREKLWDLLVNEPGVVMEEGFPNATGREQSIRGMRNSEFCLHPAGDTPTSCRLFDAIQSLCIPVIVSDTIELPFEGIIDYSEFSVFASVSDALTPKWLANHLGRFSEREKETLRSRIAKVQSVFVYDNGHADGIGPIEPNGAVNHIWKKVQQKVPMVKEAVIRERRKPAGASVPLRCQCI

SEQ ID NO: 13877 - protein, 357 aa, Pinus sylvestris
  misc_feature: Useful for making plants with modulated water use efficiency
MSSVLTDLLNLDLSDVTEKVIAEYIWIGGSGMDMRSKARSLSGPVSSVKELPKWNYDGSSTGQAQGHDSEVILYPQAIFRDPFRRGKHILVICDAYSPNGTAIPSNKRAAAAKIFNEKAVSDEETWYGLEQEYTLLQKDVKWPLGWPIGGYPGPQGPYYCGVGADKAWGRDIVDAHYKACLYSGINISGINGEVMPGQWEFQVGPSVGISAADELWCARFIMERITEKAGVVLSFDPKPIEGDWNGAGCHTNYSTKSMRKEGGFEVIKKAIEKLKLRHKEHISAYGEGNERRLTGRHETADMNTFSWGVANRGASVRVGRDTEKEGKGYFEDRRPASNMDPYIVTSMIAETTILWKP

SEQ ID NO: 13878 - protein, 331 aa, Panicum virgatum
  misc_feature: Useful for making plants with altered carbohydrate content
MRSRAPSLRRSVVAAAVVALTAAWCAAAQLSQSYYASTCPNVDTLVRGAVTQKLQETFNAAPGTLRLFFHDCFVRGCDASVLLSGPDDEHSAGADTTLSPDALDLITRAKAAVDADPRCANKVSCADILALAARDVVSQTGGPYYPVELGRLDGKVGTRAVVKHSLPGAGFDLDQLNKLFAANGLTQTDMIALSGGHTIGVTHCDKFVRRLYPFKGGAGAGGGPPMNLYFLRQMRQTCPLNYSPSAFAMLDAVSPRKFDNGYYQTLQQMKGLLASDQALFADRRSRATVNYFAANQTAFFDAFVAAMAKLGRVGVKTGSDGEIRRVCTKVN

SEQ ID NO: 13879 - protein, 322 aa, Arabidopsis thaliana
  misc_feature: Useful for making plants with altered cell wall content and/or composition
KNQSSFSIVALLLIFFSSSVFAQLQTNFYRKSCPNVETIVRNAVRQKFQQTFVTAPATLRLFFHDCFVRGCDASILLASPSEKDHPDDKSLAGDGFDTVAKAKQALDRDPNCRNKVSCADILALATRDVVVLTGGPNYPVELGRRDGRLSTVASVQHSLPQPSFKLDQLNTMFARHGLSQTDMIALSGAHTIGFAHCGKFSKRIYNFSPKRPIDPTLNIRYALQLRQMCPIRVDLRIAINMDPTSPNTFDNAYFKNLQKGMGLFTSDQVLFSDERSRSTVNSFASSEATFRQAFISAITKLGRVGVKTGNAGEIRRDCSRVN

SEQ ID NO: 13880 - protein, 533 aa, Panicum virgatum
  misc_feature: Useful for making plants with altered carbohydrate content
MYYNGMYHFFYQYNPHGALWDMGNLSWGHSVSGDLVNWAALDTALDPTAPFDINGCWSGSSTILPGGTPAILYTGIDANNEQVQNVAFPKNPADPLLREWVKPSYNPVIALPADVPGDKFRDPSTAWLGRDGLWRIAVSAEVSGVASTLVYRSADFRRWEQNAAPLHSSRAAGMVECPDLFPVKQHGKDGLDTSANGPGVSHVLKLSVMDTLQDYYMVGRYDDAADTFAPAEPERGDDVRNWRRFDYGHVYASKSFFDARKNRRVLWSWANESDSQADDVARGWSGVQTVPRKVWLDKDGKQLRQWPIEEIETLRRKRVGLRRDSDTVLNAGAMNEIVGVAGSQADVEVAFKIPRLEAAESLDPNWLLDPQKLCGEKGASVPSGVGPFGLIVMASGDLPEHTAVFFRVFRHHGDYKLLMCTDLTKSSTRAGVYKPPYGGFVDIDIKEHKTIKLRTLIDHSVVESYGAEGRACITARVYPEHAQTSNSHMFVFNNGTGTVKVTKLEAWELATATVNVGDEGFIVSESKDETESY

SEQ ID NO: 13881 - protein, 358 aa, Arabidopsis thaliana
  misc_feature: Useful for making plants with modulated light quality sensitivity
MEGSSSTIARKTWELENSILTVDSPDSTSDNIFYYDDTSQTRFQQEKPWENDPHYFKRVKISALALLKMVVHARSGGTIEIMGLMQGKTDGDTIIVMDAFALPVEGTETRVNAQDDAYEYMVEYSQTNKLAGRLENVVGWYHSHPGYGCWLSGIDVSTQRLNQQHQEPFLAVVIDPTRTVSAGKVEIGAFRTYSKGYKPPDEPVSEYQTIPLNKIEDFGVHCKQYYSLDVTYFKSSLDSHLLDLLWNKYWVNTLSSSPLLGNGDYVAGQISDLAEKLEQAESHLVQSRFGGVVPSSLHKKKEDESQLTKITRDSAKITVEQVHGLMSQVIKDELFNSMRQSNNKSPTDSSDPDPMITY

SEQ ID NO: 13882 - protein, 273 aa, Arabidopsis thaliana
  misc_feature: Useful for making plants with modulated biomass
  misc_feature: Useful for making plants with modulated low light sensitivity
MADQQRGHNTSDSRRKSLAGKRTSQQTPTSSLSSGGVSMAAATTGTGTASPCGACKFLRRKCVSGCIFAPHFGSDQGAARFAAVHKVFGASNVSKLLHHIPVNRRHDAVVTISYEAQARLSDPVYGCVSTILALQQQVASLQAELSVVQSQLINSRVAMANVMQQQTHHQQQQQQLVVMQQPEYSNNSSASTTLAGAAMNSFTMTADAAAVSYDVMAPTNLEHSLQPMPPHQQRRGDYQHEDEEESGADFSVAVGSTAVASKVIFPAEDFHRR

SEQ ID NO: 13883 - protein, 450 aa, Arabidopsis thaliana
  misc_feature: Useful for biocontainment applications
MCPCVERRAPPGVYYTPPPARTSDHVAAMPMTERRRPPYSCSSSSERRDPFHIVHKVPSGDSPYVRAKHAQLIDKDPNRAISLFWTAINAGDRVDSALKDMAVVMKQLGRSDEGIEAIKSFRYLCSFESQDSIDNLLLELYKKSGRIEEEAVLLEHKLQTLEQGMGFGGRVSRAKRVQGKHVIMTIEQEKARILGNLGWVHLQLHNYGIAEQHYRFGFVTKIPNIDYCLVMRALGLERDKNKLCNLAICLMRMSRIPEAKSLLDDVRDSPAESECGDEPFAKSYDRAVEMLAEIESKKPEADLSEKFYAGCSFVNRMKENIAPGTANKNYSDVSSSPASVRPNSAGLYTQPRRCRLFEEETRGAARKLLFGKPQPFGSEQMKILERGEEEPMKRKKLDQNMIQYLHEFVKDTADGPKSESKKSWADIAEEEEAEEEEEERLQGELKTAEM

SEQ ID NO: 13884 - protein, 882 aa, Panicum virgatum
  misc_feature: Useful for making plants with altered carbohydrate content
MVSRSYSNLLELASGGGGGGEPLPSLGRRRVPRVVTAPGIVPGLDASDDDDDASDRSSHAPRERVIIVANQLPVRAAHRAGGAGWDFAWDEDSLLLQVKDSLRAHHGRGDVEFVYVGGLRDDVPPAEHDQVAHELLEGFRCVPTFLPADLRSRFYHGFCKQQLWPLFHYMLPLSPELGGRFDRLLWQAYVSVNKIFADKILEVISPDEDFVWVHDYHLMVLPTFLRKRFNRVKLGFFLHSPFPSSEIYKTLPVREELLRSLLNADLIGFHTFDYARHFLSCCSRMLGLKYESQRGYIALEYYGRTVTIKILPVGVHLEQLQSVLNLPETGVKVAELLKQFNHRSRLLLLGVDDMDIFKGISLKLLAFEQLLMQHPKWRGRVVLVQIANPARGKGKDVKEVQEESDAMVKRINDAFGQPDYQPVILIDKPLRFYERMAYYVVAECCLVTAVRDGMNLIPYEYIIARQGNEMIDRILGLGPSSRKKSMLVVSEFIGCSPSLSGAIRVNPWNIDSVADAMDSALEMPEGEKVLRHEKHHRYVSTHDVSYWANSFLQDLERTCLDHNRRRCWGIGFGLKFRVVALDPNFKKLAVEHLVSAYRRTTKRIILLDYDGTLMPQTSFGKSPTSRTIDMLNSLCRDKNNMVFLVSTKSRTTLSEWFSPCENLGLAAEHGYFLRLRRDAEWEECVTVIDCSWKQIAEPVMKTYTETTDGSTIEDKETAIVWSYEDADPDFGSCQAKELHDHLESVLSNEPVSVKAGLNHVEVKPQGVSKGLVAKRILSTMQERGDLPDFILCVGDDRSDEDMFEVITTAAARGPSSLHPEAEVFACTVGRKPSKAKYYLDDPADIVRLIQGLANVSNDQASHGGSGATLPDDAAAAAATVLR

SEQ ID NO: 13885 - protein, 314 aa, Arabidopsis thaliana
  misc_feature: Useful for making plants with modulated biomass
MMEIRTPKTGKAKRVLESRAPKLVETGKKTLILHGTKTSATLSSVMTELYRLKKGGAIRYSRRNENIRPFESGGETSLEFFSQKTDCSIFVYGSHTKKRPDNLVLGRMYDHQVYDLIEVGIENFKSLRAFSYYKKFAPHEGTKPFICFIGEGFENVSELKHLKEVLTDLFRGEVVDNLNLTGLDRAYVCSAISPTKVFLTHCALKLKKSGSIVPRMELVEVSPSMDLVIRRNRLPNDSLMKEAMRTSKDKPKKKEKNVDQDAVLGKTGKIYMPDQKLKEMKLFDKSKGSKRERKDAKLKHKEETVAKKMKVSSE

SEQ ID NO: 13886 - protein, 782 aa, Panicum virgatum
  misc_feature: Useful for making plants with altered carbohydrate content
MAEPEVSSAAAGGGGRLRNAFGGVLCAFTLLLIGVVAFSIRLFSVIKYESVIHEFDPYFNFRVTQFLSKNGIYEFWNWFDDRTWYPLGRVIGGTVYPGLTLTAGTIWWLVNSLNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGGYTFIINLIPMHVLLCIVTGRYSSRLYIAYAPLVILGTLLAALVPVVGFNAVMTSEHFASFLVFIILHVVALVYYIKGLLSPRLFKIAMTLVISVGLAVCFAVVAVLVALVASSPTKGWSGRSLSLLDPTYASKYIPIIASVSEHQPPTWPSYFMDINVLAFLIPAGIISCLLPLSDASSFMVLYLVTAVYFSGVMVRLMLVLAPAACILSGIALSEVFGVLTRSIKFQLSKLFDDSSAASGDSSSESSTNSAKSETRNEKSETAPKEKPSKKNRKKEKEVAESVPVKTKKEKRLLVLPFELSVMGILLLIVLGGFYVVHCVWAAAEAYSAPSIVLTSHSRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRVDAQATPTMLNCLIYKLCYYRFVETDGKGFDRVRGYEIGKKHFKLTHFEEVFTTHHWMVRIYKLKPQKNRVRGKLKKLKSNAKTSSTLAAGRKKNPWQ

SEQ ID NO: 13887 - protein, 255 aa, Arabidopsis thaliana
  misc_feature: Useful for making plants with modulated drought sensitivity
MTVGVLALQGSFNEHIAALRRLGVQGVEIRKADQLLTVSSLIIPGGESTTMAKLAEYHNLFPALREFVKMGKPVWGTCAGLIFLADRAVGQKEGGQELVGGLDCTVHRNFFGSQIQSFEADILVPQLTSQEGGPETYRGVFIRAPAVLDVGPDVEVLADYPVPSNKVLYSSSTVQIQEEDALPETKVIVAVKQGNLLATAFHPELTADTRWHSYFIKMTKEIEQGASSSSSKTIVSVGETSAGPEPAKPDLPIFQ

SEQ ID NO: 13888 - protein, 412 aa, Panicum virgatum
  misc_feature: Useful for making plants with altered carbohydrate content
MSASLPLPLAVAVMLAAAALLLCGGAEARVLLTLDDFGAVGDGIANDTQAFVDAWAAACASSEQAVLAVPVGKAYRIWPVQLFGPCKKKLKLLISGAIVAPASPDEWAGRDPMKWLYIYGVDGLSVSGGGTIDGSGQQWWASTCKRKKTPPCYSGPRPKTVHFEECRGVSVQGVTLQNGQQFHLTFTRCSDVRASFLRVIAPADSPNTDGVHLNDTSHVQITDNLISTGDDCVSMVGNCSDVRVTDISCGPGHGISIGSLGKNRTTDMVENVRVDTCLLTNTTNGVRIKTWQGGMGFARDLRFESIVMKNVSNPIIIDQYYCDQPTPCANQTRAVEVREVGFADIRGTSATAKAISIACSDAVPCRDLELKNVNLTLEGGGGGRATASCYRAYGKSAGAVVPPSCLAKPTAS

SEQ ID NO: 13889 - protein, 247 aa, Arabidopsis thaliana
  misc_feature: Useful for making plants with altered cell wall content and/or composition
MNFIIARSDSVRVSKVMVSSPGDSPNTDGIHITGSTNVILQDCKIGTGDDCVSIVNASSNIKMKNIYCGPGHGISIGSLGKDNTTGIVTQVVLDTALLRETTNGLRIKTYQGGSGYVQGIRFTNVEMQDVANPILIDQFYCDSPTTCQNQTSAVKISQIMYRNITGTTKSAKAIKFACSDTVPCSHIVLNNVNLEGNDGQVEAYCNSAEGFGYGVIHPSADCLYSHDDKGLDQTHKSEEAETGHDEL

SEQ ID NO: 13890 - protein, 450 aa, Panicum virgatum
  misc_feature: Useful for making plants with altered carbohydrate content
MVSSRRSSGIIIREGSRNWSEFNDPSPSPKLLYSQSYVAMRGLVASVISLDFFLLSSKLKSAWAGMTSQRHIRSQERSKSRGLNCKRVVVHLLLCFMVGIFIGFMPFFSVDVYKKIVSENERLPFHESVVETEMMDTKVKELETVVVEKEVELIDEPEVGESPPVPAMLDDEADFAESTRALPAIEDSDISVKKLLIIVTITSVRPQQAYYLNRLAHVLKAVQAPLLWLVVEWPEQSYETAEILRSSGVMYRHLICRKNTTSVRKIAVCQRNNAIYHVKKHHLDGIMHFADEERSYSADVFEEMQKIRRFGSWPVAIHVGTKYRAVLEGPICKGSRVTGWHTVQAVQKKSMTRRFPIGFSAFAFNSTMLWDPQRWNRPAMDSVIVHSGGRGGLQESRFIEKLVKNERQVEGLPDNCNRVMVWNFNLEPPQLNYPTGWALYKNLEADMPVI

SEQ ID NO: 13891 - protein, 244 aa, Panicum virgatum
  misc_feature: Useful for making plants with altered carbohydrate content
MAARSLLAAAFLALAVPAVLCQAPGPAAPKGPPNVTAILEKGGQYATFIRLMKATQQDTQLNSQLNNSFGSGYTVFAPTDNAFNSLKPGTLNKLSQQEQVSLVQYHILPQFYSLDSFETASNPVRTQASGSDGPYTLNITADSNNQVNVSTGLVATRVGTALRDTQPLAVYSVDKVLLPNDLFGVKPPTSTPPAPTKKPAKGGSVAEAPAGSADSAPSGAAPGGARVAGWSLAALVLGAAGGLL

SEQ ID NO: 13892 - protein, 247 aa, Arabidopsis thaliana
  misc_feature: Useful for making plants with altered cell wall content and/or composition
MATTPLLLLLLTAVFLSTEITAQRAAPAPGPAGPINITAILEKGGQFVTLIRLLNTTQIGNQINIQINSSSEGMTVLAPTDNAFQNLKPGTLNKLSPDDQVKLILYHVSPKFYTLEDLLSVSNPVRTQASGRDVGGVYGLNFTGQGNQVNVSTGVVETRLSTSLRQERPLAVYVVDMVLLPEEMFGERKISPMAPPPKSKSPDVSDDSESSKKAAAPSESEKSGSGEMNTGLGLGLGLVVLCLKFLL

SEQ ID NO: 13893 - protein, 403 aa, Arabidopsis thaliana
  misc_feature: Useful for making plants with modulated biomass
MASLGLSFPPAAKTPTYLASSSSTFFSNSSLSVRTSQFRSRNSVFACVKCDMPESLNVGNGNPSIPIINERTLPKFLESARMEKSVNRTNTRLKLFSGTANPALAQEIAWYMGLDLGKVNIKRFADGEIYVQLQESVRGCDVYLVQPTCTPTNENLMELLIMVDACRRASAKKVTAVIPYFGYARADRKTQGRESIAAKLVANLITEAGADRVLACDLHSGQSMGYFDIPVDHVYCQPVILDYLASKSIPSEDLVVVSPDVGGVARARAFAKKLSDAPLAIVDKRRSGHNVAEVMNLIGDVRGKVAIMVDDMIDTAGTIVKGAALLHQEGAREVYACCTHAVFSPPAIERLSGGLLQEVIVTNTLPVAEKNYFPQLTILSVANLLGETIWRVHDDSSVSSIFL

SEQ ID NO: 13894 - protein, 73 aa, Arabidopsis thaliana
  misc_feature: Useful for making plants with modulated salt sensitivity
MEVFRSFDRDGNGSITAAELAGSMAKMGHPLTYRELTEMMTEADSNGDGVISFNEFSHIMAKSAADFLGLTAS

SEQ ID NO: 13895 - protein, 121 aa, Arabidopsis thaliana
  misc_feature: Useful for making plants with modulated light quality sensitivity
EKIEVIDFSSYIDVSTDPGHYAIFWEISGETNEDVLQDCCNCLDRAFIDAGYVSSRKCKTIGALELRVVAKGTFRKIQEHFLGLGSSAGQFKMPRCVKPSNAKVLQILCENVVSSYFSTAF

SEQ ID NO: 13896 - protein, 524 aa, Panicum virgatum
  misc_feature: Useful for making plants with altered carbohydrate content
MRLGLKGLTFLLLLVLLVLCSSICLCDARSGKHWRRSRATSTSMLRKGKPKSSSSHKQNGKGIQNPYQPSPSTSPVSPSRSPVHGKGSQGPTMPTPGGGSGCTVPPPPLLQPPPPPSPPAEQDTVFNVVDFGAKGDGVTDDTQAFEAAWAAACKVEASTVLIPYELEFVVGPISFSGPYCKPNILFQLDGTILAQTSARVWGSGLLQWLEFTKLTGIAIQGSGVINGRGQEWWTYSDPNDDDDDDAFRVELDKMPQIKPTALRFYGSSNVTVTGITIVNSSQCHLKFDSCQGVMVHDLTISSPENSPNTDGIHLQNSREVNIHHTNMACGDDCVSIQTGCSDINIHNVNCGPGHGISIGGLGRYNTKACVSNVTVRDVNMFKTMNGVRIKTWQGGSGLVQGIRFSNIQVSEVQTPIIIDQFYCDKTTCRNQTSAVAVSGVQYENIRETFTIKPAHFACSDNSPCSDITLTGIQLKPVIVPQYHLYNPFCWQAFGVLYTPTVPPIACLQIGKPAGNSVLSDGDLC

SEQ ID NO: 13897 - protein, 380 aa, Arabidopsis thaliana
  misc_feature: Useful for making plants with altered cell wall content and/or composition
MLVPPEYTYLVGPISFSGPYCQANIVFQLDGTIIAPTDSKTWGKGLMWWIDFTKLKGIKVQGKGVIDGRGSGWWQQDSPFIDSDTKLIVPLNNSANQNPPMPIRSELDERMPSIKPTALRFSGSFGVEVTGITIQNSPQCHLKFDDCVGVVVHDIAVSSPGDSPNTDGIHLQNTKDVLIHSTTLACGDDCISIQTGCSNVFVHNVNCGPGHGISIGSLGKEGTKACVSNITVRDVAMHNTMTGVRIKTWQGGVGSVKGIIFSNIQLNQVQIPITINQFYCDHSKCKNQTSAVAVEGVTYERIKGTYTVKPVHFACSDNFPCVDVQLSSIELKPVQEKYRMYDAYCWQTFGELNTPTLPPIDCLKIGKPPRNKVQSDHDVC

SEQ ID NO: 13898 - protein, 439 aa, Arabidopsis thaliana
  misc_feature: Useful for making plants with modulated light quality response
MDSREIHHQQQQQQQQQQQQQQQQQHLQQQQQPPPGMLMSHHNSYNRNPNAAAAVLMGHNTSTSQAMHQRLPFGGSMSPHQPQQHQYHHPQPQQQIDQKTLESLGFDGSPSSVAATQQHSMRFGIDHQQVKKKRGRPRKYAADGGGGGGGGSNIALGLAPTSPLPSASNSYGGGNEGGGGGDSAGANANSSDPPAKRNRGRPPGSGKKQLDALGGTGGVGFTPHVIEVKTGEDIATKILAFTNQGPRAICILSATGAVTNVMLRQANNSNPTGTVKYEGRFEIISLSGSFLNSESNGTVTKTGNLSVSLAGHEGRIVGGCVDGMLVAGSQVQVIVGSFVPDGRKQKQSAGRAQNTPEPASAPANMLSFGGVGGPGSPRSQGQQHSSESSEENESNSPLHRRSNNNNSNNHGIFGNSTPQPLHQIPMQMYQNLWPGNSPQ

SEQ ID NO: 13899 - protein, 616 aa, Arabidopsis thaliana
  misc_feature: Useful for making plants with altered cell wall content and/or composition
MMVKLRNLVLFFMLLTVVAHILLYTDPAASFKTPFSKRDFLEDVTALTFNSDENRLNLLPRESPAVLRGGLVGAVYSDKNSRRLDQLSARVLSATDDDTHSHTDISIKQVTHDAASDSHINRENMHVQLTQQTSEKVDEQPEPNAFGAKKDTGNVLMPDAQVRHLKDQLIRAKVYLSLPSAKANAHFVRELRLRIKEVQRALADASKDSDLPKTAIEKLKAMEQTLAKGKQIQDDCSTVVKKLRAMLHSADEQLRVHKKQTMFLTQLTAKTIPKGLHCLPLRLTTDYYALNSSEQQFPNQEKLEDTQLYHYALFSDNVLATSVVVNSTITNAKHPLKHVFHIVTDRLNYAAMRMWFLDNPPGKATIQVQNVEEFTWLNSSYSPVLKQLSSRSMIDYYFRAHHTNSDTNLKFRNPKYLSILNHLRFYLPEIFPKLSKVLFLDDDIVVQKDLSGLWSVDLKGNVNGAVETCGESFHRFDRYLNFSNPLISKNFDPRACGWAYGMNVFDLDEWKRQNITEVYHRWQDLNQDRELWKLGTLPPGLITFWRRTYPLDRKWHILGLGYNPSVNQRDIERAAVIHYNGNLKPWLEIGIPRYRGFWSKHVDYEHVYLRECNINP

SEQ ID NO: 13900 - protein, 385 aa, Panicum virgatum
  misc_feature: Useful for making plants with altered carbohydrate content
MQDDCSIVVKKLRAMLHSAEEQLHAHKKQTVLLTQLAAKTLPKGLHCLPLRLANEYFSLDPDRQQFPNQNKLTNPKLYHYALFSDNILATAVVVNSTVLNAKHPSDHVFHIVTDRLNYAPMRMWFLSNPPGKATIEVQNTGEFTWLNDSYSPVLKQLGSQSMIDYYFGTNRANPDSNLKYRNSKYLSILNHLRFYLPEIYPKLDKMVFLDDDIVVKKDLTGLWSINMKGKVNGAVETCGESFHRFDRYLNFSNPGIAKNFDPHACGWAFGMNVFDLAEWKRQNITQIYHSWQKLNQDRSLWKFGTLPPGLITFWNKTFPLSRSWHVLGLGYNPHVNSRDIERAAVIHYNGNMKPWLEIGLPKFRSYWSKYLDYDQPFLRECNINP

SEQ ID NO: 13901 - protein, 264 aa, Panicum virgatum
  misc_feature: Useful for making plants with altered carbohydrate content
MDATPTMLGEKDALSNINSLRSFEVVDEIKEALEERCPGVVSCADIVVMAARDAVFLTGGPTWEVRLGREDSLTASQEDSDSIMPSPRANASALIRLFAGLNLSVTDLVALSGSHSIGEARCFSIVFRLYNQSGSGRPDPNMDAGYRRALNALCPRGGDEEVTGGMDATPRVFDNRYFKDLVALRGFLNSDQTLFSDNARTRRVVKRFSEDQDAFFRAFIEGMIKMGELQNPRKREIRRNCRVANGSPSPATPKEVATYRVMDF

SEQ ID NO: 13902 - protein, 329 aa, Arabidopsis thaliana
  misc_feature: Useful for making plants with altered cell wall content and/or composition
MSLLPHLILYLTLLTVVVTGETLRPRFYSETCPEAESIVRREMKKAMIKEARSVASVMRFQFHDCFVNGCDASLLLDDTPNMLGEKLSLSNIDSLRSFEVVDDIKEALEKACPATVSCADIVIMAARDAVALTGGPDWEVKLGRKDSLTASQQDSDDIMPSPRANATFLIDLFERFNLSVKDMVALSGSHSIGQGRCFSIMFRLYNQSGSGKPDPALEPSYRKKLDKLCPLGGDENVTGDLDATPQVFDNQYFKDLVSGRGFLNSDQTLYTNLVTREYVKMFSEDQDEFFRAFAEGMVKLGDLQSGRPGEIRFNCRVVNRRPIDVLLVS

SEQ ID NO: 13903 - protein, 729 aa, Arabidopsis thaliana
  misc_feature: Useful for making plants with altered cell wall content and/or composition
MVNKDDRIRPVHEADGEPLFETRRRTGRVIAYRFFSASVFVCICLIWFYRIGEIGDNRTVLDRLIWFVMFIVEIWFGLYWVVTQSSRWNPVWRFPFSDRLSRRYGSDLPRLDVFVCTADPVIEPPLLVVNTVLSVTALDYPPEKLAVYLSDDGGSELTFYALTEAAEFAKTWVPFCKKFNVEPTSPAAYLSSKANCLDSAAEEVAKLYREMAARIETAARLGRIPEEARVKYGDGFSQWDADATRRNHGTILQVLVDGREGNTIAIPTLVYLSREKRPQHHHNFKAGAMNALLRVSSKITCGKIILNLDCDMYANNSKSTRDALCILLDEKEGKEIAFVQFPQCFDNVTRNDLYGSMMRVGIDVEFLGLDGNGGPLYIGTGCFHRRDVICGRKYGEEEEEEESERIHENLEPEMIKALASCTYEENTQWGKEMGVKYGCPVEDVITGLTIQCRGWKSAYLNPEKQAFLGVAPTNLHQMLVQQRRWSEGDFQIMLSKYSPVWYGKGKISLGLILGYCCYCLWAPSSLPVLIYSVLTSLCLFKGIPLFPKVSSSWFIPFGYVTVAATAYSLAEFLWCGGTFRGWWNEQRMWLYRRTSSFLFGFMDTIKKLLGVSESAFVITAKVAEEEAAERYKEEVMEFGVESPMFLVLGTLGMLNLFCFAAAVARLVSGDGGDLKTMGMQFVITGVLVVINWPLYKGMLLRQDKGKMPMSVTVKSVVLALSACTCLAFL

SEQ ID NO: 13904 - protein, 265 aa, Arabidopsis thaliana
  misc_feature: Useful for making plants with modulated heat sensitivity
MGKIKKVNQRGHIATPYPSPCCKKEWAGSTCPVCLESPHNAVLLLCSSYHKGCRPYMCATSSRFANCLDQYRKSYGNENSGQPELLCPLCRGQVKGWTVVKDARMHFNSKRRTCMQDNCSFLGNFRKLKKHMKEKHPHACPRAIDPALETKWKRLERERDRRDVISTIMSSTPGAVVLGDYVIEPHNRGVYDEEDEEEDYSSDDSLSNGILDLESSWQGQSHHIRFLDMESSDFASSSSSPASPSRSLHRLLFPRNQRGGNRGAV

SEQ ID NO: 13905 - protein, 446 aa, Arabidopsis thaliana
  misc_feature: Useful for making plants with modulated nitrogen use efficiency
CGNAESMYLDINGVMIKQFSFKASLLPFSSNFRQSSAKIHRPIGATMTTVSTQNESTQKPVQVAKRLEKFKTTIFTQMSILAVKHGAINLGQGFPNFDGPDFVKEAAIQAIKDGKNQYARGYGIPQLNSAIAARFREDTGLVVDPEKEVTVTSGCTEAIAAAMLGLINPGDEVILFAPFYDSYEATLSMAGAKVKGITLRPPDFSIPLEELKAAVTNKTRAILMNTPHNPTGKMFTREELETIASLCIENDVLVFSDEVYDKLAFEMDHISIASLPGMYERTVTMNSLGKTFSLTGWKIGWAIAPPHLTWGVRQAHSYLTFATSTPAQWAAVAALKAPESYFKELKRDYNVKKETLVKGLKEVGFTVFPSSGTYFVVADHTPFGMENDVAFCEYLIEEVGVVAIPTSVFYLNPEEGKNLVRFAFCKDEETLRGAIERMKQKLKRKV

SEQ ID NO: 13906 - protein, 484 aa, Arabidopsis thaliana
  misc_feature: Useful for making plants with altered cell wall content and/or composition
MVRRFLSSHKSLITVFWIATFASLFIWQFGGVSTNLYSGFSLFWSSSSTTTTVFSGGFPKLRPVVFNLTDFGAVGDGVTINTEAFEKAIYKISKLAKKGGGQLNVPPGRWLTAPFNLTSYMTLFLSENAEILALQDEKYWSLLPPLPSYGYGREHHGPRYGSFIHGQNLRDVVVTGNNGSINGQGQTWWKKYRQKLLNHTRGPLVQIMWSSDIVFANITLRDSPFWTLHPYDCKNVTITNMTILAPVFEAPNTDGIDPDSCEDMLIENSYISVGDDGIAIKSGWDQYGTTYGKPSKNILIRNLIIRSMVSAGISIGSEMSGGVSNITVENILIWSSRRGVRIKTAPGRGGYVRDITFRNVTLDELRVGIVIKTDYNEHPDGGFNPQAFPILENINYTGIYGQGVRVPVRIQGSKEIPVKNVTFRDMSVGITYKKKHIFQCAYVEGRVIGTIFPAPCDNLDRYDEQERLVKQSDSQNATDIDYEI

SEQ ID NO: 13907 - protein, 72 aa, Arabidopsis thaliana
  misc_feature: Useful for making plants with modulated water use efficiency
MSGLQAQDSACSLDKPSKDVVATETKPKKRICCACPDTKKLRDECIVEHGESACTKWIEAHISCLRSEGFKV

SEQ ID NO: 13908 - protein, 692 aa, Arabidopsis thaliana
  misc_feature: Useful for making plants with altered cell wall content and/or composition
MAPRLDFSDWWAKDTRKGTPVVVKMENPNYSVVEIDGPDSAFRPVEKSRGKNAKQVTWVLLLKAHRAVGCLTWLATVFWSLLGAIKKRLSFTHPLGSEKLGRDRWLFTAIKLFLAVSLVILGFEIVAYFRGWHYFQSPSLHIPTSTLEIQSLFHLVYVGWLTLRADYIAPPIKALSKFCIVLFLIQSVDRLVLCLGCFWIKYKKIKPRFDEEPFRNDDAEGSGSEYPMVLVQIPMCNEREVYEQSISAVCQLDWPKDRILVQVLDDSNDESIQQLIKAEVAKWSQKGVNIIYRHRLVRTGYKAGNLKSAMSCDYVEAYEYVAIFDADFQPTPDFLKLTVPHFKDNPELGLVQARWTFVNKDENLLTRLQNINLCFHFEVEQQVNGVFLNFFGFNGTAGVWRIKALEESGGWLERTTVEDMDIAVRAHLHGWKFIYLNDVKVLCEVPESYEAYKKQQHRWHSGPMQLFRLCLGSILTSKIAIWKKANLILLFFLLRKLILPFYSFTLFCIILPLTMFVPEAELPVWVICYIPVFMSFLNLLPSPKSFPFIVPYLLFENTMSVTKFNAMVSGLFQLGSSYEWIVTKKAGRSSESDLLSITEKETPTKKSQLLRGVSDSELLELSQLEEQKQAVSKKPVKKTNKIYHKELALAFLLLTAALRSLLAAQGVHFYFLLFQGVTFLLVGLDLIGEQMS

SEQ ID NO: 13909 - protein, 1026 aa, Arabidopsis thaliana
  misc_feature: Useful for making plants with altered cell wall content and/or composition
  misc_feature: Useful for making plants with modulated biomass
MEASAGLVAGSHNRNELVVIHNHEEPKPLKNLDGQFCEICGDQIGLTVEGDLFVACNECGFPACRPCYEYERREGTQNCPQCKTRYKRLRGSPRVEGDEDEEDIDDIEYEFNIEHEQDKHKHSAEAMLYGKMSYGRGPEDDENGRFPPVIAGGHSGEFPVGGGYGNGEHGLHKRVHPYPSSEAGSEGGWRERMDDWKLQHGNLGPEPDDDPEMGLIDEARQPLSRKVPIASSKINPYRMVIVARLVILAVFLRYRLLNPVHDALGLWLTSVICEIWFAVSWILDQFPKWFPIERETYLDRLSLRYEREGEPNMLAPVDVFVSTVDPLKEPPLVTSNTVLSILAMDYPVEKISCYVSDDGASMLTFESLSETAEFARKWVPFCKKFSIEPRAPEMYFTLKVDYLQDKVHPTFVKERRAMKREYEEFKVRINAQVAKASKVPLEGWIMQDGTPWPGNNTKDHPGMIQVFLGHSGGFDVEGHELPRLVYVSREKRPGFQHHKKAGAMNALVRVAGVLTNAPFMLNLDCDHYVNNSKAVREAMCFLMDPQIGKKVCYVQFPQRFDGIDTNDRYANRNTVFFDINMKGLDGIQGPVYVGTGCVFKRQALYGYEPPKGPKRPKMISCGCCPCFGRRRKNKKFSKNDMNGDVAALGGAEGDKEHLMSEMNFEKTFGQSSIFVTSTLMEEGGVPPSSSPAVLLKEAIHVISCGYEDKTEWGTELGWIYGSITEDILTGFKMHCRGWRSIYCMPKRPAFKGSAPINLSDRLNQVLRWALGSVEIFFSRHSPLWYGYKGGKLKWLERFAYANTTIYPFTSIPLLAYCILPAICLLTDKFIMPPISTFASLFFISLFMSIIVTGILELRWSGVSIEEWWRNEQFWVIGGISAHLFAVVQGLLKILAGIDTNFTVTSKATDDDDFGELYAFKWTTLLIPPTTVLIINIVGVVAGISDAINNGYQSWGPLFGKLFFSFWVIVHLYPFLKGLMGRQNRTPTIVVIWSVLLASIFSLLWVRIDPFVLKTKGPDTSKCGINC

SEQ ID NO: 13910 - protein, 275 aa, Arabidopsis thaliana
  misc_feature: Useful for making plants with modulated oxidative stress sensitivity
MALSLLSVFIFFHVFTNVVFAASNEESKALVSLPTPTLPSPSPATKPPSPALKPPTPSYKPPTLPTTPIKPPTTKPPVKPPTTSVTPVKPPVSTPPIKLPPVQPPTYKPPTPTVKPPSVQPPTYKPPTPTVKPPTTSPVKPPTTPPVQSPPVQPPTYKPPTSPVKPPTTTPPVKPPTTTPPVQPPTYNPPTTPVKPPTAPPVKPPTPPPVRTRIDCVPLCGTRCGQHSRKNVCMRACVTCCYRCKCVPPGTYGNKEKCGSCYANMKTRGGKSKCP

SEQ ID NO: 13911 - protein, 299 aa, Panicum virgatum
  misc_feature: Useful for making plants with altered carbohydrate content
MAKSFPAMLLVTALALAGLAAGARAGDIAIYWGQNGNGGTLAEACATGNYKFVNVAFLTTFGKAQTPVLNLAGHCNPATNGCTGVGAEIKSCQSRGVKVLLSIGGGVGSYGLSSPADAGQVAAYLWNNYLGGASKSRPLGDAVLDGIDFDIEIGGSLYWDDLARSLKSYSRQGRRPVYLAAAPQCPFPDASLDTALRTGLFDYVWVQFYNNPPCQYSASAGVGGLARAWAQWTSIRAGRVFLGLPAAPQAAGSGFVPTSDLVSQVLPVVRNSTKYGGIMLWSRFYDGLTGYSDAVKSQV

SEQ ID NO: 13912 - protein, 302 aa, Arabidopsis thaliana
  misc_feature: Useful for making plants with altered cell wall content and/or composition
MTNMTLRKHVIYFLFFISCSLSKPSDASRGGIAIYWGQNGNEGNLSATCATGRYAYVNVAFLVKFGNGQTPELNLAGHCNPAANTCTHFGSQVKDCQSRGIKVMLSLGGGIGNYSIGSREDAKVIADYLWNNFLGGKSSSRPLGDAVLDGIDFNIELGSPQHWDDLARTLSKFSHRGRKIYLTGAPQCPFPDRLMGSALNTKRFDYVWIQFYNNPPCSYSSGNTQNLFDSWNKWTTSIAAQKFFLGLPAAPEAAGSGYIPPDVLTSQILPTLKKSRKYGGVMLWSKFWDDKNGYSSSILASV

SEQ ID NO: 13913 - protein, 102 aa, Arabidopsis thaliana
  misc_feature: Useful for biocontainment applications
  misc_feature: Useful for making plants with modulated biomass
  misc_feature: Useful for making plants with modulated flowering time
MMKKRQMVIKQRSRNSNTSSSWTTTSSSSSSSEISNVRYVECQKNHAANIGGYAVDGCREFMAAGVEGTVDALRCAACGCHRNFHRKEVDTEVVCEYSPPNA

SEQ ID NO: 13914 - protein, 474 aa, Arabidopsis thaliana
  misc_feature: Useful for making plants with altered cell wall content and/or composition
MSHKSKPKPKMKTQPPKSNDGSPVVSQPPQVQQPPPPHVQPPPTPLPLQPVEDSQQFNVLDFGAKGDGMSDDTQAFEAAWASACKVEASTMIIPPDYIFLVGPISFSGPYCQANIVFQLEGMIVAPTDTESWGGGLMWWIEFTKLSGITIQGNGVIDGRGTVWWQQDYLSDYPIDDDFKLIVPLNNSVQERPPMPIRSELNWRMPSIKPTALRFYGSIDVTVTGITIQNSPQCHLKFDNCVKVLVHDVNVSSPGDSPNTDGIHLQNTRDVMIHTTTLACGDDCISIQTGCSNVYVHNVNCGPGHGISIGSLGKDSTKACVSNITVRDVVMHNTMTGVRIKTWQGGIGSVKGILFSNIQLTEVQLPIVIDQFYCDHSKCMNHTSAVSVEGVTYEKIRGTYTVKPVHFACSDSFPCIDVQLSGIELKPVQLQYHMYDPFCWKTFGELNSATVPPIDCLQIGKPARNGVHSDHDICL

SEQ ID NO: 13915 - protein, 384 aa, Arabidopsis thaliana
  misc_feature: Useful for making plants with altered cell wall content and/or composition
MASLLVLFVFFFISSCSAQSYNVLSFGAKPDGKTDATKAFMAVWQTACASSRPVTIVVPKGRFLLRSVTFDGSKCKPKPVTFRIDGTLVAPADYRVIGNEDYWIFFQHLDGITVYGGVLDARGASLWDCKKSGKNCPSGATTIGFQSSSNVVVSGLTSLNSQMFHVVINGCNNVKLQGVKVLAAGNSPNTDGIHVQSSSSVSIFNTKISTGDDCVSIGPGTNGLWIENVACGPGHGISIGSLGKDSVESGVQNVTVKTVTFTGTDNGVRIKSWARPSSGFAKNIRFQHCVMNNVENPIIIDQNYCPDHDCPRQVSGIKISDVLFVDIHGTSATEVGVKLDCSSKKPCTGIRLEDVKLTYQNKPAASACTHAGGIEAGFFQPNCL

SEQ ID NO: 13916 - protein, 502 aa, Panicum virgatum
  misc_feature: Useful for making plants with altered carbohydrate content
MAVANGSGGKGFEVPKVEVRFTKLFINGQFVDAVSGKTFETRDPRTGEVIANIAEGDKADVDLAVKAAREAFDNGPWPRMTGYERGRILNKFADLIDQHIEELAMLDTVDAGKLFLVGKVRDIPGAAHLLRYYAGAADKIHGETLKMAQRMHGYTLKEPVGVIGHIVPWNYPSTMFFFKVSPALAAGCAVVVKPAEQTPLSALFYAHLSREAGVPDGVLNVVPGFGPTAGAAVAAHMDVDKLSFTGSTEVGRLVMKAAAESNLKSVSLELGGKSPVIVFDDADLDMAVNLVNFATYTNKGEICVAGTRIYVQEGIYDAFVKKAAELAKKSVVGDPFNPRVNQGPQVDKDQYEKVLKYINIGKREGATLVTGGKPCGDKGYYIEPTIFTDVKDDMSIAQDEIFGPVMALMKFKTVEEVIQKANNTRYGLAAGIVTKNIDIANTVSRSIRAGAIWINCYFAFDPDAPFGGYKMSGFGKDMGMDGLEKYLQTKTVVTPLYNTPWL

SEQ ID NO: 13917 - protein, 656 aa, Panicum virgatum
  misc_feature: Useful for making plants with altered carbohydrate content
MGTKEASPPTVLCLFFLFCLGGKCLASEFQATQTATLTVDASPQLARKIPDTLFGIFFEEINHAGAGGIWAELVSNRGFEAGGPHTPSNIGPWSIIGDDSSIFVATDRTSCFSRNIVALRMEVLCDNCPAGGVGIYNPGFWGMNIEDGKTYNLVMYAKSPETTDLTVSLTSADGSQSLASATVTVSGTLNWTKLEQKLVAKGTNRTSRLQITTNKKGVVWFDQVSLMPEDTYKGHGFRTELISMLLDLKPQFLRFPGGCFVEGDWLRNAFRWRESIGPWEERPGHFGDVWHYWTDDGLGYYEFLQLAEDLGAAPIWVFNNGVSHNDEVDTVAIAPFVKDVLDSLEFARGSANSTWGSVRASMGHPEPFPVKYVAIGNEDCGKKFYRGNYLKFYNAIRQAYPDIQMISNCDGSSKPLDHPADLYDFHVYTDSKTLFNMRSTFDRTSRSGPKAFVSEYAVWRSDAGRGSLLASLAEAAFLTGLEKNSDIVQMASYAPLFVNDNDQTWNPDAIVFNSWQHYGTPSYWMQTLFRESSGAMIHPIKISSNYSGSLAASAITWQDSENSFLRVKVVNFGSDAGSLTISTSGLQASVNALGSTATVLTSGNVMDENSFSNPNKVAPVKSELSNAAEQMQVTLAPHSFSSFDLALAQSKLIAEM

SEQ ID NO: 13918 - protein, 681 aa, Arabidopsis thaliana
  misc_feature: Useful for making plants with modulated light quality response
  misc_feature: Useful for making plants with modulated low light sensitivity
  misc_feature: Useful for making plants with modulated nitrogen use efficiency
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTG

SEQ ID NO: 13919 - protein, 263 aa, Panicum virgatum
  misc_feature: Useful for making plants with altered carbohydrate content
MVSHTALPLLLLPFLFAAAADDLAPGPSPPGELNLTSILESGGQYSTLLRLLQATKISEQLTSQLKNTYDGLTFFAPNDNAFTKLKTGTLNGLTDQQKIQLLLYHVLPRYYSVTTFQTASNPLPTEASGPGGMYSVNVTTTTTSHLVNMSTGVVDVPISSTLSAKFPLAVYSVDDVLLPVQLFGTSHKGKASAPAPAGQAGAAAGKASAGKKGGVPKSDVAAEPSAAEEAEDSNNAAAGRGSAGWTTIAAFALIMAIVNLVGA

SEQ ID NO: 13920 - protein, 247 aa, Arabidopsis thaliana
  misc_feature: Useful for making plants with altered cell wall content and/or composition
MSSSLFSYVVLLIFLFTIPYIQSQPTAPAPTTEKSPINLTAILEAGHQFTTLIQLLNTTQVGFQVSVQLNSSDQGMTIFAPTDNAFNKLKPGTLNSLTYQQQIQLMLYHIIPKYYSLSDLLLASNPVRTQATGQDGGVFGLNFTGQAQSNQVNVSTGVVETRINNALRQQFPLAVYVVDSVLLPEELFGTKTTPTGAPAPKSSTSSSDADSPAADDEHKSAGSSVKRTSLGIVVSFALFCCSVIYIA

SEQ ID NO: 13921 - protein, 269 aa, Arabidopsis thaliana
  misc_feature: Useful for making plants with altered lignin content
MGRSPCCEKEHMNKGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKLLSKGIDPATHRGINEAKISDLKKTKDQIVKDVSFVTKFEETDKSGDQKQNKYIRNGLVCKEERVVVEEKIGPDLNLELRISPPWQNQREISTCTASRFYMENDMECSSETVKCQTENSSSISYSSIDISSSNVGYDFLGLKTRILDFRSLEMK

SEQ ID NO: 13922 - protein, 282 aa, Arabidopsis thaliana
  misc_feature: Useful for making plants with altered alkaloid content
  misc_feature: Useful for making plants with altered lignin content
  misc_feature: Useful for making plants with modulated nitrogen use efficiency
  misc_feature (234)..(234): Xaa is any aa, unknown, or other
  misc_feature (242)..(242): Xaa is any aa, unknown, or other
MGRSPCCEKAHINKGAWTKEEDERLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINXMECRCGRXRCDVVGGSSKGSDMSNGFDFLGLAKKETTSLLGFRSLEMK

SEQ ID NO: 13923 - protein, 336 aa, Arabidopsis thaliana
  misc_feature: Useful for biocontainment applications
MGRHSCCYKQKLRKGLWSPEEDEKLLRYITKYGHGCWSSVPKQAGLQRCGKSCRLRWINYLRPDLKRGAFSQDEENLIIELHAVLGNRWSQIAAQLPGRTDNEIKNLWNSCLKKKLRLRGIDPVTHKLLTEIETGTDDKTKPVEKSQQTYLVETDGSSSTTTCSTNQNNNTDHLYTGNFGFQRLSLENGSRIAAGSDLGIWIPQTGRNHHHHVDETIPSAVVLPGSMFSSGLTGYRSSNLGLIELENSFSTGPMMTEHQQIQESNYNNSTFFGNGNLNWGLTMEENQNPFTISNHSNSSLYSDIKSETNFFGTEATNVGMWPCNQLQPQQHAYGHI

SEQ ID NO: 13924 - protein, 274 aa, Panicum virgatum
  misc_feature: Useful for making plants with altered carbohydrate content
MGRQPCCDKLGVKRGPWTAEEDRKLISFILSNGHCCWRAVPKLAGLLRCGKSCRLRWTNYLRPDLKRGLLTDAEEQVVIDLHAKLGNRWSKIAAKLPGRTDNEIKNHWNTHIKKKLIKMGIDPVTHEPLDRKTSNSPATTSQSVVTADSTKSDEATKQQSPQSDAVGDVLADGSSPTESSATNTTVSTGGSISSSHDQDPLVKWLLEVDPPTGDEPWLNFTGSVEVDGEFSSIAAGPELPWDGATDWLLDYQDFGLGDLGLVDGYMINSSNGAN

SEQ ID NO: 13925 - protein, 282 aa, Arabidopsis thaliana
  misc_feature: Useful for making plants with altered cell wall content and/or composition
MGRQPCCDKVGLKKGPWTAEEDRKLINFILTNGQCCWRAVPKLSGLLRCGKSCRLRWTNYLRPDLKRGLLSDYEEKMVIDLHSQLGNRWSKIASHLPGRTDNEIKNHWNTHIKKKLRKMGIDPLTHKPLSIVEKEDEEPLKKLQNNTVPFQETMERPLENNIKNISRLEESLGDDQFMEINLEYGVEDVPLIETESLDLICSNSTMSSSTSTSSHSSNDSSFLKDLQFPEFEWSDYGNSNNDNNNGVDNIIENNMMSLWEISDFSSLDLLLNDESSSTFGLF

SEQ ID NO: 13926 - protein, 359 aa, Oryza sativa
  misc_feature: Useful for making plants with modulated biomass
MGHHSCCNQQKVKRGLWSPEEDEKLIRYITTHGYGCWSEVPEKAGLQRCGKSCRLRWINYLRPDIRRGRFTAEEEKLIISLHAIVGNRWAHIASHLPGRTDNEIKNYWNSWIKKKIRKPAAAAAAATTTSPNNPPPCSTATSDHHHLPPPAFGGADHHLQLDAIINQNLISSLPPKLATGDDSPPAVPGLPHHCPLFMFDTTTTGAGGAISPPPPSSLIPTHLHHHHHPFIASFTAAMAADTPSYLPPLVDGMAAMGAAMDCSLEDGQTAAAMAATNGYYQHHQKHQQLEIELEEEEQRQLGHHHHQHHHEHEHENHQWDEEEAQHLLMWDQEVLTSSNLEAMQSGAHSLLFMGPNDHD

SEQ ID NO: 13927 - protein, 69 aa, Arabidopsis thaliana
  misc_feature: Useful for making plants with modulated nitrogen use efficiency
MASNEAGRALPKFGEWDVNDPATADGFTVIFSKAGEDKKTGRSSTKTNSQRKQDGDKPAVKKWLCFTFA

SEQ ID NO: 13928 - protein, 569 aa, Arabidopsis thaliana
  misc_feature: Useful for making plants with modulated flowering time
MALRTLSTFPSLPRRHTTTRREPNLTVIYRNPTTSIVCKSIANSEPPVSLSERDGFAAAAPTPGERFLENQRAHEAQKVVKKEIKKEKKKKKEEIIARKVVDTSVSCCYGCGAPLQTSDVDSPGFVDLVTYELKKKHHQLRTMICGRCQLLSHGHMITAVGGNGGYPGGKQFVSADELREKLSHLRHEKALIVKLVDIVDFNGSFLARVRDLVGANPIILVITKIDLLPKGTDMNCIGDWVVEVTMRKKLNVLSVHLTSSKSLDGVSGVASEIQKEKKGRDVYILGAANVGKSAFINALLKTMAERDPVAAAAQKYKPIQSAVPGTTLGPIQINAFVGGEKLYDTPGVHLHHRQAAVVHSDDLPALAPQNRLRGQSFDVSLLYYGQISTLPTQSSSSPKGESLNGYTFFWGGLVRIDILKALPETCFTFYGPKALEIHAVPTKTATAFYEAKLGVLLTPPSGKNQMQEWKGLQSHRLLQIEINDAKRPASDVAISGLGWISIEPIRKTRGTEPRDLNEAEHEIHICVSVPKPVEVFLRPTLPIGTSGTEWYQYRELTDKEEEVRPKWYF

SEQ ID NO: 13929 - protein, 366 aa, Panicum virgatum
  misc_feature: Useful for making plants with altered carbohydrate content
MGTGAVAVVAPDRAKQRRGGHLWKKALLHFSLCFVMGFFTGFAPSSSSSWKAATQHPPHRAGDHLAASRVAVDARVNLVPSPPDTAGEVGLGGAGGGATVDVGDDDEEAGLQRLLIVVTTTRSGAGERRRRRAELLRLAHTLRLVRPPVVWVVVEPVADAPATAEVLRGTGVMYRHIAFKPEENFTTAAAEAHAQRNAALAHVEKHRLAGVLHFADAAGVYDTGFFDQIRQIEAFGTWPVATMSAGEKKVVVEGPLCSASKVIGWFSRDFNDGTTRAATYNTETDLNPAGAAGTRLHTIDVSGFAFNSSILWDPERWGRPTSLPDTSQDSIKFVQEVVLEDRAKLKGIPSDCSQIMVWQYGAPSSQ

SEQ ID NO: 13930 - protein, 280 aa, Arabidopsis thaliana
  misc_feature: Useful for making plants with altered sterol content
MSGSSSPSLWLAPNPSKRWGELFFLFYTPFWLTLCLGIVVPYKLYETFTELEYLLLALVSAVPAFVIPMLLVGKADRSLCWKDRYWVKANLWIIVFSYVGNYFWTHYFFKVLGASYTFPSWKMNNVPHTTFFLTHVCFLFYHVASNITLRRLRHSTADLPDSLKWCFEAAWILALSYFIAYLETIAIANFPYYEFVDRSAMYRVGCLFYAIYFIVSFPMFFRMDEKSTDEWDLSRVAVDALGAAMLVTIILDLWRLFLGPIVPLPEGQNCLQSGLPWFSN

SEQ ID NO: 13931 - protein, 348 aa, Panicum virgatum
  misc_feature: Useful for making plants with altered carbohydrate content
MRLSAAVLCALVAVQAAVLLAAVPAAQAGELQVGYYGKKCKGLENIVKWHVIRALKANRRTGSALVRLLFHDCFVRGCDGSVLLDASYDNPHPEKEAPANIGLTAFDLLEEIKAAVEDKCPGVVSCSDLLIYAARDASSILSNGHVHFDVPAGRLDGFVSKAEEAQAELPDSADDVHKLIANFARKNFTVEELVILSGAHSIGQTHCSSFAGRLSEPADQIVPAYRELLKYKCSQGSNPPVVNNVRDEDYDVVARYTPGFTSRVRKVPDYLDNSYYHNNLAKIVTFHSDWTLLTHKEALGHVKEYAENGTLWDEDFADSLVKLSKLPMPAGSKGEIRKKCSAINHRLY

SEQ ID NO: 13932 - protein, 236 aa, Arabidopsis thaliana
  misc_feature: Useful for making plants with modulated nitrogen use efficiency
MGRSPCCEKAHTNKGAWTKEEDQRLVDYIRNHGEGCWRSLPKSAGLLRCGKSCRLRWINYLRPDLKRGNFTDDEDQIIIKLHSLLGNKWSLIAGRLPGRTDNEIKNYWNTHIKRKLLSHGIDPQTHRQINESKTVSSQVVVPIQNDAVEYSFSNLAVKPKTENSSDNGASTSGTTTDEDLRQNGECYYSDNSGHIKLNLDLTLGFGSWSGRIVGVGSSADSKPWCDPVMEARLSLL

SEQ ID NO: 13933 - protein, 425 aa, Panicum virgatum
  misc_feature: Useful for making plants with altered carbohydrate content
MGTGTGGARGGAGGGGLVPGERWWRVLFLALASVSFLISLILLFLSAPRLRLPGVAPSASTSAASAVRRGLDAPPCLAYLLIGARGDGRRLLRLLLAVYHPRNRYVLHLSADAPDDERQSLAAGVVAAAPAVGAFENVAVVGNPTAGTLVGSSGLAGTLRAAAVLLRLHPDWDWFLTLNAADYPLVTQDDLIHVLSSVPRDLNFIDHTSNIGSKEPEKVEQIIVDAGIYLSGRTNFFRGTQKRPAPVAFKFFTGSPWVILNRRFIEYCILAWENLPRILLMYFNNIIQPQEGYFHSVICNSLEFRNFTVNNDLRFIPREDPAQKEPPFLSREHYSQMVDSGAPFARPFRENDPLLDQIDGNILKRWSHGPVPGAWCSGRKRWFSDPCSQWGDVNIVRPGPQAVKLHQYVNRTLQEAKSSSNTCRQ

SEQ ID NO: 13934 - protein, 538 aa, Arabidopsis thaliana; identical to SEQ ID NO: 13374
  misc_feature: Useful for making plants with modulated water use efficiency

SEQ ID NO: 13935 - protein, 738 aa, Arabidopsis thaliana
  misc_feature: Useful for making plants with modulated biomass
  misc_feature: Useful for making plants with modulated biotic stress sensitivity
  misc_feature: Useful for making plants with modulated light response
  misc_feature: Useful for making plants with modulated root development
  misc_feature: Useful for making plants with modulated salt sensitivity
MEVCNCIEPQWPADELLMKYQYISDFFIAIAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALSGNTDKSTKEKCMSFGLDGVLLKPVSLDNIRDVLSDLLEPRVLYEGM

SEQ ID NO: 13936 - protein, 261 aa, Panicum virgatum
  misc_feature: Useful for making plants with altered carbohydrate content
MAAASHLAAVLLMLAAAVLSTAPVARGQAASAPAPAPAAPKTITAVLTKAGQFTKFLQLLQSTREAEQITNQLKGKSSSGGLTVFAPPDNAFTALPVGTLNSLSDQQKTSLVQFHVVSMVMPASQLETVSNPLRTQAGDTGPGKYPLNITADGTNVNVSTGVVNATLDGTPLYAGDRLVVYQVNKVLLPWALYGPALPPAPAPAPAESKKKKKDAPDAAADAPAADTAAGTTASEAARGVQGVGAGSCVAVAVAAAMWWAM

SEQ ID NO: 13937 - protein, 246 aa, Arabidopsis thaliana
  misc_feature: Useful for making plants with altered cell wall content and/or composition
MATSRTFIFSNLFIFFLVIATTYGQAPAPGPSGPTNITAILEKAGQFTLFIRLLKSTQASDQINTQLNSSSSNGLTVFAPTDNAFNSLKSGTLNSLSDQQKVQLVQFHVLPTLITMPQFQTVSNPLRTQAGDGQNGKFPLNITSSGNQVNITTGVVSATVANSVYSDKQLAVYQVDQVLLPLAMFGSSVAPAPAPEKGGSVSKGSASGGDDGGDSTDSSDAERTGFGFGIRITTVAAIAASSSLWI

SEQ ID NO: 13938 - protein, 361 aa, Arabidopsis thaliana
  misc_feature: Useful for making plants with altered lignin content
  misc_feature: Useful for making plants with altered protein content
  misc_feature: Useful for making plants with altered terpenoid content
MEYSCVDDSSTTSESLSISTTPKPTTTTEKKLSSPPATSMRLYRMGSGGGSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLSAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 13939 - protein, 384 aa, Glycine max
  misc_feature: Useful for making plants with altered alkaloid content
  misc_feature: Useful for making plants with altered lignin content
MDAISCLDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDAVTNFKPLSGTDDDDGESEFLNSHSKSEIVDMLRKHTYNDELEQSKRSRGFVRRRGSAAGAGNGNSISGACVMKAREQLFQKAVTPSDVGKLNRLVIPKQHAEKHFPLQSAANGVSATAAAAKGVLLNFEDVGGKVWRFRYSYWNSSQSYVLTKGWSRFVKEKNLKAGDTVCFQRSTGPDRQLYIDWKTRNVVNEVALFGPVVEPIQMVRLFGVNILKLPGSDSIANNNNASGCCNGKRREMELFSLECSKKPKIIGAL

SEQ ID NO: 13940 - protein, 157 aa, Arabidopsis thaliana
  misc_feature: Useful for making plants with modulated heat sensitivity
  misc_feature (14)..(14): Xaa is any aa, unknown, or other
MSLIPSFFGNNRRXNSIFDPFSLDVWDPFKELQFPSSLSGETSAITNARVDWKETAEAHVFKADLPGMKKEEVKVEIEDDSVLKISGERHVEKEEKQDTWHRVERSSGQFSRKFKLPENVKMDQVKASMENGVLTVTVPKVEEAKKKAQVKSIDISG

SEQ ID NO: 13941 - protein, 277 aa, Panicum virgatum
  misc_feature: Useful for making plants with altered carbohydrate content
MFNFIPTKSLKSSQISDTNTSGGPMQGDPGYGYGYGYGAGAGGYDYDMAGYGGGGGAYYTANDRYPVAPAANEDPVAGTRQHDFPAPLTGLEFQPSDTCPKNYVIFDQTYDRSRMMFHPSLVPNNLGSSVGGYDYDYDHRCYGYDQNYAGKSAYYGCGDDGGAASIRQEDTDEINALMSTEDGEDEDDVRSTGRTPGCRAGGSPDSTCSSAGCSAGRKHEAGGEKKKERMKKMVRTLKGIVPGGDRMDTPAVLDEAVRYLKSLKVEVKKLGARGSSG

SEQ ID NO: 13942 - protein, 329 aa, Arabidopsis thaliana
  misc_feature: Useful for making plants with modulated water use efficiency
IRSWFQISLFSSKTHLSLSLIKHKNSFIVLSRLTYNTRLSNRNRFSLFDQISDLSLFDSSSLDRFSLETTMASGREEFVYMAKLAEQAERYEEMVEFMEKVSAAVDGDELTVEERNLLSVAYKNVIGARRASWRIISSIEQKEESRGNDDHVTAIREYRSKIETELSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQ

SEQ ID NO: 13943 - protein, 462 aa, Arabidopsis thaliana
  misc_feature: Useful for making plants with modulated nitrogen use efficiency
MAVATHCFTSPCHDRIRFFSSDDGIGRLGITRKRINGTFLLKILPPIQSADLRTTGGRSSRPLSAFRSGFSKGIFDIVPLPSKNELKELTAPLLLKLVGVLACAFLIVPSADAVDALKTCACLLKGCRIELAKCIANPACAANVACLQTCNNRPDETECQIKCGDLFENSVVDEFNECAVSRKKCVPRKSDLGEFPAPDPSVLVQNFNISDFNGKWYITSGLNPTFDAFDCQLHEFHTEGDNKLVGNISWRIKTLDSGFFTRSAVQKFVQDPNQPGVLYNHDNEYLHYQDDWYILSSKIENKPEDYIFVYYRGRNDAWDGYGGAVVYTRSSVLPNSIIPELEKAAKSIGRDFSTFIRTDNTCGPEPALVERIEKTVEEGERIIVKEVEEIEEEVEKEVEKVGRTEMTLFQRLAEGFNELKQDEENFVRELSKEEMEFLDEIKMEASEVEKLFGKALPIRKVR

SEQ ID NO: 13944 - protein, 451 aa, Panicum virgatum
  misc_feature: Useful for making plants with altered carbohydrate content
MAGRRTAPLRLCASVALLVVAVSSLTPSSDAYDPLDPNGNITIKWDVMQWTPDGYVAVVSLYNYQQYRHIQAPGWKLGWVWAKKEIIWAMTGGQATEQGDCSKFKSNIPHCCKKDPEVVDLLPGTPYNMQIANCCKGGVLTAWAQDPDNAVASFQVSVGQAGTTNKTVKVPKNFTLKAPGPGYTCGPAKLVKPTKFISPDGRRSTQAHMTWNVTCTYSQFVAQRSPTCCVSLSSFYNDTIVNCPTCSCGCQNNSTAPGSCVEGNSPYLASVVNDPNKNSLAPLVQCTSHMCPIRVHWHVKVNYKEYWRVKITVTNFNYRMNYSQWNLVAQHPNFDNLTTIFSFNYKSLNPYGVINDTAMLWGIKYYNDLLMTAGPDGNVQSELLFRKEPSTFTFQKGWAFPRRVYFNGDNCVMPPPDAYPWLPNASPRQSASVLLTFVAVWAALAILLANP

SEQ ID NO: 13945 - protein, 658 aa, Panicum virgatum
  misc_feature: Useful for making plants with altered carbohydrate content
METRDSAPSTTPLPYSYSPLPAADAASAEVSGARARRRPLCAAALVLSAALLLLAVAALAGVRIAPPRPIAVGETAAAARSRGPAAGVSEKTSGASGVLLGEGGGNAFPWSNAMLQWQRTGFHFQPHKNWMNDPNGPVYYKGWYHLFYQYNPDGAIWGNKIAWGHAVSRDLVHWRHLPLAMVPDHWYDANGVWTGSATTLPDGRLAMLYTGSTNESVQVQCLAVPADPADPLLTNWTKYEGNPVLLPPAAIGSKDFRDPTTAWFDPSDRTWRIVIGSKDAHHAGIAVTYRTRDLVHFELLPGLLHRVEGTGMWECIDFYPVGTRDDASRNGVDMSDAISENGVAGDVVHVMKASMDDDRHDYYALGRYDAAANAWTPLDPAKDVGIGLRYDWGKFYASKTFYDPAKRRRVLWGWVGETDSERADVAKGWASLQSIPRTVLLDTKTGSNLLQWPVEEVETLRTNSTDLSGITIDHGSVFPLNLHRATQLDIVAEFEVDRRAVMALNEADVGYNCSTSGGAASRGALGPFGLLVLADKRLREQTAVYFYVAKGLDGGLTTHFCQDESRSSSANDIVKRVVGSAVPVLGGETLSLRMLVDHSVVESFAQGGRSTATSRVYPTEAIYANAGVYLFNNATAARVTAKTLVVHEMDSSYNHDYL

SEQ ID NO: 13946 - protein, 104 aa, Arabidopsis thaliana
  misc_feature: Useful for making plants with modulated cold sensitivity
MAVKRSSKLTQTAMLKQILKRCSSLAKNQCYDEDGLPVDVPKGHFPVYVGEKRSRYIVPISFLTHPKFKSLLQQAEEEFGFNHDMGLTIPCEEVVFRSLTSMIG

SEQ ID NO: 13947 - protein, 386 aa, Panicum virgatum
  misc_feature: Useful for making plants with altered carbohydrate content
MNSGVMVVEPSETLFNDMIDKVGRLPSYTGGDQGFLNSYYPDFPNSRVYEPDSPLTPEPETQRLSTLYNADVGLYMLANKWMVDEKELRVIHYTLGPLKPWDWFTAWLVKPVGTWQDIRQKLEESLPGTGGGRNPHDQLVVKILFILPFCLLLFGYYQSCFQTNKELISIRSLCAFARRARHKYKSEEPLPSYSVVGSSAAFGISNQRLSNGTHSKLPPYFGPIAVLVCFISAGVSFAFAFAIIPRQVMPWTGLLLMFELTFVAFFLLFGSYLHFVYQWGSMSANHVGFNNSDSSENHIGSGHQRNMSDCDMDATFYWIGMAVIATVAVLLPTILGITALFTKLGLMVAGGVVLASFMTYAAEHLAISAFNKGQKDRNARTRSFCF

SEQ ID NO: 13948 - protein, 537 aa, Arabidopsis thaliana
  misc_feature: Useful for making plants with altered cell wall content and/or composition
MVRLKTSLWVLLLALVSIQLNGSFGSESSKVAYVTLLYGDEFLLGVRVLGKSIRDTGSTKDMVALVSDGVSDYSKKLLKADGWKVEKISLLANPNQVHPTRFWGVYTKLKIFNMTDYKKVVYLDADTIVVKNIEDLFKCSKFCANLKHSERLNSGVMVVEPSEALFNDMMRKVKTLSSYTGGDQGFLNSYYPDFPNARVFDPSVTPEVLKTRPVPAMERLSTLYNADVGLYMLANKWMVDDSKLHVIHYTLGPLKPWDWWTAWLVKPVDAWHSIRVKLEETLPGTGGGSNQHDELVVKFLFLLPLCALLFCIYRSIQGREGSLCWSSFSNQIRYLYYKVRSNGTLGYGGVSTMSPSYQPHSGNAQSKVPQHLGAVSVVVCFTAVLLSLGISFAIVPRQIMPWTGLVLVYEWTFTIFFLLFGVFLLFVHQHGKRIAIQSESSSLDDSAKVHQRAGGSCDVTTLYYGLGMAFLAIAAVSLPYILGITALFTRLGLMVGLAIILAAFMTYASEHLAVRWFLKGLEDRRDTTRSNSLCFLC

SEQ ID NO: 13949 - protein, 51 aa, Panicum virgatum
  misc_feature: Useful for making plants with altered carbohydrate content
MPFTPGPYSGVSTLALVARASAFGVGVVYGSIKLSILKATKPKKEEAHAHH

SEQ ID NO: 13950 - protein, 75 aa, Arabidopsis thaliana
  misc_feature: Useful for making plants with altered cell wall content and/or composition
MTLPPGLYSGTSSLALVARASAFGLGLVYGNMKLKVLKPPLIIKPLFFLYNKMPKAGGDVSPVSLISSFMIHPLA

SEQ ID NO: 13951 - protein, 180 aa, Arabidopsis thaliana
  misc_feature: Useful for making plants with modulated flowering time
MNILNKLGIGSSRQTNMDPSPIAQVIDDEAPAPGNQFAQFGAGCFWSVELAYQRVPGVTQTEVGYSQGITHDPSYKDVCSGTTNHAEIVRVQYDPKECSYQSLLDLFWSKHDPTTLNRQGNDVGTQYRSGIYFYNPEQEKLARESLERHQQQVDRKVVTEILPAKKFYRAEEHHQQYLSK

SEQ ID NO: 13952 - protein, 472 aa, Arabidopsis thaliana
  misc_feature: Useful for making plants with altered cell wall content and/or composition
MEMVRLSKLMFTFCIAVLIPTIRGNISELDEYWSQRADEAREFTLQAYHSDPYEIVDHFHERHYDNSTDVTTPEEDGDAKPEEEEKEFIEMLGSSTNSTRRSLRGKGKGKWSKLKGPCTASNPIDKCWRCRSDWAKRRKKLTRCVRGFGHRTTGGKRGRIYVVTSNLDEDMVNPKPGTLRHAVIQKEPLWIIFKNDMSIRLNQELLINSHKTIDARGANVHVAHGAGITMQFVKNVIIHGLHIHHISESSGGMIRDSVDHFGMRTRADGDGLSIYGSSNIWLDHISMSKCQDGLIDAIVGSTGITISNSHFTHHNDVMLLGAQNTNEADKHMQVTVAYNHFGKGLVQRMPRIRWGFVHVVNNDYTHWELYAIGGSQGPTILSHGNRFIAPPHKPHYREVTKRDYASEDEWKHWNWRSDKDVFMNGAYFRQSGNPQYKCAHTRQQMIKPKNGLAVSKLTKYAGALDCRVGRRC

SEQ ID NO: 13953 - protein, 518 aa, Panicum virgatum
  misc_feature: Useful for making plants with altered carbohydrate content
MGSEVNGGGGADRPAADVEAEKKSGAPPFEVPEVRFTKLFINGCFVDAVSGRTFETRDPRSGDVIASVAEGDREDVDLAVKAARDAFDHGEWPRMSGSERGRIMTRFAELVERHADALAALESLDGGKLPAVTKAVDIGNAAGSLRYFAGAADKIHGETLKMRGQFQGCTLREPLGVAGLIIPWNFPTTMFAIKVAPALAAGCTVVVKPAEQTPLSALFLADLAKQAGIPDGVINVVPGFGPTAGAAIASHMDVDTVSFTGSTEVGRLIMEASARSNLKPVSLELGGKSPLIIFDDADLDMAVELAISANFFNKGEACVAASRVYVQESAYDRFEKKLAERMRSWVVGDPLNDPRVDQGPQVDKAQYERVLSYIEHGKREGATLLTGGRPCGQKGYYIQPAVFTNVKEDMVIAKEEIFGPVMCLMKFKTVEEAIARANATRYGLGAGVVTRDMDVASRVVRSVRAGLVWVNCYFALSNDCPFGGRGMSGFGGDEGMQALDKYLAVKCVVAPLRGSPWM

SEQ ID NO: 13954 - protein, 355 aa, Panicum virgatum
  misc_feature: Useful for making plants with altered carbohydrate content
MVSAVLRTILVTGGAGYIGSHTVLQLLQQGFRVVVVDNLDNASEVALLRVAELAGHNGSNLVFHKVDLRDRHALEDIFSSHRFEAVIHFAGLKAVGESVQKPLLYYDNNLIGTITLLEVMAAHGCKKLVFSSSATVYGWPKEVPCTEEFPLCATNPYGRTKLVIEDICRDVHRSDPDWKIILLRYFNPVGAHPSGYIGEDPCGIPNNLMPYVQQVAVGRRPHLTVYGTDYNTKDGTGVRDYIHVVDLADGHIAALRKLYEDSDKIGCEVYNLGTGKGTSVLEMVAAFEKVSGKKIPLVFAGRRPGDAEIVYAATAKAEKELKWKAKYGIEEMCRDLWNWASKNPYGYAGSSENGN

SEQ ID NO: 13955 - protein, 350 aa, Arabidopsis thaliana
  misc_feature: Useful for making plants with altered cell wall content and/or composition
MAKSVLVTGGAGYIGSHTVLQLLEGGYSAVVVDNYDNSSAASLQRVKKLAGENGNRLSFHQVDLRDRPALEKIFSETKFDAVIHFAGLKAVGESVEKPLLYYNNNIVGTVTLLEVMAQYGCKNLVFSSSATVYGWPKEVPCTEESPISATNPYGRTKLFIEEICRDVHRSDSEWKIILLRYFNPVGAHPSGYIGEDPLGVPNNLMPYVQQVAVGRRPHLTVFGTDYKTKDGTGVRDYIHVMDLADGHIAALRKLDDLKISCEVYNLGTGNGTSVLEMVAAFEKASGKKIPLVMAGRRPGDAEVVYASTEKAERELNWKAKNGIEEMCRDLWNWASNNPYGYNSSSNGSSS

SEQ ID NO: 13956 - protein, 585 aa, Panicum virgatum
  misc_feature: Useful for making plants with altered carbohydrate content
MRAASGGREPSSSSAAVVALRALLIATACGLVFALLNLPDGRAGSAPPGGERGAGAGGGARLSVEQGLIREARRLNTIAEEIDGQSDESAAEEDERISKSPPDTKEKIWMMQDQLIMAKAYLHFASPQGSAHLVRELKSRIKEIERAISHSSGGSHIPGSALQKMKAMEQTLSKAQRTYPRCSQMTSKLRAMAHNSEELVRAHRSESSFLEQVAVRTLPKGHHCLAMRLTTEYFSLDPKERQFPKRDSRQLDGYYHYAIFSDNVLASAVVVNSTIAQSKDPGRIMLHIVTDALNCPAMMMWFLTNPPTPAAVEVESLDDFKWLPGDFSSRFKLKGVRDPRYTSALNHLRFYLPEVFPSLSKVLLLDHDVVIQTDLSELWGIDMKGKVIGAVETCSSGEGYHRLDNLVDFSNPTIVNKFDAKACIFAFGMNIFDLNEWRKQGLTATYHTWFQVGKRQRLWKAGSLPLGQLVFYNQTLPLDRRWHVLGLGHDFSIGRDELENAYVIHYSGKFNPGWKSPSQSTETTGIDTLTTIMHTCSSVTSTDRGDGGRGFTEYNMDTQFCSIVLISKLILFFFSLLFLDALFCI

SEQ ID NO: 13957 - protein, 400 aa, Arabidopsis thaliana
  misc_feature: Useful for making plants with altered cell wall content and/or composition
MTRQVIAEAKESFDNQLKIQKLKDTIFAVNEQLTNAKKQGAFSSLIAAKSIPKGLHCLAMRLMEERIAHPEKYTDEGKDRPRELEDPNLYHYAIFSDNVIAASVVVNSAVKNAKEPWKHVFHVVTDKMNLGAMQVMFKLKEYKGAHVEVKAVEDYTFLNSSYVPVLKQLESANLQKFYFENKLENATKDTTNMKFRNPKYLSILNHLRFYLPEMYPKLHRILFLDDDVVVQKDLTGLWEIDMDGKVNGAVETCFGSFHRYAQYMNFSHPLIKEKFNPKACAWAYGMNFFDLDAWRREKCTEEYHYWQNLNENRALWKLGTLPPGLITFYSTTKPLDKSWHVLGLGYNPSISMDEIRNAAVVHFNGNMKPWLDIAMNQFRPLWTKHVDYDLEFVQACNFGL

SEQ ID NO: 13958 - protein, 150 aa, Arabidopsis thaliana
  misc_feature: Useful for making plants with altered cell wall content and/or composition
MLKVVLLMMIMMLASQSEAQLNRDFYKESCPSLFLVVRRVVKRAVAREPRMGASLLRLFFHDCFVNGCDGSLLLDDTPSFLGEKTSGPSNNSVRGFEVIDKIKFKVEKMCPGIVSCADILAITARDSVLLVSTSTLLLFVMSYIDACNNC

SEQ ID NO: 13959 - protein, 333 aa, Arabidopsis thaliana
  misc_feature: Useful for making plants with modulated low light sensitivity
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 13960 - protein, 546 aa, Panicum virgatum
  misc_feature: Useful for making plants with altered carbohydrate content
MLRGTGHVGGDARRRALEHRRSARRRLPGWIWWLLGIFLLVGLMLFVLHHNQKEQFRPPVVDNGSEIEEVPHEKVNFTEELLSSTSFARQLADQMTLAKAYVILAKEHGNLQLAWELSSQIRNCQRLLSEGAVSGRAITRDEAHPIISRLARLIYKAQDAHYDISTTIVTLKSHALALEEHAKAAIVQSAEFGQLAAESFPKSLHCLTVKLTEEWLRNPKHRSRSEEQRNSTRLVDNNLYHFCIFSDNVLATSVVVNSTVSNANHPQQLVFHVVTDRIHFGAMSTWFLINDFKGCTVEVRCIDEFSWLNASSSPLVRQLSEVETQGYYYSAGSKHPEREIKFHNPKFVSLLNHLRFYIPQILPNLEKVVFLDDDVVVQKDLTQLFSIELHGNVIGAVETCLESFHRYHKYLNFSHPTISSKIDPHTCGWAFGMNIFDLIAWRKANATSLYHYWQEQNSDLLLWRTGTLPAGLLTFYGLMEPLDRRWHVLGLGYDVDIDDRLIESSAVVHYNGNMKPWLKLAIRRYKYIWERYVNFSHPYVRECMLH

SEQ ID NO: 13961 - protein, 536 aa, Arabidopsis thaliana
  misc_feature: Useful for making plants with altered cell wall content and/or composition
MRRRGGDSFRRAGRRKISNVVWWVLSGIALLLFFLILSKAGHIEPRPSIPKRRYRNDKFVEGMNMTEEMLSPTSVARQVNDQIALAKAFVVIAKESKNLQFAWDLSAQIRNSQLLLSSAATRRSPLTVLESESTIRDMAVLLYQAQQLHYDSATMIMRLKASIQALEEQMSSVSEKSSKYGQIAAEEVPKSLYCLGVRLTTEWFQNLDLQRTLKERSRVDSKLTDNSLYHFCVFSDNIIATSVVVNSTALNSKAPEKVVFHLVTNEINYAAMKAWFAINMDNLRGVTVEVQKFEDFSWLNASYVPVLKQLQDSDTQSYYFSGHNDDGRTPIKFRNPKYLSMLNHLRFYIPEVFPALKKVVFLDDDVVVQKDLSSLFSIDLNKNVNGAVETCMETFHRYHKYLNYSHPLIRSHFDPDACGWAFGMNVFDLVEWRKRNVTGIYHYWQEKNVDRTLWKLGTLPPGLLTFYGLTEALEASWHILGLGYTNVDARVIEKGAVLHFNGNLKPWLKIGIEKYKPLWERYVDYTSPFMQQCNFH

SEQ ID NO: 13962 - protein, 1046 aa, Arabidopsis thaliana
  misc_feature: Useful for making plants with modulated flowering time
MTSLSIQPFPEISRMARDLDSRKKRRISLDGIAALCEHSKEIIDSLPMLNSPDYFLKPCINELVEREIESPDYCSRVPDFTIGRIGYGYIRFLGNTDVRRLDLDHIVKFHRHEVIVYDDESSKPVVGEGLNKAAEVTLVVNIPDLTWGKQQVNHIAYKLKQSTERQGATFISFDPDNGLWKFFVPHFSRFGLSDDEAEDIAMDDAPGLGDPVGLDGKKVADIDEEDQMETSELELSHSLPAHLGLDPEKMKEMRMLMFPNEDEDESEDFREQTSHLMTSLTKRNVRPSQKIAQRNSHQDPPPVVRKTPLALLEYNPGNDKSSPGSILMVQQNKNLAVRKSKTGGFELDISHVTPLTDNYSRNVVDAALFMGRSFRAGWGPNGVLFHTGKPICSSSSQMVLSSVINKEKIAIDKVVWDRKGKVQKELIDSAFEAPLSLHKELNHVEEEVRFGSFSLKLQNVVTDRVVLSDICRSYIGIIEKQLEVAGLSTSAKLFLMHQVMVWELIKVLFSERQSTERLMYAASDNEEDVMQDVKEDSAKIDTEALPLIRRAEFSCWLQESVSHRVQEDVSDLNGSSYLEHLFFLLTGRELDSAVELAISKGDVRLACLLSQAGGSTVNRNDILQQLHLWRRNGLDFNFIEKERIKLYELLAGNIHDALQDFTIDWKRFLGLLMWHHLPPDSSLPIIFRSYQLLLNQAKAPWPVPIYIDEGPADGFVSDNKHSDILYYLMLLHSKEEEEFGFLQTMFSAFSSTDDPLDYHMIWHHRGILEAVGAFTSDDLHTLDMGFVAQLLSQGLCHWAIYVVLHIPFREDHPYLHVTVIREILFQYCETWSSMESQRQFIKDLGIPSEWMHEALAVYYNYHGDFVKALDQFIECANWQRAHSIFMTSVAHSLFLSANHSEIWRIATSMDDRKSEIENWDLGAGIYMSFYLLKSSLQEDADTMVELEPLDSTNESCRNFVGRLNESLAVWGDRLPVEARVAYSKMAEEICDLLLSDLSKNPSRETQLTCFETAFDAPLPEDVRSTHLQDAVSLFSLYLSETGQISA

SEQ ID NO: 13963 - protein, 533 aa, Arabidopsis thaliana
  misc_feature: Useful for making plants with altered cell wall content and/or composition
MELGDTTSVIPDSFMGYRDDITMQMSMVLDQIRAPLIVPALRLGVYICLTMSVMLFVERVYMGIVISLVKLFGRKPDKRFKYEPIKDDIELGNSAYPMVLIQIPMFNEREVYQLSIGAACGLSWPSDRIVIQVLDDSTDPTIKDLVEMECSRWASKGVNIKYEIRDNRNGYKAGALKEGMKKSYVKSCDYVAIFDADFQPEADFLWRTVPYLLHNPKLALVQARWKFVNSDECLMTRMQEMSLDYHFTVEQEVGSSTYAFFGFNGTAGIWRISALNEAGGWKDRTTVEDMDLAVRASLKGWKFLYLGSLKVKNELPSTFKAYRYQQHRWSCGPANLFRKMAFEIMTNKNVTLWKKVHVIYSFFVVRKLVAHIVTFIFYCVILPATVLVPEVTVPKWGAVYIPSVITLLNAVGTPRSLHLMVFWILFENVMSLHRTKATFIGLLEGGRVNEWIVTEKLGDVKAKSATKTSKKVIRFRFGDRIHVLELGVGMYLLFVGCYDAFFGKNHYYLYLFAQAIAFFIAGFGQIGTIVPNH

SEQ ID NO: 13964 - protein, 573 aa, Panicum virgatum
  misc_feature: Useful for making plants with altered carbohydrate content
MEAGEIGGALLFLLAVAGAVAAAVSVGAVDFSRPLAAGAPLGFQQAVSWLIGVLDGTSSAAADVYWAWVAVRAGVIAPVLQVAVWACMVMSVMLVVEAVYNSVVSLGVKAIGWRPEWRFKWEPLDGADEEKGRAHYPLVLVQIPMYNELEVYKLSIAAACELQWPKDRIIVQVLDDSTDPFIKNLVELECENWANKGVNIKYATRTSRKGFKAGALKKGMECDYARQSDYIAIFDADFQPEPDFLLRTVPFLVHNPEVALVQARWSFVNDTTSLLTRVQKMFFDYHFKVEQEAGSATFSFFSFNGTAGVWRTVAIKEAGGWKDRTTIEDMDLAVRATLKGWKFVYVGDVRVKSELPSTYKAYCRQQFRWSSGGAHLFRKMAKDVLVAKDVSLLKKSYMLYSFFLVRRVIAPTAACILYNIILPVSVTIPELYLPVWGVAYIPTVLTIVTAIRHPKNLHIMPFWILFESVMTVRRMRAALTGLLELEGFNQWDVTKKVGNDLEDSEVPLLQKTRKRLRDRVNFPEIGFSVFIFLCASYNLAFHGTTSYYIYLYLQGLAFLLLRLNFTGTCSCCQ

SEQ ID NO: 13965 - protein, 619 aa, Arabidopsis thaliana
  misc_feature: Useful for making plants with altered cell wall content and/or composition
MFPRVSMRRRSAEVSPTEPMEKGNGKNQTNRICLLVALSLFFWALLLYFHFVVLGTSNIDKQLQLQPSYAQSQPSSVSLRVDKFPIEPHAAPSKPPPKEPLVTIDKPILPPAPVANSSSTFKPPRIVESGKKQEFSFIRALKTVDNKSDPCGGKYIYVHNLPSKFNEDMLRDCKKLSLWTNMCKFTTNAGLGPPLENVEGVFSDEGWYATNQFAVDVIFSNRMKQYKCLTNDSSLAAAIFVPFYAGFDIARYLWGYNISRRDAASLELVDWLMKRPEWDIMRGKDHFLVAGRITWDFRRLSEEETDWGNKLLFLPAAKNMSMLVVESSPWNANDFGIPYPTYFHPAKDSEVFEWQDRMRNLERKWLFSFAGAPRPDNPKSIRGQIIDQCRNSNVGKLLECDFGESKCHAPSSIMQMFQSSLFCLQPQGDSYTRRSAFDSMLAGCIPVFFHPGSAYTQYTWHLPKNYTTYSVFIPEDDVRKRNISIEERLLQIPAKQVKIMRENVINLIPRLIYADPRSELETQKDAFDVSVQAVIDKVTRLRKNMIEGRTEYDYFVEENSWKYALLEEGQREAGGHVWDPFFSKPKPGEDGSSDGNGGTTISADAAKNSWKSEQRDKTQ

SEQ ID NO: 13966 - protein, 340 aa, Glycine max
  misc_feature: Useful for making plants with altered terpenoid content
MGVPERDPLAQLSLPPGFRFYPTDEELLVQYLCRKVAGHHFSLPIIAEVDLYKFDPWVLPGKAAFGEKEWYFFSPRDRKYPNGSRPNRVAGSGYWKATGTDKIITTEGRKVGIKKALVFYVGKAPKGSKTNWIMHEYRLLDSSRKHNLGTAKLDDWVLCRIYKKNSSAQKVEANLLAMECSNGSSPSSSSHVDDMLESLPEIDDRCFTLPRVNSVRTMQQQDEKFGFQNMGSGFFTDWVNPTDLDSVSEFGSGCQTQGMVNYDCNDLFVPSVPPFGHSHVNYMVGAPPSEEEVQSGVRTQQADGAACFQQNPNARLLPGSGDPFGFGFIMGQQVEFGFRD

SEQ ID NO: 13967 - protein, 326 aa, Panicum virgatum
  misc_feature: Useful for making plants with altered carbohydrate content
KGSEERLQGRRRSSPSIDTYMQGGGDQGGSLGMDVGFAGGAECSSSSAAAAAAAAAAAEAEERQLLKGEIAVHPLCEQLVTAHVGCLRVATPIDHLPLIDAQLAQSSGLLHSYAAHHRPFLSPHDKHDLDSFLAQYLMLLCSFREQLQQHVRVHAVEAVMACREIEQSLQDLTGATLEEGTGATMSEDEDEPPMLEGALDMGSDGQDMMGFGPLLPTDSERSLMERVRQELKIELKQGFKSRIEDVREEILRKRRAGKLPGDTTSILKQWWQQHSKWPYPTEDDKAKLVEETSLQLKQINNWFINQRKRNWHNNSQTSTLKSKRKR

SEQ ID NO: 13968 - protein, 437 aa, Panicum virgatum
  misc_feature: Useful for making plants with altered carbohydrate content
MAAAPHHHRGHLVLAVLSLAAAFAAAVDSSSHNITAVLDGRSEYTLYNSYLSETKVCDEINSEHTVTVLVLTNGAMSSLVANLSLAEIKNALRMLTLLDYFDEKKLHSLDSGSELTTSLYQKTGQAAGNMGHVNITDLRGGKVGFASAAPGAKFQSTYTKRVDTEPSTLSVLEVSDPITFPGLFGSPSASSVNLTDILDKAGCKQFARLIVSSGVVKMYQAAMDKALTLLAPNDDAFKAKGLPDLSKLSSADLVTLLQYHALPQYAPKASLKVAKGDIPTLASTGAGKYGLSVVSSGDDVSLDTGLGKSRVASTVLDDTPTVILTVDKLLLPSELFGGAPSPAPAPGPAADVPASAPAPETSAPAPSPKAAAKKKKAKSPSHSPPAPPADSPDLAPADAPEGDAEDKADSKKNGAAAAAVSLAATVACIALAVAAFL

SEQ ID NO: 13969 - protein, 425 aa, Arabidopsis thaliana
  misc_feature: Useful for making plants with altered cell wall content and/or composition
MYERYTTPIKCDSTRVSMSVKEGQSIVFSYEVSFEESDIKWPSRWDAYLKMEGSKVHWFSILNSLMVITFLAGIVLVIFLRTVRRDLTRYEELDKEAQAQMNEELSGWKLVVGDVFRAPSNASLLCVMVGDGVQILGMAVVTILFAALGFMSPASRGTLITGMLFFYMILGIAAGYVSVRLWRTIGCGEHRGWMSVAWKAACFFPGIAFLILTTLNFLLWGSHSTGAIPFSLFVILLLLWFCISVPLTLIGGYFGAKAPHIEFPVRTNQIPREIPAQKYPSWLLVLGAGTLPFGTLFIELFFIMSSIWMGRVYYVFGFLFVVLILLVVVCAEVSLVLTYMHLCVEDYKWWWKSFFASGSVAIYIFIYSINYLVFDLKSLSGPVSATLYLGYSLFMVLAIMLATGTVGFLSSFWFVHYLFSSVKLD

SEQ ID NO: 13970 - protein, 271 aa, Panicum virgatum
  misc_feature: Useful for making plants with altered carbohydrate content
MASAMIATKVASLAAALIFSLLVTYGSCASPPPVNLNASAFTADPNWEAARATWYGAPTGAGPYDDGGACGFKNVNLPPFSSMTSCGNQPLFKDGKGCGSCYQIRCTKHAACSGNPETVIITDMNYYPVAKYHFDLSGTAFGAMAKPGRNEELRHAGIIDIQFKRVPCNYPGQKVTFHVEEGSNAVYLAVLVEFEDGDGDVVQVDLMEANSGSWAPMRESWGSIWRMDSNHRLQAPFSLRVTNESGRKLVASRVIPANWAPNNYYRSIIQY

SEQ ID NO: 13971 - protein, 350 aa, Glycine max
  misc_feature: Useful for making plants with modulated flowering time
MMLGEHHRGNPTVLVPPWPAHDDPTAEMYSAFLTNDVNAGEYSPYHLQEALTALQRFLPSNETDADSDSSEAAQPDAAVDAYTCDHFRMYEFKVRRCARGRSHDWTECPYAHPGEKARRRDPRRFHYSGVACPEFRKGNCRKGDACEFAHGVFECWLHPARYRTQPCKDGTSCRRRVCFFAHTPEQLRVLPMQSPRSVANSSESYDGSPMRQVSLSSAAAAAFMSSPAASLSPPESPPSVNEMVASLRNLQLGKMKSMPHNRNVSVGSPRGSVLRPGFLSLPTTPTQQPVRSGVKCFDVWDESFEEEPVMERVESGRGIRAKMFEKLSKENSLDASASPPDLGWVSELVK

SEQ ID NO: 13972 - protein, 359 aa, Arabidopsis thaliana
  misc_feature: Useful for making plants with modulated nitrogen use efficiency
MMIGESHRGFNPTVHIPPWPLSEDLTVSDIYGSPDGGSSMMEALAELQRYLPSNEPDPDSDPDLSGPDSPIDAYTCDHFRMYEFKVRRCARGRSHDWTECPYAHPGEKARRRDPRKFHYSGTACPEFRKGCCKRGDACEFSHGVFECWLHPARYRTQPCKDGGNCRRRVCFFAHSPDQIRVLPNQSPDRVDSFDVLSPTIRRAFQFSISPSSNSPPVSPRGDSDSSCSLLSRSLGSNLGNDVVASLRNLQLNKVKSSLSSSYNNQIGGYGSGFGSPRGSVLGPGFRSLPTTPTRPGFMNIWENGLEEEPAMERVESGRELRAQLFEKLSKENCMGRIEPDPDQGAGDTPDVGWVSDLVM

SEQ ID NO: 13973 - protein, 272 aa, Oryza sativa
  misc_feature: Useful for biocontainment applications
MHIYKEQEAEPSTGLMMPEPAPVASPGSGGSGGSGSVGAEKIGSRGKIEIKRIENTTNRQVTFCKRRSGLLKKAYELSVLCDAEVALVVFSSRGRLYEYSNNSVKETIERYKKANSDTSNASTVAEINAQHYQQEAAKLKQQITNLQNSNRTLVGDNITTMNHRELKQLEGRLDKGLGKIRARKNELLCAEIEYMQRRETELQNDNMYLKSKVAESERGLQTVNMMGSASTSEYVQNMIHYDPRNFLQFNIMHQPQYYPEQEDRKAFMSDER

SEQ ID NO: 13974 - protein, 642 aa, Panicum virgatum
  misc_feature: Useful for making plants with altered carbohydrate content
MSGGSGPLPYSMRDVGAGGAYNNAKFRHRSRLKMFVQSLATNSSKYRCGKFTVGKFLSLLMVSGLLYLFLHKSPEGLVPDELHGKEVNNNNVRRAPSIRTFWRKAPRLPPRLPPNEIYKNNSLLQQSPSEWTSRQKKVKEAFEHAWSGYRNYAMGYDELMPLSHRGTDGLGGLGATIVDSLDTAIIMGADDVVSEASKWIEENLMKRISEKGQVNLFETTIRVLGGLLSAYHLSGGDHAGSVDSGIPASYKKANPERLLEVSKDLADRLLLAFTSSPTAIPLSDVILRDRTAHAAPDGLSSTSEASTLQLEFSYLSRVSGDPKYDREAMKVLEHMRTLPKVQGLVPIYINPSSGQFSGENIRLGSRGDSYYEYLLKVWIQQVESRDSSLKYLFEMYTEAMRGVKHLLVRKTVPNKLVFVGELPFGRNGDFSPKMDHLVCFLPGTLALGATKGITKKKALESNLLTDEDIENLQLAEDLAKTCVEMYFVTSTGLAPEIAYFHIEGNPEGGPDGGNKSNKYVNDIIIKPLDRHNLLRPETVESLFVLHRITEDPKYREWGWQIFQAFEKYTKVDSGGYSSLDDVTSLPPHRRDKMETFFLGETLKYLYLLFDESNTLPLDKYVFNTEAHPLPVMRSMEQASHSV

SEQ ID NO: 13975 - protein, 742 aa, Arabidopsis thaliana
  misc_feature: Useful for making plants with modulated heat sensitivity
MLGPSLLGRSKAFLDAVFPKKSLTVLETLANLGLLFFLFLAGLEIDTKALRRTGKKALGIALAGITLPFALGIGSSFVLKATISKGVNSTAFLVFMGVALSITAFPVLARILAELKLLTTEIGRLAMSAAAVNDVAAWILLALAIALSGSNTSPLVSLWVFLSGCAFVIGASFIIPPIFRWISRRCHEGEPIEETYICATLAVVLVCGFITDAIGIHSMFGAFVVGVLIPKEGPFAGALVEKVEDLVSGLFLPLYFVASGLKTNVATIQGAQSWGLLVLVTATACFGKILGTLGVSLAFKIPMREAITLGFLMNTKGLVELIVLNIGKDRKVLNDQTFAIMVLMALFTTFITTPVVMAVYKPARRAKKEGEYKHRAVERENTNTQLRILTCFHGAGSIPSMINLLEASRGIEKGEGLCVYALHLRELSERSSAILMVHKVRKNGMPFWNRRGVNADADQVVVAFQAFQQLSRVNVRPMTAISSMSDIHEDICTTAVRKKAAIVILPFHKHQQLDGSLETTRGDYRWVNRRVLLQAPCSVGIFVDRGLGGSSQVSAQDVSYSVVVLFFGGPDDREALAYGLRMAEHPGIVLTVFRFVVSPERVGEIVNVEVSNNNNENQSVKNLKSDEEIMSEIRKISSVDESVKFVEKQIENAAVDVRSAIEEVRRSNLFLVGRMPGGEIALAIRENSECPELGPVGSLLISPESSTKASVLVIQQYNGTGIAPDLGAAETEVLTSTDKDSD

SEQ ID NO: 13976 - protein, 428 aa, Panicum virgatum
  misc_feature: Useful for making plants with altered carbohydrate content
MAVEKTAPAAAAGAAAAGRTVLVTGGAGYIGSHAVLQLLLAGFRAVVVDNLNNSSELAVRRVAALAGDHSRNLSFHKVDLRDKGALEMVFASTRFDAVVHFAGLKAVGESVQKPLLYYDNNVIGTINLLEVMSAHGCKKLVFSSSAAVYGSPKNSPCTEEFPLTPNNPYGKTKLVVEDICRDIYRSDPEWKIILLRYFNPVGAHPSGYLGEDPCGIPNNLMPYVQQVAVGRRPALTVLGNDYATRDGTGIRDYIHVVDLADGHIAALHKLFENPSIGCEAYNLGTGRGTSVLEIVKAFEKASGKKIPLIFGARRPGDAEILFSVTAKAERELNWKAKYGIDEMCRDQWNWASKNPYGYVSPDSTKQNGHQTNGSVDSSRQNGHHTNRSVGSTRWNGHCGYGSADSPKRNGHYAYGSSDSRQNGNGRLQ

SEQ ID NO: 13977 - protein, 351 aa, Arabidopsis thaliana
  misc_feature: Useful for making plants with altered cell wall content and/or composition
MMARNVLVSGGAGYIGSHTVLQLLLGGYSVVVVDNLDNSSAVSLQRVKKLAAEHGERLSFHQVDLRDRSALEKIFSETKFDAVIHFAGLKAVGESVEKPLLYYNNNLVGTITLLEVMAQHGCKNLVFSSSATVYGSPKEVPCTEEFPISALNPYGRTKLFIEEICRDVYGSDPEWKIILLRYFNPVGAHPSGDIGEDPRGIPNNLMPFVQQVAVGRRPHLTVFGNDYNTKDGTGVRDYIHVIDLADGHIAALRKLEDCKIGCEVYNLGTGNGTSVLEMVDAFEKASGKKIPLVIAGRRPGDAEVVYASTERAESELNWKAKYGIEEMCRDLWNWASNNPYGYDSSSEDNSH

SEQ ID NO: 13978 - protein, 367 aa, Arabidopsis thaliana
  misc_feature: Useful for making plants with modulated nitrogen use efficiency
MKERQRWSGEEDALLRAYVRQFGPREWHLVSERMNKPLNRDAKSCLERWKNYLKPGIKKGSLTEEEQRLVIRLQEKHGNKWKKIAAEVPGRTAKRLGKWWEVFKEKQQREEKESNKRVEPIDESKYDRILESFAEKLVKERSNVVPAAAAAATVVMANSNGGFLHSEQQVQPPNPVIPPWLATSNNGNNVVARPPSVTLTLSPSTVAAAAPQPPIPWLQQQQPERAENGPGGLVLGSMMPSCSGSSESVFLSELVECCRELEEGHRAWADHKKEAAWRLRRLELQLESEKTCRQREKMEEIEAKMKALREEQKNAMEKIEGEYREQLVGLRRDAEAKDQKLADQWTSRHIRLTKFLEQQMGCRLDRP

SEQ ID NO: 13979 - protein, 540 aa, Panicum virgatum
  misc_feature: Useful for making plants with altered carbohydrate content
MNLWFIFLLPLLCLPARVRSEDYSDVTVIVRGSETIASTSDEFVCATIDWWPPEKCNYDQCPWGRASVLNLDLTNPLLAKAIQAFSPLRIRVGGSLQDQVLYGTPNLGSPCDPFTKVSGGLFGFSQGCITLERWDAINDLFLNTGAVVTFGLNALQGRRQISRSVWGGPWNSSNAREFMEYTVSMNYPIDSWEFGNELSGSGIGASVGAEQYGKDLVELQTIINELYGDSRKPLVVAPGGFYDQKWFAQLLKVSGPNVLNAMTHHIYNLGAGNDPQVPDRILNPQYLSRTSDTFRSLQLTIQRHGPWSAPWVGEAGGAYNSGSRLVSNTFLNSFWYLDQFGQSAKYDTKVYCRQTLIGGNYGLLDTDTFVPNPDYYSALLWHRLMGTGVLSTDISGSSYLRAYVHCGKQKGGVALLLLNLHQSMGFMVSVRNDLNVNLAEGQGIRRDNVFVHGFKRTVSWVGSKASDGYSKREEYHLSAKDGNPFARTMLLNGVPLELTEDGDIPPLYPVEVSVNSPIYVAPLTIAFVVFPDFEAEACGR

SEQ ID NO: 13980 - protein, 533 aa, Arabidopsis thaliana
  misc_feature: Useful for making plants with altered cell wall content and/or composition
MQLHISPSMRSITISSSNEFIDLMKIKVAARHISYRTLFHTILILAFLLPFVFILTAVVTLEGVNKCSSFDCFGRRLGPRLLGRIDDSEQRLVRDFYKILNEVSTQEIPDGLKLPESFSQLVSDMKNNHYDAKTFALVFRAMVEKFERDLRESKFAELMNKHFAASSIPKGIHCLSLRLTDEYSSNAHARRQLPSPELLPVLSDNAYHHFVLATDNILAASVVVSSAVQSSSKPEKIVFHVITDKKTYAGMHSWFALNSVAPAIVEVKSVHQFDWLTRENVPVLEAVESHNSIRNYYHGNHIAGANLSETTPRTFASKLQSRSPKYISLLNHLRIYLPELFPNLDKVVFLDDDIVIQKDLSPLWDIDLNGKVNGAVETCRGEDVWVMSKRLRNYFNFSHPLIAKHLDPEECAWAYGMNIFDLRTWRKTNIRETYHSWLKENLKSNLTMWKLGTLPPALIAFKGHVQPIDSSWHMLGLGYQSKTNLENAKKAAVIHYNGQSKPWLEIGFEHLRPFWTKYVNYSNDFIKNCHILE

SEQ ID NO: 13981 - protein, 562 aa, Panicum virgatum
  misc_feature: Useful for making plants with altered carbohydrate content
MQLRISPSMRSITISSSNGVVDSMKVRVAPQPPPPPPPPLGPGRRGGGGGWGAGWYWRAVAFPAVVALGCLLPFAFILAAVPALEAGGSKCSSIDCLGRRIGPNFLGRQGGDSARLVQDLYRIFDQVNNEESPSNEKLPESFRDFLLEMKDNHYDARTFAVRLKATMESMDKEVKGSRLAEQLYKHYAATAIPKGIHCLSLRLTDEYSSNAHARKQLPPPELLPLLSDNSFQHYILASDNILAASVVVSSTIRSSSVPEKVVFHVITDKKTYPGMHSWFALNSISPAIVEVKGVHQFDWLTRENVPVLEAIENHRGVRNHYHGDHGTVSSASDNPRVLASKLQARSPKYISLLNHLRIYLPELFPNLNKVVFLDDDIVVQRDLSPLWDINLEGKVNGAVETCRGEDNWVMSKRFRTYFNFSHPVISRSLDPDECAWAYGMNIFDLAAWRKTNIRDTYHFWLKENLKSGLTLWKFGTLPPGLIAFRGHVHGIDPSWHLLGLGYQEKTDIDSVRRSAVIHYNGQCKPWLDIAFKNLQPFWARHVNYSNDFVRNCHILEPQYDKE

SEQ ID NO: 13982 - protein, 190 aa, Arabidopsis thaliana
  misc_feature: Useful for making plants with modulated flowering time
  misc_feature: Useful for making plants with modulated low light sensitivity
  misc_feature: Useful for making plants with modulated nitrogen use efficiency
MDLISHQPNKNPNSSTQLTPPSSSRYENQKRRDWNTFCQYLRNHRPPLSLPSCSGAHVLEFLRYLDQFGKTKVHHQNCAFFGLPNPPAPCPCPLRQAWGSLDALIGRLRAAYEENGGPPEANPFGSRAVRLFLREVRDFQAKARGVSYEKKRKRVNRQKPQTQPPLQLQQQQQQPQQGQSMMANYSGATV

SEQ ID NO: 13983 - protein, 191 aa, Arabidopsis thaliana; identical to SEQ ID NO: 13339
  misc_feature: Useful for biocontainment applications

SEQ ID NO: 13984 - protein, 765 aa, Arabidopsis thaliana
  misc_feature: Useful for making plants with altered cell wall content and/or composition
MASHIVGYPRMGPKRELKFALESFWDGKSTAEDLQKVSADLRSSIWKQMSAAGTKFIPSNTFAHYDQVLDTTAMLGAVPPRYGYTGGEIGLDVYFSMARGNASVPAMEMTKWFDTNYHYIVPELGPEVNFSYASHKAVNEYKEAKALGVDTVPVLVGPVSYLLLSKAAKGVDKSFELLSLLPKILPIYKEVITELKAAGATWIQLDEPVLVMDLEGQKLQAFTGAYAELESTLSGLNVLVETYFADIPAEAYKTLTSLKGVTAFGFDLVRGTKTLDLVKAGFPEGKYLFAGVVDGRNIWANDFAASLSTLQALEGIVGKDKLVVSTSCSLLHTAVDLINETKLDDEIKSWLAFAAQKVVEVNALAKALAGQKDEALFSANAAALASRRSSPRVTNEGVQKAAAALKGSDHRRATNVSARLDAQQKKLNLPILPTTTIGSFPQTVELRRVRREYKAKKVSEEDYVKAIKEEIKKVVDLQEELDIDVLVHGEPERNDMVEYFGEQLSGFAFTANGWVQSYGSRCVKPPVIYGDVSRPKAMTVFWSAMAQSMTSRPMKGMLTGPVTILNWSFVRNDQPRHETCYQIALAIKDEVEDLEKGGIGVIQIDEAALREGLPLRKSEHAFYLDWAVHSFRITNCGVQDSTQIHTHMCYSHFNDIIHSIIDMDADVITIENSRSDEKLLSVFREGVKYGAGIGPGVYDIHSPRIPSSEEIADRVNKMLAVLEQNILWVNPDCGLKTRKYTEVKPALKNMVDAAKLIRSQLASAK

SEQ ID NO: 13985 - protein, 433 aa, Panicum virgatum
  misc_feature: Useful for making plants with altered carbohydrate content
MASTKLQLVFLAPFLALLFSSGALGAAAAATTNNGTAAAVGGSSSLASAQSGVFFSLDSFGARGDGSHDDAPALARAWKAACASPRPAVLLVPGGGKRYLLSSVVKLSGPCRSASVTVTVQGTLVASPNRADWSGKDTRHWIVFRAVDGLTVSGGGVIDGNGEAWWKNSCKINKALPCKEAPTALSFHYCTSLRVQELKIVNSQQIHMSIEDCSNVQVAGLSITAPGTSPNTDGIHITRSNDVQVTNCKIKTGDDCISIENGTHNLHVSQVVCGPGHGISIGSLGDDNSRAEVSGITIDSVQLYGTTNGARIKTYQGGSGYARDIAFQNMVMSGVRNPIIIDQNYCDKAKPCREQGSSAVEVSNVVFRNIRGTSTTKDAIKLSCSKNAPCHGITLQNIDLEMEGGNGAAESPCQNARWRKAGTVLPQPCTSQN

SEQ ID NO: 13986 - protein, 374 aa, Arabidopsis thaliana
  misc_feature: Useful for making plants with altered cell wall content and/or composition
MGDEAEIKEHLKPQASSETIDKKHNVKGKRLWQKVKYQLVEFHSLPAYLRDNEYIIGHYRSEWPIKQILLSIFTIHNETLNVWTHLIGFFLFLALTIYTATKVPSVVDLHSLQHRLPDLLRKTDLHKLHSELMSRLPSSPSSWHVMDLLYNCLPERFSHGNYTDMCVLHSVREDLANLIAPLIFRPITRWPFYAFLGGAIFCLLASSTCHLLSCHSERVSYIMLRLDYAGIAALIATSFYPPVYYSFMCDPFFCNLYLGFITILGIATVLVSLLPVFQSLEFRVVRASLFFGMGFSGLAPILHKLIIFWDQPEALHMTGYEILMGLLYGLGAVVYATRIPERWMPGKFDIAGHSHQLFHVLVVAGALTHYRAGL

SEQ ID NO: 13987 - protein, 186 aa, Panicum virgatum
  misc_feature: Useful for making plants with altered carbohydrate content
MFCLLASSTCHLLSCHSRRLAYIMLRLDYAGIAALIATSFYPPVYYSFMCYPFFCNLYLSFITILGVATIAFSLLPVFQNPEFRTIRACLFFGMGASGVIPVLHKLVLFWHQPEALHTTGYEVLMGLFYGLGALVYATRVPERWMPGKFDIAGHSHQLFHVLVVAGAYTHYHAGLLYLKWRDLQGC

SEQ ID NO: 13988 - protein, 518 aa, Arabidopsis thaliana
  misc_feature: Useful for biocontainment applications
  misc_feature: Useful for making plants with modulated nitrogen use efficiency
MASISTPFPISLHPKTVRSKPLKFRVLTRPIKASGSETPDLTVATRTGSKDLPIRNIPGNYGLPIVGPIKDRWDYFYDQGAEEFFKSRIRKYNSTVYRVNMPPGAFIAENPQVVALLDGKSFPVLFDVDKVEKKDLFTGTYMPSTELTGGYRILSYLDPSEPKHEKLKNLLFFLLKSSRNRIFPEFQATYSELFDSLEKELSLKGKADFGGSSDGTAFNFLARAFYGTNPADTKLKADAPGLITKWVLFNLHPLLSIGLPRVIEEPLIHTFSLPPALVKSDYQRLYEFFLESAGEILVEADKLGISREEATHNLLFATCFNTWGGMKILFPNMVKRIGRAGHQVHNRLAEEIRSVIKSNGGELTMGAIEKMELTKSVVYECLRFEPPVTAQYGRAKKDLVIESHDAAFKVKAGEMLYGYQPLATRDPKIFDRADEFVPERFVGEEGEKLLRHVLWSNGPETETPTVGNKQCAGKDFVVLVARLFVIEIFRRYDSFDIEVGTSPLGSSVNFSSLRKASF

SEQ ID NO: 13989 - protein, 949 aa, Arabidopsis thaliana
  misc_feature: Useful for making plants with altered cell wall content and/or composition
MRLRHQGGQYLARGMEPVYWSNKVDSTHDLYDNYTLGSYQNNSYNILAHTGFGYDHEFQIYEINSNSWRIIDATLDFKLGYIGRGVSLKGKTYWIASGEEEKRLGKFLISFDYTTERFERLCLPNKYPCYATLALSVVREEKLSMLSQRGIKSKAEIWVTNKIGETQVVSWSMVLALDLQPKRCIGESGSFLVDEKKRVVVCCDNIRDQGKTTFDSNLPRYHRQKKKGRMIIVFDVESMRLPVTVKATKPSFLVIWIRYSSAASSPTVSLNPSGRLQQTLAGSVEVKGKSLHSGKFSTVKLNPEIAGAGRFFEFRSRFIPASIEFAQESPLCTTLLKDELKIRTVEHLLSALEAKGVDNCRIQIESESSDDREVEVSKEWVDAIQGVGINAAQNHDGESVEKMVAHVNKPVYVCKNDTFVAAFPALETRITCGIDFPQVPAIGCQWFSWRPIHESSFAKDIASSRTFCVYEEVERMREAGLIKGGSLDNAIVCSAEHGWMNPPLRFDDEACRHKILDLIGDLSLVSRGGNGGLPVAHIVAYKNEEEEVRSSTEENENVRSSTEENEYVRSSTEAGRGEDPHEDSDNISESGAIHLQIMERFNQRSGSGKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 13990 - protein, 532 aa, Arabidopsis thaliana
  misc_feature: Useful for making plants with altered cell wall content and/or composition
MQLHISPSMRSITISSSNEFIDLMKIKVAARHISYRTLFHTILILAFLLPFVFILTAVVTLEGVNKCSSIDCLGRRIGPRLLGRVDDSERLARDFYKILNEVSTQEIPDGLKLPNSFSQLVSDMKNNHYDAKTFALVLRAMMEKFERDMRESKFAELMNKHFAASSIPKGIHCLSLRLTDEYSSNAHARRQLPSPEFLPVLSDNAYHHFILSTDNILAASVVVSSAVQSSSKPEKIVFHIITDKKTYAGMHSWFALNSVAPAIVEVKGVHQFDWLTRENVPVLEAVESHNGVRDYYHGNHVAGANLTETTPRTFASKLQSRSPKYISLLNHLRIYIPELFPNLDKVVFLDDDIVVQGDLTPLWDVDLGGKVNGAVETCRGEDEWVMSKRLRNYFNFSHPLIAKHLDPEECAWAYGMNIFDLQAWRKTNIRETYHSWLRENLKSNLTMWKLGTLPPALIAFKGHVHIIDSSWHMLGLGYQSKTNIENVKKAAVIHYNGQSKPWLEIGFEHLRPFWTKYVNYSNDFIKNCHILE

SEQ ID NO: 13991 - protein, 184 aa, Arabidopsis thaliana
  misc_feature: Useful for making plants with altered terpenoid content
MGLWDSLLNWLRSLFFKQEMELSLVGLQNAGKTSLVNAIATGGYSEDMIPTVGFNMRKVTKGNVTIKIWDLGGQRRFRTMWERYCRGVSAIVYVIDAADRDSVPISRSELNDLLTKPSLNGIPLLILGNKIDKSEALSKQALVDQLGLESVTDREVCCYMISCKDSINIDAVIDWLIKHSRTAT

SEQ ID NO: 13992 - protein, 492 aa, Arabidopsis thaliana
  misc_feature: Useful for making plants with altered cell wall content and/or composition
MARKSLIFPVILLAVLLFSPPIYSAGHDYRDALRKSILFFEGQRSGKLPPDQRLKWRRDSALRDGSSAGVDLSGGYYDAGDNIKFGFPMAFTTTMLSWSIIDFGKTMGPELRNAVKAVKWGTDYLLKATAIPGVVFVQVGDAYSDHNCWERPEDMDTLRTVYKIDRAHPGSDVAGETAAALAAASIVFRKRDPAYSRLLLDRATRVFAFANRYRGAYSNSLYHAVCPFYCDFNGYQDELLWGAAWLHKASRKRAYREFIVKNEVILKAGDTINEFGWDNKHAGINVLISKEVLMGKAEYFESFKQNADGFICSILPGISHPQVQYSRGGLLVKTGGSNMQHVTSLSFLLLAYSNYLSHAKKVVPCGELTASPSLLRQIAKRQVDYILGDNPMGLSYMVGYGQKFPRRIHHRGSSVPSVSAHPSHIGCKEGSRYFLSPNPNPNLLVGAVVGGPNVTDAFPDSRPYFQQSEPTTYINAPLVGLLGYFSAHSTWR

SEQ ID NO: 13993 - protein, 511 aa, Panicum virgatum
  misc_feature: Useful for making plants with altered carbohydrate content
MPAAARSVKELAAAGVVLAMLLSAAAAQHDYGDALHKCILFFEGQRSGRLPPDQRVRWRRDSGLHDGAAAGVDLTGGYYDAGDNVKFEFPMAFTATLMSWGLIDFGRSFGPNREEARKAVRWATDYLMKATARPNTVYVQVGDAFRDHACWERPEDMDTPRTVYKVDPSHPGSDVAAETAAALAAASIVFRDSDPGYSKRLLDRAVAVFEFADKHRGPYSSSLHAAVCPCYCDYSGYQDELLWGAAWLHKASRRREYREYIKRNEVVLGASDAINEFGWDNKHAGINVLISKEVLMGKDEYFQSFRVNADNFMCTLLPGISNHPQIQYSPGGLLFKVGSSNMQHVTQLSFLLLAYSNYLSHAGGRVSCGSSSASPAQLRRVAKRQVDYILGDNPLRMSYMVGYGARFPRRMSTTAPARCRRWRRTRRGSAARPAPPTTPARRPTRTCSSAPSSAGPATPLTPSRTRAPCSSSRSPPRTSTRRSWASSPTSRPTPTRPTPAATENIGLRMEW

SEQ ID NO: 13994 - protein, 201 aa, Panicum virgatum
  misc_feature: Useful for making plants with altered carbohydrate content
MGGASDLPPGFHFFPSDEELIVHFLRRKASLLPCQPDIVPTILLNHYDPWELNDKALQAGNQWYFFSHATQSRVTPNGYWSSICADETVKSGGCNIGLKKTLVFSIGESSEGIETNWIMHEYHLLDGGKVCSSSTSTSSSRKLHREKGHSNTESDNWVICRVFDSTCGSQANFHEEGMELSCLDEVFLSLDDYDEVSLSNN

SEQ ID NO: 13995 - protein, 471 aa, Arabidopsis thaliana
  misc_feature: Useful for making plants with altered cell wall content and/or composition
MTILVVDRYYMLMNLLFALTCLLLNLTHCFSPKKFNISAATTSDSDWSIAGSTWYGNPTGYGSDGGACGYGNAVAQPPFSKMVSAGGPSLFKSGKGCGACYQVKCTSKSACSKNPVTVVITDECPGCVKESVHFDLSGTAFGAMAISGQDSQLRNVGELQILYKKVECNYIGKTVTFQVDKGSNANSFAVLVAYVNGDGEIGRIELKQALDSDKWLSMSQSWGAVWKLDVSSPLRAPLSLRVTSLESGKTVVASNVIPANWQPGGACGFAVANPPLYGMVSAGGPSVFNNGIGCGTCFQILCNGHPACSRRPITVTITDECPGGPCASEPAHFDLSGKAMGALARPGQGDRLRSAGVLRVYYRRVECLYRRTNIAFRMDPGANPYYISFVVEYENGDGDLAYIEIQPADGEFIPMQEMRSAVWKISSGSPLTGPFNIRLTSAESHKVVLAYNVIPANWKPNETYRSVVNFK

SEQ ID NO: 13996 - protein, 148 aa, Arabidopsis thaliana
  misc_feature: Useful for biocontainment applications
MASKRILKELKDLQKDPPTSCSAGPVAEDMFHWQATIMGPAESPYSGGVFLVTIHFPPDYPFKPPKVAFRTKVFHPNINSNGSICLDILKEQWSPALTISKVLLSICSLLTDPNPDDPLVPEIAHMYKTDRAKYKATARNWTQKYAMG

SEQ ID NO: 13997 - protein, 359 aa, Arabidopsis thaliana
  misc_feature: Useful for making plants with altered cell wall content and/or composition
MGKVLQKEAFGLAAKDNSGVLSPFSFTRRETGEKDVRFKVLFCGICHSDLHMVKNEWGMSTYPLVPGHEIVGVVTEVGAKVTKFKTGEKVGVGCLVSSCGSCDSCTEGMENYCPKSIQTYGFPYYDNTITYGGYSDHMVCEEGFVIRIPDNLPLDAAAPLLCAGITVYSPMKYHGLDKPGMHIGVVGLGGLGHVGVKFAKAMGTKVTVISTSEKKRDEAINRLGADAFLVSRDPKQIKDAMGTMDGIIDTVSATHSLLPLLGLLKHKGKLVMVGAPEKPLELPVMPLIFERKMVMGSMIGGIKETQEMIDMAGKHNITADIELISADYVNTAMERLEKADVRYRFVIDVANTLKPNPNL

SEQ ID NO: 13998 - protein, 490 aa, Panicum virgatum
  misc_feature: Useful for making plants with altered carbohydrate content
MGLAKVAVGCPRLEKLSVKWCREISDIGIDLLAKKCPELRSLNISYLKVGNESLRSISTLEKLEELAMVGCSCIDDEGLELLSKGSDSLQSVDVSRCDHVTYQGLASLIDGRKFLQKLHAADCLHEIGQCFLSKLATLKETLTVLKLDGLGVSDSLLQAFGEGCNNLVEIGLSKCSGVTDEGISSLVARCSDLKTINLTCCNLITNNALNSIADNCKMLECLLLESCSLINEKGIKQIATCCPNLKEIDLTDCGVNDAALEYLAKCSELRILKLGLCSSISDKGIAFISSNCGKLVELDLYRCNSFTDDGLAALANGCKKIKLLNLCYCNKITDSGLGHLGSLEELTNLELRCLVRITCIGISSIAIGCKSLIELDLKRCYSVDDASLEALARNALNLRQLTISYCQVTGLGLCHLLSSLRCLQDIKMVHLSWVSIEGFEMALRAACGRLKKLKMLTGLKTVLSPELLQMLQACGCRIRWVNKPLVYKDC

SEQ ID NO: 13999 - protein, 346 aa, Panicum virgatum
  misc_feature: Useful for making plants with altered carbohydrate content
MQIREGPARRAAPSAAGALRLPMSAMMLAMFATMASFYIAGRLWQDAQNRVYLIKELDRRTGQGQSAISVDDTLKVVACRQQGKRLASLEMELAAAKHEGFVGKYTPETNGTHSRKKPLIVIGIMSSFGRKNYRDAVRKSWLPTGSMLKKLEEEKGIVVRFIVGRSANRGDTFDREIDDENRSTKDFLILDDHIESDEELPKKTKSFFANAAETFDAAFYAKVNDDIYINVDTLSAMLETHWDKPRVYIGCMKSGEVFSDSTHKWYEPDWWKFGDGKSYFRHASGEMFVISRAVAQFISINRSLLRTYAHDDVSVGSWMIGLAVKHVNEAKLCCSSWPSGAMCSAL

SEQ ID NO: 14000 - protein, 863 aa, Panicum virgatum
  misc_feature: Useful for making plants with altered carbohydrate content
MVSKSYSNLLDMTTGDGFDFRQPFKSLPRVVTSPGFISDPDWDTRSDGDSVGSASSTEKKIIVANFLPLNCTRDEAGQLSFSLDDDALLVQLKHGFSNETDVVYVGSLKVQVDPSEQDQVAQKLLREYRCIPTFLPSDLQQQFYHGFCKQQLWPLFHYMLPICLDKGELFDRNLFQAYVRANKLFADKVMEAINTDDDYVWVHDYHLMLLPTFLRKRLHRIKLGFFLHSPFPSSEIYRTLPVRDEIRKSLLNADLIGFQTFDYARHFLSCCSRLLGLHYESKRGYIGIEYFGRTVSLKILSVGVHVGRLESVLKLPATVSKVQEIEQRYKGKMLMLGVDDMDIFKGISLKLLGLELLLERNPKLIEKVVLVQIINPARSTGKDVQEAITETVSVAERINRKYGSSGYKPVVLIDHCIPFSEKIAFYAASDCCIVNAVRDGMNLVPYEYTVCRQGNNEIDRLRGLDKDTSHTSTLIVSEFVGCSPSLSGAFRVNPWSVDDVADALCQATDLTESEKQLRHEKHYRYVSTHDVAYWAHSFAQDLERACKDHYSRRCWAIGFGLNFRVIALSPVFRKLSSEHFVSCYNKPSRRAIFLDYDGTLVPQSSINKAPSAEVVSILNTLCNDPKNNVFIVSGRGRDSLDEWFSPCEKLGIAAEHGYFIRWSKEAEWESSYPSPQREWKHIAEPVMQVYTETTDGSSIEPKESALVWHYLDADHNFGSCQAKELQDHLERVLSNEPVVVKCGHYIVEVKPQGVSKGLAVDKLIRTLVNNGKAPDFLMCIGNDRSDEDMFESINSMTSNTFLSPTVPEVFACSVGQKPSKAKYYVDDTSEVIRLLKNVTRISSQREDVIPGRVTFRDVLDFVE

SEQ ID NO: 14001 - protein, 232 aa, Arabidopsis thaliana
  misc_feature: Useful for making plants with altered cell wall content and/or composition
VNGYAGGGWVNAHATFYGGGDASGTMGGACGYGNLYSQGYGTNTAALSTALFNNGLSCGACFEIRCQNDGKWCLPGSIVVTATNFCPPNNALPNNAGGWCNPPQQHFDLSQPVFQRIAQYRAGIVPVAYRRVPCVRRGGIRFTINGHSYFNLVLITNVGGAGDVHSAMVKGSRTGWQAMSRNWGQNWQSNSYLNGQSLSFKVTTSDGQTIVSNNVANAGWSFGQTFTGAQLR

SEQ ID NO: 14002 - protein, 438 aa, Citrullus lanatus
  misc_feature: Useful for making plants with modulated water use efficiency
MGSVPSIKEIIGGLQKESYIPLLSKLIGEAEFVQNNPPDLIPEEDKIIKHVLDVLNPFSIDNGGSLVIKQVNYVCGRGNLIIEYPGTVRGKVVSFVGSHMDVVPANRDTWEFDPFSLSIDGDKLRGRGTTDCLGHVALLTELLKKIAQTKPKLKYSVVVIFIASEENNSIQGIGVEKLWADGYFDNLKGGPLYWIDTADSQPCIGTGGSIPWSVETTGKLFHSGLPNKAINALELAMDALKPIQLNFYRDFPPHPKESDYGFETPSTMKPTQWSYPGGGVNQIPGKSTIAGDVRLTPFYEVKDVITKIQSYVEDINAHVEDLESRGPVSKYTLPDEGIRGRIDVTFGEPISGIACDLDSIGYKILYNATKEVIGHVKPYSITGSLPLVRELQEEGFDVQTVGYGLTDTYHADNEYCLYSDMNNGYKVFASIISQLEEA

SEQ ID NO: 14003 - protein, 182 aa, Arabidopsis thaliana
  misc_feature: Useful for making plants with modulated nitrogen use efficiency
MGILFTRMFSSVFGNKEARILVLGLDNAGKTTILYRLQMGEVVSTIPTIGFNVETVQYNNIKFQVWDLGGQTSIRPYWRCYFPNTQAVIYVVDSSDTDRIGVAKEEFHAILEEDELKGAVVLIFANKQDLPGALDDAAVTEALELHKIKSRQWAIFKTCAVKGEGLFEGLDWLSNTLKSGSG

SEQ ID NO: 14004 - protein, 549 aa, Panicum virgatum
  misc_feature: Useful for making plants with altered carbohydrate content
MGSVPEDTAAAVFRSKLPDIEIPRSLSLQAYCFERLPEVSSRPCLIDGQTGAVHTYADVELLSRRAAAALRALGVGKGDVVMNLLRNCPEFAFVFLGAARLGAATTTANPFYTPHEIHRQAAAAGARVIVTEACAVDKVRAFAAERGVPVVSVDGGPGGCPLLRDLMDAAEPLAADEEVHPDDVVALPYSSGTTGMPKGVMLTHRSLVTSVAQQVDGENPNLYFRQDDVVLCVLPLFHIYSLNSVLLAGLRAGCAIVIMRKFETGALVELVRAHGVTVAPFVPPIVVEIAKSPRVGAADLASIRMVLSGAAPMGKDLQDAFMAKIPNAVLGQGYGMTEAGPVLAMCLAFAKEPFEVKSGSCGTVVRNAELKIVDPDTGASLGRNLPGEICIRGEQIMKGYLNDPEATKNTIDKDGWLHTGDIGYVDDDDEIFIVDRLKEIIKYKGFQVPPAELEALLLTHPEIKDAAVVSMKDELAGEVPVAFIIRTEDSEISEDEIKQFVAKEVVFYKRINKVFFTDSIPKNPSGKILRKDLRARLAAGIPSETQSKN

SEQ ID NO: 14005 - protein, 1084 aa, Arabidopsis thaliana
  misc_feature: Useful for making plants with modulated biomass
MNTGGRLIAGSHNRNEFVLINADESARIRSVQELSGQTCQICGDEIELTVSSELFVACNECAFPVCRPCYEYERREGNQACPQCKTRYKRIKGSPRVDGDDEEEEDIDDLEYEFDHGMDPEHAAEAALSSRLNTGRGGLDSAPPGSQIPLLTYCDEDADMYSDRHALIVPPSTGYGNRVYPAPFTDSSAPPQARSMVPQKDIAEYGYGSVAWKDRMEVWKRRQGEKLQVIKHEGGNNGRGSNDDDELDDPDMPMMDEGRQPLSRKLPIRSSRINPYRMLILCRLAILGLFFHYRILHPVNDAYGLWLTSVICEIWFAVSWILDQFPKWYPIERETYLDRLSLRYEKEGKPSGLAPVDVFVSTVDPLKEPPLITANTVLSILAVDYPVDKVACYVSDDGAAMLTFEALSDTAEFARKWVPFCKKFNIEPRAPEWYFSQKMDYLKNKVHPAFVRERRAMKRDYEEFKVKINALVATAQKVPEEGWTMQDGTPWPGNNVRDHPGMIQVFLGHSGVRDTDGNELPRLVYVSREKRPGFDHHKKAGAMNSLIRVSAVLSNAPYLLNVDCDHYINNSKAIRESMCFMMDPQSGKKVCYVQFPQRFDGIDRHDRYSNRNVVFFDINMKGLDGIQGPIYVGTGCVFRRQALYGFDAPKKKKPPGKTCNCWPKWCCLCCGLRKKSKTKAKDKKTNTKETSKQIHALENVDEGVIVPVSNVEKRSEATQLKLEKKFGQSPVFVASAVLQNGGVPRNASPACLLREAIQVISCGYEDKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLIVYCSLPAVCLLTGKFIVPEISNYAGILFMLMFISIAVTGILEMQWGGVGIDDWWRNEQFWVIGGASSHLFALFQGLLKVLAGVNTNFTVTSKAADDGAFSELYIFKWTTLLIPPTTLLIINIIGVIVGVSDAISNGYDSWGPLFGRLFFALWVIVHLYPFLKGMLGKQDKMPTIIVVWSILLASILTLLWVRVNPFVAKGGPVLEICGLNCGN

SEQ ID NO: 14006 - protein, 415 aa, Arabidopsis thaliana
  misc_feature: Useful for making plants with modulated nitrogen use efficiency
MGVINVQGSPSFSIHSSESNLRKSRALKKPFCSIRNRVYCAQSSSAAVDESKNITMGDSFIRPHLRQLAAYQPILPFEVLSAQLGRKPEDIVKLDANENPYGPPPEATLGNMKFPYVYPDPQSRRLRDALAQDSGLESEYILVGCGADELIDLIMRCVLDPGEKIIDCPPTFSMYVFDAAVNGAGVIKVPRNPDFSLNVDRIAEVVELEKPKCIFLTSPNNPDGSIISEDDLLKILEMPILVVLDEAYIEFSGVESRMKWVKKYENLIVLRTFSKRAGLAGLRVGYGAFPLSIIEYLWRAKQPYNVSVAGEVAALAALSNGKYLEDVRDALVRERERLFGLLKEVPFLNPYPSYSNFILCEVTSGMDAKKLKEDLAKMGVMVRHYNSQELKGYVRVSAGKPEHTDVLMECLKQFY

SEQ ID NO: 14007 - protein, 397 aa, Arabidopsis thaliana
  misc_feature: Useful for making plants with altered cell wall content and/or composition
MFKLKQWLIYLVCSLVIMNTEGLFVNITFVRNAVAKGAVCLDGSPPAYHLDRGSGTGINSWLIQLEGGGWCNNVTNCVSRMHTRLGSSKKMVENLAFSAILSNKKQYNPDFYNWNRVKVRYCDGASFTGDVEAVNPATNLHFRGARVWLAVMQELLAKGMINAENAVLSGCSAGGLASLMHCDSFRALLPMGTKVKCLSDAGFFLNTRDVSGVQYIKTYFEDVVTLHGSAKNLPRSCTSRLTPAMCFFPQYVARQIRTPLFILNAAYDSWQIKNILAPRAADPYGKWQSCQLDIKNCHPSQIKVMQDFRLEFLSAVIGLGRSSSRGMFIDSCYTHCQTETQTSWFWQDSPILNRTTIAKAVGDWVYDRTLFQKIDCPYPCNPTCHHRVFTPLDAPPI

SEQ ID NO: 14008 - protein, 436 aa, Oryza sativa
  misc_feature: Useful for biocontainment applications
MVLDLNVESPGGSAATSSSSTPPPPPDGGGGGYFRFDLLGGSPDEDGCSSPVMTRQLFPSPSAVVALAGDGSSTPPLTMPMPAAAGEGPWPRRAADLGVAQSQRSPAGGKKSRRGPRSRSSQYRGVTFYRRTGRWESHIWDCGKQVYLGGFDTAHAAARAYDRAAIKFRGLDADINFNLNDYEDDLKQMRNWTKEEFVHILRRQSTGFARGSSKYRGVTLHKCGRWEARMGQLLGKKYIYLGLFDSEIEAARAYDRAAIRFNGREAVTNFDPSSYDGDVLPETDNEVVDGDIIDLNLRISQPNVHELKSDGTLTGFQLNCDSPEASSSVVTQPISPQWPVLPQGTSMSQHPHLYASPCPGFFVNLREVPMEKRPELGPQSFPTSWSWQMQGSPLPLLPTAASSGFSTGTVADAARSPSSRPHPFPGHHQFYFPPTA

SEQ ID NO: 14009 - protein, 390 aa, Arabidopsis thaliana
  misc_feature: Useful for making plants with altered cell wall content and/or composition
MRLRFPMKSAVLAFAIFLVFIPLFSVGIRMIPGRLTAVSATVGNGFDLGSFVEAPEYRNGKECVSQSLNRENFVSSCDASLVHVAMTLDSEYLRGSIAAVHSMLRHASCPENVFFHLIAAEFDPASPRVLSQLVRSTFPSLNFKVYIFREDTVINLISSSIRQALENPLNYARNYLGDILDPCVDRVIYLDSDIIVVDDITKLWNTSLTGSRIIGAPEYCHANFTKYFTSGFWSDPALPGFFSGRKPCYFNTGVMVMDLVRWREGNYREKLETWMQIQKKKRIYDLGSLPPFLLVFAGNVEAIDHRWNQHGLGGDNVRGSCRSLHKGPVSLLHWSGKGKPWVRLDEKRPCPLDHLWEPYDLYEHKIERAKDQSLFGFSSLSELTEDSSFF

SEQ ID NO: 14010 - protein, 374 aa, Panicum virgatum
  misc_feature: Useful for making plants with altered carbohydrate content
MLWVTRLSGFFSAAMVMVVLSPSLQSFPPAEAIRSSQFDGSVRFPGQIAGGARGIAFRRAPSFRNAADCGSGGAGNGTAANVCDPSLVHIAITLDEEYLRGSVAAVHSVVQHAKCPESVFFHFLVSDPGLGDLVRAVFPQLRFKVYYFDPDRVRGLISTSVRQALEQPLNYARNYLADLLEPCVRRVIYLDSDLVLVDDVAKLWRTDLGGRTVGAPEYCHANFTKYFTGRFWSDQRFAGTFAGRRPCYFNTGVMVLDLERWRQASYTQRIERWMEIQKSPPGRIYELGSLPPFLLVFAGHVAPIEHRWNQHGLGGDNVLGSCRDLHPGPVSLLHWSGSGKPWARLGAGRPCPLDALWAPFDLYGPAGAGAEESR

SEQ ID NO: 14011 - protein, 376 aa, Panicum virgatum
  misc_feature: Useful for making plants with altered carbohydrate content
MENETTETSTSGCGSLILEMGVLSRLTGDSRYEAAALRALRKLWSMRSSLNLVGTTLDVLTGKWIEYSSGIGAGVDSFYEYLVKAYILFGSDEYWDMFHSAYLAVQKYFRHGPWYHEADMRTGEATHWQLTSLQAFWPGLQTLLGDVAAANLSHREFYNIWQRFGMLPERYLLDYGILHPTEKYYPLRPEFAESTFYLYQATKDPWYLEVGETIIGSLNYYTKVDGGFASVRDVSTMKLEDHQHSFFLSETCKYLFLLYDDSFLRNQNYIFTTEGHPLPIRSTWHEKFPATHFPRNWTFVKDETQPIRVSALSSQVCPETVFQKSVGSPWESACHVPDVHASHICRTDDDCGIEAVTCKKRTCSMAGYCGLWLVIN

SEQ ID NO: 14012 - protein, 291 aa, Panicum virgatum
  misc_feature: Useful for making plants with altered carbohydrate content
MATRRATVLAALLLASLLPLALSRGLGFGRGHVRPHGHGVGLGRRHALPHPQPHGHPPLGGGAWSSAHATFYGGGDASGTMGGACGYGNLYSQGYGTNTAALSTALFNNGLSCGACFEVRCDAAGGGSHSCLPGSVVVTATNFCPPNYALSSDDGGWCNPPRAHFDMSQPVFQRIALYRAGIVPVSYRRVACNKKGGIRFTINGHSYFNLVLVTNVGGAGDVHAVAVKADRSPGWQAMSRNWGQNWQSNALLDGQALSFRVTTGDGRSVVSTNAAPRGWSFGQTFSGAQFN

SEQ ID NO: 14013 - protein, 318 aa, Oryza sativa subsp. japonica
  misc_feature: Useful for biocontainment applications
MNTRGSGSSSSSSSSQASLMAFSEPPKPASQPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPQYAAAAAAPSSVQYGGGVGAAPHIGSYGHHHHHHHHHGHGAASGASSVGECSTMPVMVPVDPHRSSMSSSLLDMDRNGHDFLFSGADDNSGYLSSVVPESCLRPRGGGAAADHQDMRRYSDADAYGMMGLREDVDDLAQMVAGFWGGGDAADQLGACGFPASGGAADMVASSQGSDSYSPFSFLSH

SEQ ID NO: 14014 - protein, 771 aa, Arabidopsis thaliana
  misc_feature: Useful for making plants with altered cell wall content and/or composition
MLVQDRAAPSPAKPPKSQIRELPTHQQIRRRFSEPKNLDFSTWFSENLSRIAVFSLLIVTIVAFFFLYNTTDTASLLCFQSQSTQFLQSLSRPQIKWNSIPVVPDKTSPYANFQTEKWIVVSVTKYPTEELKSLVKIRGWQVLAIGNSATPKDWSLKGSIFLSLDAQAELGYRVLDHLPYDSFVRKSVGYLFAIQHGAKKIYDADDRGEVIDGDLGKHFDVELVGLDSKQEPILQYSHENPNRTVVNPYIHFGQRSVWPRGLPLENVGEINHEEYYTEVFGGKQFIQQGISNGLPDVDSVFYFTRKTTLEAFDIRFDEHSPKVALPQGVMVPVNSFNTLYHSSAFWGLMLPVSVSSMASDVLRGYWGQRLLWELGGYVAVYPPTAHRFDRIEAYPFVEEKDLHVNVGRLIKFLLAWRSEKHSFFETVLDLSFAMAEEGFWTEQDLKFTAAWLQDLIAVGYQQPRLMSLELDRPRASIGHGDRKEFVPRKLPSVHLGVEETGTVSTEIGNLIRWRKNFGNVVLVMFCNGPVERTALEWRLLYGRIFKTVVILSSQKNSDLYVEEAKLDHIYKHLPKIFDRYSSAEGFLFVEDDTVLNYWNLLQADKSKIWTTDKVSKSWTSVKPTGNSDWFSVQAELVKKTVSTMPAHFQVNYKDATKNNHETLTVCSSEVFYVPKRLVTDFIDLVDLVGDMDLHYKVAVPMFFLSMDSPQNFDPVLGSMVYKRKSASFNTSSSLYSAKAPAVHPWSISSEQDFIKLVQQMAEGDPLLMELV

SEQ ID NO: 14015 - protein, 415 aa, Arabidopsis thaliana
  misc_feature: Useful for making plants with altered cell wall content and/or composition
MVKLLLVGFVVAGIILGTQANEYLDFNVTEIDRIEELEFGFSKYSSNLNPLMVGLTLIRGADSGAVCLDGTLPGYHLHRGHGSGANSWLIQLEGGGWCNNIRTCVYRKTTRRGSSNYMEKQLQFTGILSDKAQENPDFFNWNRVKLRYCDGASFSGDGQNQAAQLQFRGERIWRAAIDDLKANGMRYANQALLSGCSAGGLAAILRCDEFRNLFPGSTKVKCLSDAGLFLDTADVSGGRTIRNLYNGVVELQSVKNNLPRICTNHLDPTSCFFPQNLISQMKTPLFIVNAAYDTWQIQSSIAPTSADPSGFWHDCRLNHGKCTPAQLRFLQGFREQMLRVVKGFSMSRQNGLFINSCFAHCQTERQDTWFADDSPVIRKKAVAIAVGDWYFDRAEVKLVDCPYPCDKSCHNLVFR

SEQ ID NO: 14016 - protein, 462 aa, Panicum virgatum
  misc_feature: Useful for making plants with altered carbohydrate content
MLQKRWQGCVFLLAFLLCDASGIMTPSENSPSEFAKILQSKQTKHARVCRADPELLRSLAGSDAELMLAIPNEQLEHIAEFQEEADLWVIAYVARFLPAARITHVLAGDDVLTTSPGSAYFLVPAMLNLRSALAAAGLDGRVKVSTAVSAEALAAPAWSGVAGHVLRFLSSAGSPLFLKSRPSEASDAEADAAYGAMRALGVPAVPVVAADLGAAAGGEAAAYYYYGYPGGQPGERGTRRSLATGTFCVALQNADPAALQAGLNWACGPGHADCSAIQPGGPCYQQNNLPALASYAYNDYYQKMSSTGATCSFNGTATTTTNDPSSGSCVFAGSSTAGGSNSSTPTPVGASPPTSLSPPAGFTPPVGSSPPSSDLSPPAVGTTPPSGFAPPAGGGFEPPAGGFGTPPSGFGPPGSFNGSGSFGPSGTLNPYGGCRGAMSGGAGLTALLAVAVAGLLVSMDAM

SEQ ID NO: 14017 - protein, 505 aa, Arabidopsis thaliana
  misc_feature: Useful for making plants with altered cell wall content and/or composition
MLLPRWFAEALLLLLSILACSNAAFIGVNIGTDLTNMPPPSDIVTLLKSQQITHVRLYDANSHMLKAFANTSIEVMVGVTNEEILKIGRFPSAAAAWVNKNVAAYIPSTNITAIAVGSEVLTTIPHVAPILASALNNIHKALVASNLNFKVKVSSPMSMDIMPKPFPPSTSTFSPSWNTTVYQLLQFLKNTGSFFMLNAYPYYGYTTANGIFPLDYALFKQLSPVKQIVDPNTLLHYNSMFDAMVDAAYYSMEALNFSKIPVVVTETGWPSSGGSDEAAATVANAETFNTNLIKRVLNNSGPPSQPDIPINTYIYELYNEDKRSGPVSERNWGILFPNGTSVYPLSLSGGSSSAALNGSSMFCVAKADADDDKLVDGLNWACGQGRANCAAIQPGQPCYLPNDVKSHASFAFNDYYQKMKSAGGTCDFDGTAITTTRDPSYRTCAYTGSLNANATNGNFPPDALGPASPLGGNANARIIFSYHLPILAPLALTLLQLLLQHDRLL

SEQ ID NO: 14018 - protein, 534 aa, Arabidopsis thaliana
  misc_feature: Useful for making plants with altered cell wall content and/or composition
MDGVSPKFVLPETFDGVRMEITGQLGMIWELVKAPVIVPLLQLAVYICLLMSVMLLCERVYMGIVIVLVKLFWKKPDKRYKFEPIHDDEELGSSNFPVVLVQIPMFNEREVYKLSIGAACGLSWPSDRLVIQVLDDSTDPTVKQMVEVECQRWASKGINIRYQIRENRVGYKAGALKEGLKRSYVKHCEYVVIFDADFQPEPDFLRRSIPFLMHNPNIALVQARWRFVNSDECLLTRMQEMSLDYHFTVEQEVGSSTHAFFGFNGTAGIWRIAAINEAGGWKDRTTVEDMDLAVRASLRGWKFLYLGDLQVKSELPSTFRAFRFQQHRWSCGPANLFRKMVMEIVRNKKVRFWKKVYVIYSFFFVRKIIAHWVTFCFYCVVLPLTILVPEVKVPIWGSVYIPSIITILNSVGTPRSIHLLFYWILFENVMSLHRTKATLIGLFEAGRANEWVVTAKLGSGQSAKGNTKGIKRFPRIFKLPDRLNTLELGFAAFLFVCGCYDFVHGKNNYFIYLFLQTMSFFISGLGWIGTYVPS

SEQ ID NO: 14019 - protein, 148 aa, Arabidopsis thaliana
  misc_feature: Useful for making plants with modulated water use efficiency
MATQISKKRKFVADGVFYAELNEVLTRELAEDGYSGVEVRVTPMRTEIIIRATRTQNVLGEKGRRIRELTSLVQKRFKFPQDSVELYAEKVANRGLCAIAQAESLRYKLLGGLAVRRACYGVLRFVMESGAKGCEVIVSGKLRAARAK

SEQ ID NO: 14020 - protein, 443 aa, Panicum virgatum
  misc_feature: Useful for making plants with altered carbohydrate content
MEPRCSVMVLALAAALSVAVAYDPLDPNGNITIKWDIMSWTPDGYVAVVTINNFQMYRQIMAPGWTVGWTWAKKEVIWSMVGAQATEQGDCSRFKGNIPHCCKRTPAVVDLLPGVPYNQQIANCCRGGVISAYGQDPGAAVAAFQVSVGQAGTTNRTVKVPKNFTLLGPGPGYTCGPAKVVPSTVFLTPDRRRKTQALMTWNVTCTYSQYLASKYPSCCVSFSSFYNDTIVPCAKCACGCEHKTCVQGDSKRPLAVTGKHTHAAATRGHRDKEAPLLQCTTHMCPVRVHWHVKLNYKEYWRAKIAITNFNYRMNYTQWTLVAQHPNLDNITEVFSFDYKPVVAYGSINDTAMFYGLKYFNDHLMQAGPYGNVQSEVLMRKDASTFTFRQGWAFPRKVYFNGDECQMPPPDAYPYLPNAALPAPVASLGAAVVAVVAFLVLVVV

SEQ ID NO: 14021 - protein, 431 aa, Arabidopsis thaliana
  misc_feature: Useful for making plants with altered cell wall content and/or composition
MRLLFSFCFFFFMIIFTATAYDPLDPSGNITIKWDIMSWTADGYVATVTMNNFQIYRHIQNPGWTLGWTWAKKEVIWSMVGAQTTEQGDCSKFKGNVPHCCKKTPTVVDLLPGVPYNQQFSNCCKGGVIGAWGQDPSAAVSQFQVSAGLAGTTNKTVKLPKNFTLLGPGPGYTCGPAKIVPSTVFLTTDKRRKTQALMTWNVTCTYSQFLARKHPSCCVSFSSFYNDTITPCPSCACGCENKKSCVKADSKILTKKGLNTPKKDNTPLLQCTHHMCPVRVHWHVKTNYKDYWRVKIAITNFNYRMNHTLWTLAIQHPNLNNVTQVFSFDYKPVSPYGSINDTGMFYGTKFYNDLLMEAGPSGNVQSEVLLQKDQKTFTFKQGWAFPRKVYFNGDECMLPPPDSYPFLPNSAQGNFASFSLTILLLLFISIW

SEQ ID NO: 14022 - protein, 224 aa, Panicum virgatum
  misc_feature: Useful for making plants with altered carbohydrate content
MLEAKPPSPGSGAAAHIHGHRRWAAPLLASVLLSSLLISASLFFSSSRALLLSFSPLPTAASAEPLFVEAKLRQQMRAGERPPPPAVPRIAYLISGSAGDGAALSRTLRALYHPANTYVVHLDLEAPAAERAELAAAVRADPVYARFRNVRVVTRANLVTYRGPTMVANTLHAAAILLREGGDWDWFINLSASDYPLVTQDDLLHVLSELPRQLNFIEHTSDIG

SEQ ID NO: 14023 - protein, 558 aa, Arabidopsis thaliana
  misc_feature: Useful for making plants with altered cell wall content and/or composition
MDQNSYRRRSSPIRTTTGGSKSVNFSELLQMKYLSSGTMKLTRTFTTCLIVFSVLVAFSMIFHQHPSDSNRIMGFAEARVLDAGVFPNVTNINSDKLLGGLLASGFDEDSCLSRYQSVHYRKPSPYKPSSYLISKLRNYEKLHKRCGPGTESYKKALKQLDQEHIDGDGECKYVVWISFSGLGNRILSLASVFLYALLTDRVLLVDRGKDMDDLFCEPFLGMSWLLPLDFPMTDQFDGLNQESSRCYGYMVKNQVIDTEGTLSHLYLHLVHDYGDHDKMFFCEGDQTFIGKVPWLIVKTDNYFVPSLWLIPGFDDELNKLFPQKATVFHHLGRYLFHPTNQVWGLVTRYYEAYLSHADEKIGIQVRVFDEDPGPFQHVMDQISSCTQKEKLLPEVDTLVERSRHVNTPKHKAVLVTSLNAGYAENLKSMYWEYPTSTGEIIGVHQPSQEGYQQTEKKMHNGKALAEMYLLSLTDNLVTSAWSTFGYVAQGLGGLKPWILYRPENRTTPDPSCGRAMSMEPCFHSPPFYDCKAKTGIDTGTLVPHVRHCEDISWGLKLV

SEQ ID NO: 14024 - protein, 605 aa, Panicum virgatum
  misc_feature: Useful for making plants with altered carbohydrate content
MVMGRPNQSHGSGGDEERLPLRGGLETERAPPPPHHAAEQLKEARRGGGRLWRASVRAGLVLCLLTVPAVLLLLRWQADSSPQWVFDFEAPEEDDDDQDIQDDVSDDISPSPQIEYDRLLGGLLIEGFDEKSCRSRYQFARYHKSPSIPSPYLIERLRKQELLQKKCGPGTKAYKEASKQLRSGQSQTTNTTDCNYLILTIHAGLGNRMLEITSALLYALLTNRILLVDRYKEIGDLFCEPFPGTSWLVPSDFPLSYGEFTQSSPESYGNMLQNKAAGGNTNRSLAGTRPNYVYLHLDGNYGFHDKLFFCEDDQQFLQGVPWLIIRTDMYFVPSLFLIPGFQDELSRLFPEKDTVFHHLARYLFHPTNNIWYSITKYYRSYMAKAEKRVGIQIRIYETKGILQRNGPFPHILNQILSCAQNEKLLPEIGMMEGAAAEAQNKGAAAETQNNQTIVVLTTSLSSWYSDQIQKKYEEHPTVDGTTVKVYQPSHEEYQRSRNRKHNMKALAEIYLLSMNDELITSGFSTFGYAAQGLAGLKPWIMFRSENHVTPDPPCGRVMSIEPCFHQAPFYDCKAKRDTDLGKVVPYVRHCEDVSWGLKIVNETKL

SEQ ID NO: 14025 - protein, 500 aa, Arabidopsis thaliana
  misc_feature: Useful for making plants with altered cell wall content and/or composition
MQLSFFNIFNYQLLDATTNGSKDSRKSKDKLLGGLLTADFDEDSCLSRYESSLYRKPSPYKPSRYLVSKLRSYEMLHKRCGPGTEAYKKATEILGHDDENHSTKSVGECRYIVWIAVYGLGNRILTLASLFLYALLTDRIMLVDQRTDISDLFCEPFPGTSWLLPLDFPLTDQLDSFNKESPRCYGTMLKNHAINSTTTESIIPSYLCLYLIHDYDDYDKMFFCESDQILIRQVPWLVFNSNLYFIPSLWLIPSFQSELSKLFPQKETVFHHLARYLFHPTNQVWGMITRSYNGYLSRADERLGIQVRVFSKPAGYFQHVMDQILACTQREKLLPEVFVLETQVTNTSRSSKLKAVLVTSLYPEYSEILRQMYWKGPSSTGEIIQIYQPSQEIYQQTDNKLHDQKALAEIYLLSLTDYIVTSDSSTFGYVAQGLGGLKPWILYKPKNHTAPEPPCVRAVSMEPCFLRAPLYGCQAKKVNITPFVMYCEDRITGLKLVDSN

SEQ ID NO: 14026 - protein, 150 aa, Arabidopsis thaliana
  misc_feature: Useful for making plants with modulated biomass
MAFCNKLGGLLRQNISSNGNVPVTSMLGSLRLMSTKLFIGGLSWGTDDASLRDAFAHFGDVVDAKVIVDKETGRSRGFGFVNFNDEGAATAAISEMDGKELNGRHIRVNPANDRPSAPRAYGGGGGYSGGGGGGYGGGGGSYGGGDGGGY

SEQ ID NO: 14027 - protein, 208 aa, Arabidopsis thaliana
  misc_feature: Useful for making plants with altered cell wall content and/or composition
MSLKGTIVLLGLLWSFQATLGIRFVIDREECFSHKAEYEGDTLHVSFVVIKSDSQWHFNEDGVDLVIHGPTGEQIHDFREQISAKHDFVVQKKGVYRFCFTNKSPYHETIDFDVQLGHFAYYDQHAKDEHFTPLMEQISKLEEALYNIQFEQHWLEAQTDRQAIVNENMSKRAVHKALFESFALIGASFLQVYLLRRLFERKLGMSRV

SEQ ID NO: 14028 - protein, 159 aa, Panicum virgatum
  misc_feature: Useful for making plants with altered carbohydrate content
MEGLSWGRVCLSVLCVVLLSRPAAAIRFVIDREECFSHNVEYEGDTVHVSFVVIKAETPWHYSEEGVDLVVKDPNGAQVRDSRDKTSDKFEFIVQKRGVHRFCFTNKSPYHETIDFDVHVGHFSYFEQHAKDEHFAPLLEQIAKLDEALYNIQFEQHWL

SEQ ID NO: 14029 - protein, 346 aa, Panicum virgatum
  misc_feature: Useful for making plants with altered carbohydrate content
MEKRRRCSNLLAVAALALVAAMLPPSGKAKLSPDYYRSTCPDVEAIVRAVVAKKVKETFVTVPATLRLFFHDCFVEGCDASVIIASRDNDAEKDAPDNVSLAGDGFDTVVRAKAEVEKECPGVVSCADILAIAARDVVAMSSGPHWAVELGRLDGLVSKAGGVAGRLPGPDMRVADLAALFARHNLTTLDMVALSGAHTVGFAHCTRFTGRLYRHGAVGAGAHAVDPSYDPAYARQLMAACPPDVGETIAVDMDPVTPTAFDNAYYGNLARGMGLFTSDQALHTDGASRPAVRDFAGNQTRFFEAFKDAMVKLGRVGVKTGRHGEIRRDCTAFNKKIEASSRRLHN

SEQ ID NO: 14030 - protein, 160 aa, Arabidopsis thaliana
  misc_feature: Useful for making plants with modulated water use efficiency
MAQRTEKEETEFKVLETLTTTTTTLCTNNCGVTANPATNNMCQKCFNASLVSAAAGVVESGSILKRSARSVNLRSSPAKVVIRPREIDAVKKRDQQIVNRCSGCRKKVGLTGFRCRCGELFCSEHRYSDRHDCSYDYKTAGREAIARENPVVKAAKMVKV

SEQ ID NO: 14031 - protein, 246 aa, Panicum virgatum
  misc_feature: Useful for making plants with altered carbohydrate content
MAAGGDTIARVHTGIDSSNKTLLKSEALYKYVLDTSVLPHEPECMRELRLVTDKHEWGFMQSSPDEAQLLRMLIKLTGARNTLEVGVFTGYSLLATALALPEDGRVIAVDVDRDYYEIGRPFIEKAGVAHKVDFREGPALDHLDALLADERNLGAFDFAFVDADKPNYVRYHEQLLRLVRVGGTIVYDNTLWAGTVALPPDTPLSDLDRRFSAAIRDLNARLSADERVEVCQLAIADGVTICRRLV

SEQ ID NO: 14032 - protein, 767 aa, Panicum virgatum
  misc_feature: Useful for making plants with altered carbohydrate content
MTITSSVKLAGGTLSVCGRTVLSGVPAAVAASSASAAGAVDGVFIGADLAEPASHHVISLGTLRGVRFMACFRSKLWWMSQRMGDKGGDVPHETQFLLVESTGAGGKDAAAAAYVVFLPLVEGAFRASLQGGAGEALELCVESGDDDTRAASIERALFVGAAESDPFAAVAGAVAAARSALKTFRVRAEKKLPGIVDYFGWCTWDAFYQDVTQEGVEAGLRSLVTGGAPPKFVIIDDGWQSVGTDQPSPSPDEHAGEATQPRLPRLTGIRENSKFQNADDPAAGIKAVVRAAKEEYGLKYVFVWHAIIGYWGGVRPGAAGMERYRSSMQFPKISPGVAENDPGMRTDWITAQGVGLVPPRAVYRFYDEQHAYLAAAGVDGVKVDEQCILETLGAGHGGRAQLTRQYHQALDASVAKNFPENGIIACMSHNTDALYCSKQTAVVRASDDFFPRDPVSHTIHIAAVAYNSVFLGEFMLPDWDMFHSLHPAGEYHGSARAISGGPVYVSDAPGKHDFELLKKIVLPDGSVLRARLPGRPTKDCLFTDPARDGVSLLKIWNMNKFTGVLGVYNCQGAAWSFVEKKTTFHRTGAGALTCGVKGSDVHLISDAATDPDQWSGDCAVYRHGSGDLAVLPDGAALPVSLKVLEQDILTVSPIKDLAPGFRFAPVGLVGMFNGGAAVEGLTYHLLDGGKLVGDGGSAACRSEEAVGLVCMEVRGRGRFGAYSSVRPRRCMLGSAEIEFSYVPSSGLLTLLLEEMPGERVHKIVVEL

SEQ ID NO: 14033 - protein, 448 aa, Panicum virgatum
  misc_feature: Useful for making plants with altered carbohydrate content
MARPRRFSLTVSLISLVEFLSLTSASTLQQLCADGGGPAAGVRAGYWSPSSSRYSPVSSIDASLFTHLYYSSVSIDEASYAVAPPPADEASLFAAFSSTVKSSSSSAKTMLSIGTDEYRVDVSNAAFSRMASDRGLRGVFINSSVELARANGFDGLDLSWIFPATQMDMENLGVLLAEWRAKITEESATNSLSEPLLLTATLYFSNHLFDMPDSNLDYPIDDISSNLDWANILTFGFHGGSNVTTADAPLYDATSHFSVSYGVISWLDTGVPPCKLVMGMPLYGRSWFLRNKAKNGIGSPTAAAGTKQRKSNQTGIIAYAEVEEYTNSASTVLTYDSQSVAEYFYNGDLWVSFDSAQVVQKKLEFAARSQLLGYFLWTVGFDDSNSTIAKQATESWHQYAQDGFGTMHAGGSNQYVAFSSSSVSSGSWYSKILRYLLSPILLLVTLSH

SEQ ID NO: 14034 - protein, 577 aa, Arabidopsis thaliana
  misc_feature: Useful for making plants with modulated nitrogen use efficiency
MSFWLSLIFCFFTFASSSPPDDPVNCEFGNTMCTVTNSYGAFPDRSICKAAKVEYPRTEAELVSIVAAATRAGQKMRVVTRYSHSFPKLVCTDGKDGTLISTKFLNHVVTTNPEAKTLTVESGVTLRQLIEEAAKFDLALPYAPYWWGLTVGGMMGTGAHGSSLWGKGSAVHDYVTEIRLVSPGLASDGYVKVQVLSETIDPEEFRAAKVSLGVLGVISQVTFELQPMFKRSLNYVMRNDSDFGDQAVSFGERHEFADFLWLPSQGKVVYRMDGRVPLNTSGDGLFEFFPFRSQLSLVLAIDRSLEESEESLEDANMKCVRAKLVSSSMFLMSYGVTNNGLIFTGYPVIGMQNHMMSSGSCLDSRQDGLITACPWDPRIKGQFFHQTTFSVSLTNVKSFINDIKALVKIEPKSLCVLEGSNGILIRYVTSSLAFLGKEEKALDFDLTYYRSKNDPLAPRLYEDYIEEIEQMAIFKYNALPHWGKNRNLAFDGAIRKYKNANAFLKVKEKFDSLGLFSTEWTDQILGLKGNVTIVKQGCALEGLCICSEDSHCAPTKGYLCRPGKVYREARVCTRVSS

SEQ ID NO: 14035 - protein, 396 aa, Panicum virgatum
  misc_feature: Useful for making plants with altered carbohydrate content
  misc_feature (395)..(395): Xaa is any aa, unknown, or other
MSFNKSRGAGIGGGGGDELVLRGSVSKKWTFLLCLGSFCVGLLFTNRMWTMPEPKEIIRRSTLEVDKMNLVAGDCAPKSIGDAKDIPGEVPRTQDVIQTLDKTISNLEMELASAKATQESMLSVAPASESIGKRKYFMVIGINTAFSSRKRRDSVRATWMPQGEKRRKMEEEKGIIIRFVIGHSATSGGILDRAIDAEDRKHGDFMRLDHVEGYLELAAKTKAYFVAAVSMWDAEYYIKVDDDVHVNIATLGNTLARHRSKPRVYVGCMKSGPVLAQKGVKYHEPEYWKFGEWGNKYFRHATGQLYAISKDLASYIALNQHVLHKYANEDVSLGAWFIGLDVEHVDDRRLCCGTPPDCEWKAQAGNVCVASFDWSCSGICKSADRIKEVHQALRXE

SEQ ID NO: 14036 - protein, 544 aa, Arabidopsis thaliana
  misc_feature: Useful for making plants with altered cell wall content and/or composition
MEKSGYGRDGIYRSLRPTLVLPKDPNTSLVSFLFRNSSSYPSKLAIADSDTGDSLTFSQLKSAVARLAHGFHRLGIRKNDVVLIFAPNSYQFPLCFLAVTAIGGVFTTANPLYTVNEVSKQIKDSNPKIIISVNQLFDKIKGFDLPVVLLGSKDTVEIPPGSNSKILSFDNVMELSEPVSEYPFVEIKQSDTAALLYSSGTTGTSKGVELTHGNFIAASLMVTMDQDLMGEYHGVFLCFLPMFHVFGLAVITYSQLQRGNALVSMARFELELVLKNIEKFRVTHLWVVPPVFLALSKQSIVKKFDLSSLKYIGSGAAPLGKDLMEECGRNIPNVLLMQGYGMTETCGIVSVEDPRLGKRNSGSAGMLAPGVEAQIVSVETGKSQPPNQQGEIWVRGPNMMKGYLNNPQATKETIDKKSWVHTGDLGYFNEDGNLYVVDRIKELIKYKGFQVAPAELEGLLVSHPDILDAVVIPFPDEEAGEVPIAFVVRSPNSSITEQDIQKFIAKQVAPYKRLRRVSFISLVPKSAAGKILRRELVQQVRSKM

SEQ ID NO: 14037 - protein, 637 aa, Arabidopsis thaliana
  misc_feature: Useful for making plants with modulated abiotic stress sensitivity
MANKLKVDELRLKLAERGLSTTGVKAVLVERLEEAIAEDTKKEESKSKRKRNSSNDTYESNKLIAIGEFRGMIVKELREEAIKRGLDTTGTKKDLLERLCNDANNVSNAPVKSSNGTDEAEDDNNGFEEEKKEEKIVTATKKGAAVLDQWIPDEIKSQYHVLQRGDDVYDAILNQTNVRDNNNKFFVLQVLESDSKKTYMVYTRWGRVGVKGQSKLDGPYDSWDRAIEIFTNKFNDKTKNYWSDRKEFIPHPKSYTWLEMDYGKEENDSPVNNDIPSSSSEVKPEQSKLDTRVAKFISLICNVSMMAQHMMEIGYNANKLPLGKISKSTISKGYEVLKRISEVIDRYDRTRLEELSGEFYTVIPHDFGFKKMSQFVIDTPQKLKQKIEMVEALGEIELATKLLSVDPGLQDDPLYYHYQQLNCGLTPVGNDSEEFSMVANYMENTHAKTHSGYTVEIAQLFRASRAVEADRFQQFSSSKNRMLLWHGSRLTNWAGILSQGLRIAPPEAPVTGYMFGKGVYFADMFSKSANYCYANTGANDGVLLLCEVALGDMNELLYSDYNADNLPPGKLSTKGVGKTAPNPSEAQTLEDGVVVPLGKPVERSCSKGMLLYNEYIVYNVEQIKMRYVIQVKFNYKH

SEQ ID NO: 14038 - protein, 750 aa, Arabidopsis thaliana
  misc_feature: Useful for making plants with altered cell wall content and/or composition
MLRFIIFFSLFIHLCVAAPQTPAAAAAVPAKKWLTLNGQEPAVVARGGFSGLFPESSASANDLAIGTSSPGLTMLCNLQMTKDGVGLCLSDIILDNATTISSVFPKAQKTYKVNGQDLKGWFVLDYDADTIFNNVTLVQNIFSRPSIFDGQMSVSAVEDVLGTKPPKFWLSVQYDAFYMEHKLSPAEYLRSLQFRGINVISSPEIGFLKSIGMDAGRAKTKLIFEFKDPEAVEPTTNKKYSEIQQNLAAIKAFASGVLVPKDYIWPIDSAKYLKPATTFVADAHKAGLEVYASGFANDLRTSFNYSYDPSAEYLQFVDNGQFSVDGVITDFPPTASQSITCFSHQNGNLPKAGHALVITHNGASGDYPGCTDLAYQKAVDDGADVIDCSVQMSKDGIAFCHDAADLTASTTAMTIFMSRATSVPEIQPTNGIFSFDLTWAEIQSVKPQIENPFTATGFQRNPANKNAGKFITLADFLDFSKAKAVTGVMINIENAAYLASKKGLGVVDAVKSALAKSTLDKQSTQKVLIQSDDSSVLASFEAVPPYTRVLSIDKEIGGAPKPSVDEIKKYAEAVNLLRTSLVTVSQSFTTGKTNVVEEMHKGNISVYVSVLRNEYISVAFDYFSDPTIELATFISGSGVDGVITEFPATATRYLKSPCSDLNKEQPYAILPAEAGGLVVVADKEAQPPASAPNPPLEAKDVIDPPLPPVANLAASNATGGAQSHPPPASGTVANAANLGLSLLAMLALGV

SEQ ID NO: 14039 - protein, 819 aa, Arabidopsis thaliana; identical to SEQ ID NO: 13355
  misc_feature: Useful for making plants with modulated drought sensitivity

SEQ ID NO: 14040 - protein, 328 aa, Panicum virgatum
  misc_feature: Useful for making plants with altered carbohydrate content
MSTVTAADPHTSFLADKDAKVFVAGHRGLVGSAVVRRLLSLGFTSVVVRTHAELDLTRQADVEAFFAAERPRYVVLAAAKVGGIHANSTFPADFIAANLQIQTNVVDAALRSGSVRKLLFLGSSCIYPKFAPQPITEGALLSGPLEPTNEWYAVAKIAGIKMCQAYRIQHGLDAVSAMPTNLYGPHDNFHPENSHVLPALIRRFHEAKACDAPEVVVWGSGSPLREFLHVDDLADAVIFLMDQYSGLEHVNVGSGSEVAIKELAELVKEVVGFQGKLVWDSSKPDGTPRKLMDSSKIQGMGWKPKIALKEGLVETYKWYVENVVSGKK

SEQ ID NO: 14041 - protein, 328 aa, Arabidopsis thaliana
  misc_feature: Useful for making plants with altered cell wall content and/or composition
MADNTGSEMKSGSFMLEKSAKIFVAGHRGLVGSAIVRKLQDQGFTNLVLRTHSELDLTSQSDVESFFATEKPVYVILAAAKVGGIHANNTYPADFIGVNLQIQTNVIHSAYTHGVKKLLFLGSSCIYPKFAPQPIPESALLTGPLEPTNEWYAIAKIAGIKMCQAYRLQHQWDAISGMPTNLYGQNDNFHPENSHVLPALMRRFHEAKANNADEVVVWGSGSPLREFLHVDDLADACVFLMDQYSGFEHVNVGSGVEVTIKELAELVKEVVGFKGKLVWDTTKPDGTPRKLMDSSKLASLGWTPKISLKDGLSQTYEWYLENVVQKKQ

SEQ ID NO: 14042 - protein, 452 aa, Glycine max
  misc_feature: Useful for making plants with modulated biomass
METGGGRDSGMSSETINSSTQRTSMSNESVCSTSFSRLSFDLPPPSSSPETLFVKPHRSSDFAYSAILRRKSALTFRDFHLLRRIGAGDIGTVYLCRLRHDAGDEDDDEDPCFYAMKVVDKEAVALKKKAQRAEMERKILKMVDHPFLPTLYAEFEASNFSCIVMEYCSGGDLHSLQHNHPNNRFSLSSARFYAAEVLVALEYLHMLGIIYRDLKPENVLVRSDGHIMLSDFDLSLCSDAIPAVESPDCSLDPAFAPALRYTRQYSTPFSCLSNRVFRSRKVQTLQPNRLFVAEPVGARSCSFVGTHEYVSPEVASGNSHGNAVDWWSFGIFIYEMVYGRTPFAGSSNEATLRSIIKKPLAFPTSTPSSTLEMHARDLISGLLNKDPNRRLGSKRGSADVKKHPFFAGLNLALIRTVTPPEVPSLRRHKTTPFYYPANVNNSRQQLTAFDYF

SEQ ID NO: 14043 - protein, 465 aa, Panicum virgatum
  misc_feature: Useful for making plants with altered carbohydrate content
MGAPVRGALLLCLLLLAGAAGAAGDAAPQEPTLPAAGAGAGGGPAVGVNSNSVLVALLDSHYTELAELVEKALLLQTLEDAVGRHNVTIFAPRNEALERDLDPEFKRFLLEPRNLKSLQALLLYHVLPARLPSDSWPAASHPTLSGEELELAAGMRVGHAAVTRPDAVLRPDGVIHGIERLLVPRSVQEDFNRRRSLAAISAVLPTGAPEVDPRTHRLKKPAPPVPPGAPPVLPIWDAMAPGPAIAPAPAPGPGSGKHHFDGHSQVKDFIQTLLLYGGYNELADILVNLTSLATEMGRLVSEGYVLTVLAPNDEAMARLTTDQLSEPGSPENILYYHMIPEYQTEESMYNAVRRFGKVRYDTLRLPHKVVAREADGSVKFGQGEGSAYLFDPDIYTDGRISVQGIDAVLFPPGDKNATQTADPHRKPPAITTHKKIKLRRGKLLEASCQMAALFGQRSRFASCQD

SEQ ID NO: 14044 - protein, 436 aa, Arabidopsis thaliana
  misc_feature: Useful for making plants with altered cell wall content and/or composition
MDDLSKLLFFLLLTISITTALPDKPGSGQINSNSVLVALLDSHYTELAELVEKALLLQTLEEAVGQHNITIFAPRNDALEKNLDPEFKSFLLQPKNLKSLQSLLMFHILPKRITSPQFSSAVVSHRTLSNDHLHFTNGKVNSAEITKPDDLTRPDGIIHGIERLLIPRSVQEDFNRRRSLRSIAAVLPEGAPEVDPRTHRLKKKPAPIPAGAPPVLPVYDAMSPGPSLAPAPAPGPGGPRHHFNGEAQVKDFIHTLLHYGGYNEMADILVNLTSLATEMGRLVSEGYVLTVLAPNDEAMAKLTTDQLSEPGAPEQIMYYHIIPEYQTEESMYNSVRRFGKIRYDSLRFPHKVEAQEADGSVKFGHGDGSAYLFDPDIYTDGRISVQGIDGVLFPEEKTPVEKKTGVPVVKKAPKPRRGKLMEVACTMLGSQFPTCQ

SEQ ID NO: 14045 - protein, 534 aa, Panicum virgatum
  misc_feature: Useful for making plants with altered carbohydrate content
MSDLESVAALMESTCSKIEQLQQAFAELERQSAVSMNLKWKQLEDHFRGLEQSLKKKFDELKEQEKEFQETVAKSEKMLEQQEATVVAKELTSLERLQEKRDAALAMIFSKSKLALPVPAINPMDKALDNLGVKWPKLASEESMCLQVDSAAVKPRSELVSLCEKMNVKGLHKFISDNRKNLATIREEIPSALKKAPHPYGLVLDSLEDFYAGDNLVLDGKKDGDLLGVRRTCLMLMESLGQLQTDNITRFSSEGHMLTTDIKERAKKTAYEWKSKLDSLDIDASNGNCLEAHAFLQLLATFGISAEYNEDDLCKLLPYVSRRRQTPELCRLLGLSQKMPGVIGVLVETGKPIDAINLAYAFELTEQFEPVQLLKAYLRDVKKVSHAKNAKMSSGAQNEMNERELSALKAVIKCIEEHKLEEHYPVDPLQKRVLQLEKAKADKRRAVEAAKPQSKRPRANGSAFAPRATSFGDKSFYPATPERHPSYPYERQFVYGAEAHHPPMMSSAPYTIQPAPAPYYGNGYPVQYQVPYIH

SEQ ID NO: 14046 - protein, 496 aa, Panicum virgatum
  misc_feature: Useful for making plants with altered carbohydrate content
MQANGRGEQHSPRSAAAGWPSPRGGGGEHYSPSPSKTPRGGAASPKLPASAAWLVDSRWALSAALSLLLFLAVGLAVTSFSSSSSAPPYISASAFFSSSDQAHHVHAADLVQEGVHVSQQQQQPESLASPPPPPGADLPRLAYLISGSKGDLERLWRALHALYHPRNQYVVHLDREAPVSERLALAARVSNSTVFRRAGNVHVVHRANMVTYRGPTMVANTLHACAILLRRGGAWDWFINLSASDYPLMTQDDILQVFSTVPSNVNFIEHTGYLGWKEGQRARPLIVDPGLYGSKKQDIFWASPKRELPTAFKLFTGSAWVALSRDFVEYTVWGWDNLPRTLLMYYANFVSSPEGYFQTLVCNAPRFVQTVANHDLHHIQWDVPPRQHPHALALADLPAMVRSGAPFARKFPRDDPVLDAIDAELLGRPPPPRGGNGTAPAAAAATFVPGGWCGGDASCGGVDNDWVLRPGPGAERFQRLIERIVRSEAFPNRQCK

SEQ ID NO: 14047 - protein, 328 aa, Panicum virgatum
  misc_feature: Useful for making plants with altered carbohydrate content
MYAVTLSSGLFLLEKYAAAVSVAAAGVILGWPFSILVFLPVTVYSLIRGPFGRVFLSGFLTSVSLLVLSFLADYHCYGRWTFSVFNLLKYNVLGGGESHLYGTEGPSFYFRNGFNNFNFAFILALLFLGVVPFARKKYAPDLLMVVSPVYIWLAFMSLQAHKEERFLYPIYTLICVAAASVIDIFPDFFHDKYSSDQSIFEKIAKGLRPLILGFILCASHSRTFSMLNGYGAPLQIYQHLEYHENSGPRSILCVGSEWHRYPSSFFIPSYISEVRWIDDGFRGLLPFPFNETLGGTTAAPAYFNNKNKASEEQYVFSILLKFHKAIFF

SEQ ID NO: 14048 - protein, 193 aa, Zea mays
  misc_feature: Useful for making plants with altered terpenoid content
MELDADNLSATELRLGLPGTSSSSRDDWQKKPSPSVGAKRVLDDGTKSEASGTSTAAGDLDFDHDTAAPPKAQVVGWPPVRAYRKNTFQAAAAKKVEQKQQQGGLYVKVSMDGAPYLRKGGPPDVQGVQGAQGGSGRALHQLLLRGGGRGRRRPPARHRLRGQGRRPHARRRRALGYVHLFLQEAEDNEGLCL

SEQ ID NO: 14049 - protein, 410 aa, Arabidopsis thaliana
  misc_feature: Useful for making plants with altered sterol content
MGSLGTMLRYPDDIYPLLKMKRAIEKAEKQIPPEPHWGFCYSMLHKVSRSFSLVIQQLNTELRNAVCVFYLVLRALDTVEDDTSIPTDEKVPILIAFHRHIYDTDWHYSCGTKEYKILMDQFHHVSAAFLELEKGYQEAIEEITRRMGAGMAKFICQEVETVDDYDEYCHYVAGLVGLGLSKLFLAAGSEVLTPDWEAISNSMGLFLQKTNIIRDYLEDINEIPKSRMFWPREIWGKYADKLEDLKYEENTNKSVQCLNEMVTNALMHIEDCLKYMVSLRDPSIFRFCAIPQIMAIGTLALCYNNEQVFRGVVKLRRGLTAKVIDRTKTMADVYGAFYDFSCMLKTKVDKNDPNASKTLNRLEAVQKLCRDAGVLQNRKSYVNDKGQPNSVFIIMVVILLAIVFAYLRAN

SEQ ID NO: 14050 - protein, 390 aa, Arabidopsis thaliana
  misc_feature: Useful for making plants with altered alkaloid content
MSDKDEFAAKKKDLVNTPVDLYPPENPMLGPSPMMDSFRETLWHDGGFNVHTDADTSFRGNNNIDIPLEMGWNMAQFPADSGFIERAAKFSFFGCGEMMMNQQQSSLGVPDSTGLFLQDTQIPSGSKLDNGPLTDASKLVKERSINNVSEDSQSSGGNGHDDAKCGQTSSKGFSSKKRKRIGKDCEEEEDKKQKDEQSPTSNANKTNSEKQPSDSLKDGYIHMRARRGQATNSHSLAERVRREKISERMKFLQDLVPGCDKVTGKAVMLDEIINYVQSLQCQIEFLSMKLSAVNPVLDFNLESLLAKDALQSSAPTFPHNMSMLYPPVSYLSQTGFMQPNISSMLLLSGGLKRQETHGYESDHHNLVHKNHETGTAPDHEDTTADMKVEP

SEQ ID NO: 14051 - protein, 431 aa, Arabidopsis thaliana
  misc_feature: Useful for making plants with altered cell wall content and/or composition
MARCCRHLAVFLCVLLMLSLCKALSSNVDDGYGHEDGSFESDSLLKLNNDDVLSLISSDETTLEASTVSVSNFGAKGDGKTDDTQAFKKAWKKACSTNGVTTFLVPKGKTYLLKSTRFRGPCKSLRNFQILGTLSASTKRSDYKDKNHWLILEDVNNLSIDGGSTGIINGNGKTWWQNSCKIDKSKPCTKAPTALTLYNLKNLNVKNLRVKNAQQIQISIEKCNKVEVSNVEITAPGDSPNTDGIHITNTQNIRVSNSDIGTGDDCISIEDGTQNLQIFDLTCGPGHGISIGSLGDDNSKAYVSGINVDGAKFSESDNGVRIKTYQGGSGTAKNIKFQNIRMENVKNPIIIDQDYCDKDKCEDQESAVQVKNVVYKNISGTSATDVAITLNCSEKYPCQGIVLENVKIKGGTASCKNANVKNQGTVSPKCS

SEQ ID NO: 14052 - protein, 324 aa, Arabidopsis thaliana
  misc_feature: Useful for making plants with altered cell wall content and/or composition
MLTDEREVVCVTGASGCIGSWLVHQLLLRGYSVHATVKNLQDEKETKHLEGLEGAATRLHLFEMDLLQYDTVSAAINGCSGVFHLASPCIVDEVQDPQKQLLDPAVKGTINVLTAAKEASVKRVVVTSSISAITPSPNWPADKIKNEECWAAEDYCRQNGLWYPLSKTLAEKAAWEFAEEKGLDVVVVNPGTVMGPVIPPSLNASMHMLLRLLQGCTETYENFFMGSVHFKDVALAHILVYEDPYSKGRHLCVEAISHYGDFVAKVAELYPNYNVPKLPRETQPGLLRDKNASKKLIDLGLKFISMEEIIKEGVESLKSKGFIS

SEQ ID NO: 14053 - protein, 261 aa, Panicum virgatum
  misc_feature: Useful for making plants with altered carbohydrate content
MAAMPAVLVLLLVAALAAPAAARIPGVYGGGNWQSAHATFYGGSDASGTMGGACGYGNLYSQGYGVKNAALSTALFNEGLSCGACFEIKCENQPGWRWCRPGSPSILVTATNFCPPNYALPSDNGGWCNPPRPHFDLAMPMFLHIAEYRAGIVPVSYRRVPCRKSGGVRFTINGFRYFNLVLITNVAGAGDIVRASVKSSSTGWLPMSRNWGQNWQSNAILVGDALSFRVTGSDRRTSTSWNVAPRNWQFGQTFEGKNFRV

SEQ ID NO: 14054 - protein, 257 aa, Arabidopsis thaliana
  misc_feature: Useful for making plants with altered cell wall content and/or composition
MAIKLAILFTTFVLFSLADARIPGIYSGGAWQNAHATFYGGSDASGTMGGACGYGNLYSQGYGTNTAALSTALFNNGMSCGACFELKCANDPQWCHSGSPSILITATNFCPPNLAQPSDNGGWCNPPREHFDLAMPVFLKIAQYRAGIVPVSYRRVPCRKRGGIRFTINGHRYFNLVLITNVAGAGDIVRASVKGSRTGWMSLSRNWGQNWQSNAVLVGQALSFRVTGSDRRTSTSWNMVPSNWQFGQTFVGKNFRV

SEQ ID NO: 14055 - protein, 540 aa, Arabidopsis thaliana
  misc_feature: Useful for making plants with modulated biomass
MQAVKRSRRHVEEEPTMVEPKTKYDRQLRIWGEVGQAALEEASICLLNCGPTGSEALKNLVLGGVGSITVVDGSKVQFGDLGNNFMVDAKSVGQSKAKSVCAFLQELNDSVNAKFIEENPDTLITTNPSFFSQFTLVIATQLVEDSMLKLDRICRDANVKLVLVRSYGLAGFVRISVKEHPIIDSKPDHFLDDLRLNNPWPELKSFVETIDLNVSEPAAAHKHIPYVVILVKMAEEWAQSHSGNLPSTREEKKEFKDLVKSKMVSTDEDNYKEAIEAAFKVFAPRGISSEVQKLINDSCAEVNSNSSAFWVMVAALKEFVLNEGGGEAPLEGSIPDMTSSTEHYINLQKIYLAKAEADFLVIEERVKNILKKIGRDPSSIPKPTIKSFCKNARKLKLCRYRMVEDEFRNPSVTEIQKYLADEDYSGAMGFYILLRAADRFAANYNKFPGQFDGGMDEDISRLKTTALSLLTDLGCNGSVLPDDLIHEMCRFGASEIHVVSAFVGGIASQEVIKLVTKQFVPMLGTYIFNGIDHKSQLLKL

SEQ ID NO: 14056 - protein, 471 aa, Arabidopsis thaliana
  misc_feature: Useful for making plants with altered cell wall content and/or composition
MKRSFLLLYVLLVQAFYGAWCSVGESLHCEYSNLASLHRPHSVSITEFGAVGDGVTLNTKAFQNALFYLNSFSDKGGAKLFVPAGQWLTGSFDLISHLTLWLDKGATILGSTSSENWPVVDPLPSYGRGRELPGRRHRSLIYGQNLTDVVITGENGTIDGQGTVWWDWFRNGELNYTRPHLVELMNSTGLIISNLTFLNSPFWNIHPVYCRDVVVKNLTILAPLESPNTDGVDPDSSTNVCIEDCYIVTGDDLVSIKSGWDEYGISYARPSSKIKINRLTGQTTSSSGIAIGSEMSGGVSEIYIKDLHLFNSNTGIRIKTSAGRGGYVRNVHILNVKLDNVKKAIRFTGKYGEHPDEKYDPKALPAIEKITFENVNGDGIGVAGLLEGIEGDVFKNICFLNVTLRVKKNSKKSPWECSNVRGYSQWVSPEITCDSLKESIFPEHGSDCFGLSENNMEISSGLSRSPWLLSW

SEQ ID NO: 14057 - protein, 67 aa, Arabidopsis thaliana
  misc_feature: Useful for making plants with modulated nitrogen use efficiency
MNQEAAETARESLELVFRMSNILETGLDRHTLSVLIALCDIGLNPEALATLVKELRRDSATTTTTVD

SEQ ID NO: 14058 - protein, 105 aa, Arabidopsis thaliana
  misc_feature: Useful for making plants with modulated biomass
  misc_feature: Useful for making plants with modulated nitrogen use efficiency
MEDFGRQRPYGDGGMQIQPYHGNQGGDFRSYSASYGTRENNIYDVKKEKSIARSKSWGITDPELQRKKRVASYKMYGVEGKVKGSFRNSFRWLKQRYTQVVYGWW

SEQ ID NO: 14059 - protein, 1065 aa, Arabidopsis thaliana
  misc_feature: Useful for making plants with altered cell wall content and/or composition
  misc_feature: Useful for making plants with modulated biomass
MVAGSYRRYEFVRNRDDSDDGLKPLKDLNGQICQICGDDVGLTKTGNVFVACNECGFPLCQSCYEYERKDGSQCCPQCKARFRRHNGSPRVEVDEKEDDVNDIENEFDYTQGNNKARLPHRAEEFSSSSRHEESLPVSLLTHGHPVSGEIPTPDRNATLSPCIDPQLPGIYQLLLLPVRILDPSKDLNSYGLVNVDWKKRIQGWKLKQDKNMIHMTGKYHEGKGGEFEGTGSNGDELQMVDDARLPMSRVVHFPSARMTPYRIVIVLRLIILGVFLHYRTTHPVKDAYALWLTSVICEIWFAFSWLLDQFPKWYPINRETFLDRLALRYDRDGEPSQLAPVDVFVSTVDPMKEPPLVTANTVLSILAVDYPVDKVACYVSDDGSAMLTFEALSETAEFSKKWVPFCKKFNIEPRAPEFYFSQKIDYLKDKIQPSFVKERRAMKREYEEFKVRINILVAKAQKIPEDGWTMEDGTSWPGNNPRDHPGMIQVFLGHSGGLDTDGNELPRLIYVSREKRPGFQHHKKAGAMNALIRVSAVLTNGAYLLNVDCDHYFNNSKAIKEAMCFMMDPAIGKKCCYVQFPQRFDGIDLHDRYANRNTVFFDINLKGLDGIQGPVYVGTGCCFNRQALYGYDPVLTEEDLEPNIIVKSCFGSRKKGKSRKIPNYEDNRSIKRSDSNVPLFNMEDIDEDVEGYEDEMSLLVSQKRLEKRFGQSPVFIAATFMEQGGLPSTTNPLTLLKEAIHVISCGYEAKTDWGKEIGWIYGSVTEDILTGFKMHARGWISIYCVPSRPAFKGSAPINLSDRLNQVLRWALGSIEILLSRHCPIWYGYNGRLKLLERIAYINTIVYPITSIPLLAYCMLPAFCLITNTFIIPEISNLASLCFMLLFASIYASAILELKWSDVALEDWWRNEQFWVIGGTSAHLFAVFQGLLKVFAGIDTNFTVTSKASDEDGDFAELYVFKWTSLLIPPTTILLVNLVGIVAGVSYAINSGYQSWGPLMGKLLFAFWVVAHLYPFLKGLLGRQNRTPTIVIVWSALLASIFSLLWVRINPFVSTTGVMSNSFMGE

SEQ ID NO: 14060 - protein, 1145 aa, Arabidopsis thaliana
  misc_feature: Useful for making plants with altered cell wall content and/or composition
MASNNHFMNSRSNLSTNSDAAEAERHQQPVSNSVTFARRTPSGRYVNYSRDDLDSELGSVDLTGYSVHIPPTPDNQPMDPSISQKVEEQYVSNSLFTGGFNSVTRAHLMEKVIDTETSHPQMAGAKGSSCAVPGCDVKVMSDERGQDLLPCECDFKICRDCFMDAVKTGGMCPGCKEPYRNTDLADFADNNKQQRPMLPPPAGGSKMDRRLSLMKSTKSGLMRSQTGDFDHNRWLFETSGTYGFGNAFWTKDGNFGSDKDGNGHGMGPQDLMSRPWRPLTRKLQIPAAVISPYRLLILIRIVVLALFLMWRIKHKNPDAIWLWGMSVVCELWFALSWLLDQLPKLCPINRATDLNVLKEKFETPTPSNPTGKSDLPGLDMFVSTADPEKEPPLVTSNTILSILAADYPVEKLACYVSDDGGALLTFEAMAEAASFANMWVPFCRKHNIEPRNPDSYFSLKRDPYKNKVKADFVKDRRRVKREYDEFKVRINSLPDSIRRRSDAYHAREEIKAMKLQRQNRDEEIVEPVKIPKATWMADGTHWPGTWINSGPDHSRSDHAGIIQVMLKPPSDEPLHGVSEGFLDLTDVDIRLPLLVYVSREKRPGYDHNKKAGAMNALVRASAIMSNGPFILNLDCDHYIYNSQALREGMCFMMDRGGDRLCYVQFPQRFEGIDPSDRYANHNTVFFDVNMRALDGLMGPVYVGTGCLFRRIALYGFDPPRAKEHHPGFCSCCFSRKKKKSRVPEENRSLRMGGDSDDDEEMNLSLVPKKFGNSTFLIDSIPVAEFQGRPLADHPAVQNGRPPGALTIPRELLDASTVAEAIAVISCWYEDKTEWGSRIGWIYGSVTEDVVTGYRMHNRGWKSVYCVTKRDAFRGTAPINLTDRLHQVLRWATGSVEIFFSRNNAFFASPRMKILQRIAYLNVGIYPFTSFFLIVYCFLPALSLFSGQFIVQTLNVTFLVYLLIISITLCLLALLEIKWSGISLEEWWRNEQFWLIGGTSAHLAAVIQGLLKVVAGIEISFTLTSKSGGEDVDDEFADLYIVKWTSLMIPPITIMMVNLIAIAVGFSRTIYSVIPQWSKLIGGVFFSFWVLAHLYPFAKGLMGRRGRTPTIVYVWSGLVAITISLLWVAINPPAGSTQIGGSFTFP

SEQ ID NO: 14061 - protein, 1065 aa, Arabidopsis thaliana
  misc_feature: Useful for making plants with modulated biomass
MESEGETAGKPMKNIVPQTCQICSDNVGKTVDGDRFVACDICSFPVCRPCYEYERKDGNQSCPQCKTRYKRLKGSPAIPGDKDEDGLADEGTVEFNYPQKEKISERMLGWHLTRGKGEEMGEPQYDKEVSHNHLPRLTSRQDTSGEFSAASPERLSVSSTIAGGKRLPYSSDVNQSPNRRIVDPVGLGNVAWKERVDGWKMKQEKNTGPVSTQAASERGGVDIDASTDILADEALLNDEARQPLSRKVSIPSSRINPYRMVIMLRLVILCLFLHYRITNPVPNAFALWLVSVICEIWFALSWILDQFPKWFPVNRETYLDRLALRYDREGEPSQLAAVDIFVSTVDPLKEPPLVTANTVLSILAVDYPVDKVSCYVSDDGAAMLSFESLAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKAKKESDKKKSGRHTDSTVPVFNLDDIEEGVEGAGFDDEKALLMSQMSLEKRFGQSAVFVASTLMENGGVPPSATPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYNGRLKFLERFAYVNTTIYPITSIPLLMYCTLPAVCLFTNQFIIPQISNIASIWFLSLFLSIFATGILEMRWSGVGIDEWWRNEQFWVIGGVSAHLFAVFQGILKVLAGIDTNFTVTSKASDEDGDFAELYLFKWTTLLIPPTTLLIVNLVGVVAGVSYAINSGYQSWGPLFGKLFFAFWVIVHLYPFLKGLMGRQNRTPTIVVVWSVLLASIFSLLWVRIDPFTSRVTGPDILECGINC

SEQ ID NO: 14062 - protein, 225 aa, Arabidopsis thaliana
  misc_feature: Useful for making plants with altered cell wall content and/or composition
MHFSSSSTSSTWTILITLGCLMLHASLSAAQLTPTFYDRSCPNVTNIVRETIVNELRSDPRIAASILRLHFHDCFVNGCDASILLDNTTSFRTEKDAFGNANSARGFPVIDRMKAAVERACPRTVSCADMLTIAAQQSVTLAGGPSWRVPLGRRDSLQAFLELANANLPAPFFTLPQLKASFRNVGLDRPSDLVALSGGHTFGKNQCQFILDRLYNFSNTGLPDP

SEQ ID NO: 14063 - protein, 354 aa, Arabidopsis thaliana
  misc_feature: Useful for making plants with modulated biomass
  misc_feature: Useful for making plants with modulated flowering time
  misc_feature: Useful for making plants with modulated nitrogen use efficiency
MAPSAQPLPVSVSDEKYANVKWEELAFKFVRTDYMYVAKCNHGESFQEGKILPFADLQLNPCAAVLQYGQGLYEGLKAYRTEDGRILLFRPDQNGLRLQAGADRLYMPYPSVDQFVSAIKQVALANKKWIPPPGKGTLYIRPILFGSGPILGSFPIPETTFTAFACPVGRYHKDNSGLNLKIEDQFRRAFPSGTGGVKSITNYCPVWIPLAEAKKQGFSDILFLDAATGKNIEELFAANVFMLKGNVVSTPTIAGTILPGVTRNCVMELCRDFGYQVEERTIPLVDFLDADEAFCTGTASIVTSIASVTFKDKKTGFKTGEETLAAKLYETLSDIQTGRVEDTKGWTVEIDRQG

SEQ ID NO: 14064 - protein, 267 aa, Panicum virgatum
  misc_feature: Useful for making plants with altered carbohydrate content
MASAFSSKAAALAALVFSLLVTYGSCARPVNFNTSAFTGDPNWEAARATWYGAPTGAGPDDDGGACGFKNVNLPPFSAMTSYGNEPLFKDGKGCGSCYQIRCTNHAACSGNPETVIITDMNYYPVAKYHFDLSGTAFGAMAKPGRNDELRHAGIIDIQFKRVPCNYPGQKVTFHVEEGSNAVYLAVLVEFEDGDGDVVQVDLMEANSGSWAPMRESWGSIWRMDSNHRLQAPFSLRITNESGKQLVASNVIPANWVPNTYYRSIIQY

SEQ ID NO: 14065 - protein, 983 aa, Arabidopsis thaliana
  misc_feature: Useful for making plants with modulated abiotic stress sensitivity
MASPHKPWRAEYAKSSRSSCKTCKSVINKENFRLGKLVQSTHFDGIMPMWNHASCILKKTKQIKSVDDVEGIESLRWEDQQKIRKYVESGAGSNTSTSTGTSTSSTANNAKLEYGIEVSQTSRAGCRKCSEKILKGEVRIFSKPEGPGNKGLMWHHAKCFLEMSSSTELESLSGWRSIPDSDQEALLPLVKKALPAAKTETAEARQTNSRAGTKRKNDSVDNEKSKLAKSSFDMSTSGALQPCSKEKEMEAQTKELWDLKDDLKKYVTSAELREMLEVNEQSTRGSELDLRDKCADGMMFGPLALCPMCSGHLSFSGGLYRCHGYISEWSKCSHSTLDPDRIKGKWKIPDETENQFLLKWNKSQKSVKPKRILRPVLSGETSQGQGSKDATDSSRSERLADLKVSIAGNTKERQPWKKRIEEAGAEFHANVKKGTSCLVVCGLTDIRDAEMRKARRMKVAIVREDYLVDCFKKQRKLPFDKYKIEDTSESLVTVKVKGRSAVHEASGLQEHCHILEDGNSIYNTTLSMSDLSTGINSYYILQIIQEDKGSDCYVFRKWGRVGNEKIGGNKVEEMSKSDAVHEFKRLFLEKTGNTWESWEQKTNFQKQPGKFLPLDIDYGVNKQVAKKEPFQTSSNLAPSLIELMKMLFDVETYRSAMMEFEINMSEMPLGKLSKHNIQKGFEALTEIQRLLTESDPQPTMKESLLVDASNRFFTMIPSIHPHIIRDEDDFKSKVKMLEALQDIEIASRIVGFDVDSTESLDDKYKKLHCDISPLPHDSEDYRLIEKYLNTTHAPTHTEWSLELEEVFALEREGEFDKYAPHREKLGNKMLLWHGSRLTNFVGILNQGLRIAPPEAPATGYMFGKGIYFADLVSKSAQYCYTCKKNPVGLMLLSEVALGEIHELTKAKYMDKPPRGKHSTKGLGKKVPQDSEFAKWRGDVTVPCGKPVSSKVKASELMYNEYIVYDTAQVKLQFLLKVRFKHKR

SEQ ID NO: 14066 - protein, 377 aa, Arabidopsis thaliana
  misc_feature: Useful for making plants with modulated biotic stress sensitivity
  misc_feature: Useful for making plants with modulated flowering time
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSESERKSLAFFLCPKKDRVVTPPRELLDSITSRRYPDFTWSMFLEFTQKHYRADMNTLQAFSDWLTKPI

SEQ ID NO: 14067 - protein, 376 aa, Arabidopsis thaliana
  misc_feature: Useful for making plants with modulated biomass
MECIIKLPQRFNKNKSKKNPLRIFDSTVLNHQPDHIPQEFVWPDHEKPSKNVPILQVPVIDLAGFLSNDPLLVSEAERLVSEAAKKHGFFLVTNHGVDERLLSTAHKLMDTFFKSPNYEKLKAQRKVGETTGYASSFVGRFKENLPWKETLSFSFSPTEKSENYSQTVKNYISKTMGDGYKDFGSVYQEYAETMSNLSLKIMELLGMSLGIKREHFREFFEDNESIFRLNYYPKCKQPDLVLGTGPHCDPTSLTILQQDQVSGLQVFVDNQWQSIPPIPQALVVNIGDTLMALTNGIYKSCLHRAVVNGETTRKTLAFFLCPKVDKVVKPPSELEGERAYPDFTWSMFLEFTMKHYRADMNTLEEFTNWLKNKGSF

SEQ ID NO: 14068 - protein, 349 aa, Panicum virgatum
  misc_feature: Useful for making plants with altered carbohydrate content
MAARAGFLLAAAAWVCLSAVSASAFDDVPTAAFDERFSSLFGDGNLVRSSDDRSVRLLLDRRSGSGFMSSHYYLHGFFSASIKLPKDYTAGVVVAFYLSNGDVYEKTHDELDFEFLGSRWGGQWRVQTNVYGNGSTSRGREERYLLPFDPTLEAHRYSVLWAPTHIIFYIDDTPIREVIRHPDMGGDFPAKPMAVYATIWDGSAWATEGGKYKVNYKYAPFASEFSDLAVVGPRADPVLRVPRRGGAGDQDDDQDLLGLMTADYAVMTPQKRAAMRAFRARHMTYTVCYDAARYASGPIPECDNSDEERENFSAWGESKTVVMRPRARGRRRGRKAGGAAAARGRAASS

SEQ ID NO: 14069 - protein, 264 aa, Arabidopsis thaliana
  misc_feature: Useful for making plants with altered cell wall content and/or composition
MIKLPADYTAGVVVAFYTSNGDVFEKTHDELDIEFLGNIKGKPWRFQTNLYGNGSTHRGREERYRLWFDPSKEFHRYSILWTPHKIIFWVDDVPIREVIRNDAMGADYPAKPMALYATIWDASDWATSGGKYKANYKFAPFVAEFKSFSLDGCSVDPIQEVPMDCSDSVDFLESQDYSSINSHQRAAMRRFRQRFMYYSYCYDTLRYPEPLPECVIVPAEKDRFKETGRLKFGGTEARERRRNRRQQRRPEIEIESDPDDRKLL

SEQ ID NO: 14070 - protein, 371 aa, Panicum virgatum
  misc_feature: Useful for making plants with altered carbohydrate content
MKGGDVSSISPLVSFVLGAAMATVCVLFFMSASPTRRLADISAFTSGNATNDDLRLASSSSSDNGVADGNAEVTATPAPAPAPVQAPSPWGDLEEVLRRAATKDRTVIMTQINAAWTRPGSLLDLFFESFRTGEGGVARLLEHLVIVTMDPAAYQGCQAVHRHCYFLRTSNGVDYRSEKMFMSKDYLEMMWGRNRFQQTVLELGYNFLFTDVDVMWFRDPFRHISMAADIAISSDVYMGDPYSLRNFPNGGFLFVRSSAKTIDFYHAWQQGRWRFFGKHEQDVFNLIKHDMAAKLDLAIQFLDTTYISGFCQLSKDLNKICTLHANCCVGLGAKLHDLRGVLDVWRNYTAGTPQDRRAGKFQWKLPGICIH

SEQ ID NO: 14071 - protein, 425 aa, Panicum virgatum
  misc_feature: Useful for making plants with altered carbohydrate content
MAKVAAEAAGRQAASFVLGCVAALTVVVLILQRRPEELTRPREPVQFFAGSRSESSPSSGRRGGASSSGSSSSSTPAGQTTAIVAADDGQPQAAVPVQANATKLKPAAAGAGGATTAAAAADDLRRVPATPAHRQQEGEAADDDAEFPGLAAVVARAATADDRTVIITCVNHAWAAPGSLLDLFLESFRVGDGIAELLGHVLIVAMDPTAMARCRALHPHCYLYTMPGVDFASAKFFLSKEYLELVWSKLKLQRRVLQLGYNFLFTDVDILWFRNPFKHVTAYADMSISSDVFFGDPDNIDNFPNTGFFHVRPNNRTIAMTRAWHEARERYPGRNEQPVFNAIKKELVRDLRLRVQYMDPAFMGGFCSYGKDLRRICTMHANCCVGLANKLRDLGTLLQDWRNYTAMPHWAKQHAKWTVPGACIH

SEQ ID NO: 14072 - protein, 394 aa, Panicum virgatum
  misc_feature: Useful for making plants with altered carbohydrate content
MVPNEIIPDIAASPAAADRWVADNLVPYYPATRVKFLLVGNEILSDYSIANSTWARLVPAMENIHLSLRKRGISSVKIGTTLAMDALADGAFPRPPSAAAFRPDIAGSVVRPLLHFLNGTNSYYFVDAYPYFVWAGNNLTVPLDYALFQGGRTRYVDPGTGLTYTNLLDEMLDAVAIAMAKLGYGGVKLAVAETGWPNGCDYDQIGGNVHNAAIYNRNLAARMAKNPGTPLRPGAKMPVFVFSLYNEDLKGGPGTERHWGLYYANGTAVYEVDLTGRRPLCSYPPLPAPENNTPYKGPIWCVMSPAASKKLNETAVGNALSYACGQGNGTCDAIQPGKKCYLPNTTVAHASYAFNSYWQQFRRTGATCYFNNLAEQTIKDPSHGSCKFRSSLDS

SEQ ID NO: 14073 - protein, 411 aa, Oryza sativa subsp. japonica
  misc_feature: Useful for making plants with modulated water use efficiency
MASVGVVRSSLGFQNETSTSGDADRLPNEMSNMSIRDDNKDIDDIVVNGNGTEPGHVIVTSIDGRNGQAKQTISYMAERVVGHGSFGTVFQAKCLETGETVAIKKVLQDKRYKNRELQTMRVLDHPNVVSLKHCFFSKTEKEELYLNLVLEYVPETAHRVIKHYNKMNQRMPLIYAKLYMYQICRALAYIHNTIGVCHRDIKPQNLLVNPHTHQLKLCDFGSAKVLVKGEPNISYICSRYYRAPELIFGATEYTTAIDVWSAGCVLAELLLGQPLFPGDSGVDQLVEIIKVLGTPTREEIKCMNPNYTEFKFPQIKAHPWHKIFHKRMPAEAVDLVSRLLQYSPYLRSTAPEALIHPFFDELRDPNTRLPNGRFLPPLFNFKPHELKGMPMEFLVKLIPEHARKQCAFVGW

SEQ ID NO: 14074 - protein, 380 aa, Arabidopsis thaliana
  misc_feature: Useful for making plants with modulated biomass
MADDKEMPAAVVDGHDQVTGHIISTTIGGKNGEPKQTISYMAERVVGTGSFGIVFQAKCLETGETVAIKKVLQDRRYKNRELQLMRVMDHPNVVCLKHCFFSTTSKDELFLNLVMEYVPESLYRVLKHYSSANQRMPLVYVKLYMYQIFRGLAYIHNVAGVCHRDLKPQNLLVDPLTHQVKICDFGSAKQLVKGEANISYICSRFYRAPELIFGATEYTTSIDIWSAGCVLAELLLGQPLFPGENAVDQLVEIIKVLGTPTREEIRCMNPHYTDFRFPQIKAHPWHKIFHKRMPPEAIDFASRLLQYSPSLRCTALEACAHPFFDELREPNARLPNGRPFPPLFNFKQEVAGSSPELVNKLIPDHIKRQLGLSFLNQSGT

SEQ ID NO: 14075 - protein, 286 aa, Arabidopsis thaliana
  misc_feature: Useful for making plants with modulated biomass
MNFKNVKVPKGPGGGVIAAVVIGGLSLYGATHTLYNVDGGHRAIVFNRLVGIKDKVYPEGTHLMIPWFERPIIYDVRAKPYLVESTSGSRDLQMVKIGLRVLTRPMADQLPEVYRSLGENYRERVLPSIIHETLKAVVAQYNASQLITQRESVSREIRKILTLRAANFHIALDDVSITGLTFGKEFTAAIEGKQVAAQEAERAKFIVEKAEQDKRSAVIRAEGEAKSAQLIGQAIANNQAFLTLRKIEAAREIAQTISRSANKVYLSSNDLLLNLQAMDLDVKPKK

SEQ ID NO: 14076 - protein, 439 aa, Arabidopsis thaliana
  misc_feature: Useful for making plants with modulated nitrogen use efficiency
MALNKLLSLTFQLLLFLLSVSSESPWIAEDTSQIQTKLLEFAKSPEVFDWMVKIRRKIHENPELGYEELETSKLIRSELELIGIKYRYPVAITGVIGYIGTGEPPFVALRADMDALPIQEGVEWEHKSKIAGKMHACGHDGHVTMLLGAAKILHEHRHHLQGTVVLIFQPAEEGLSGAKKMREEGALKNVEAIFGIHLSARIPFGKAASRAGSFLAGAGVFEAVITGKGGHAAIPQHTIDPVVAASSIVLSLQQLVSRETDPLDSKVVTVSKVNGGNAFNVIPDSITIGGTLRAFTGFTQLQQRVKEVITKQAAVHRCNASVNLTPNGREPMPPTVNNKDLYKQFKKVVRDLLGQEAFVEAAPVMGSEDFSYFAETIPGHFSLLGMQDETNGYASSHSPLYRINEDVLPYGAAIHASMAVQYLKEKASKGSVSGFHEEL

SEQ ID NO: 14077 - protein, 261 aa, Arabidopsis thaliana
  misc_feature: Useful for making plants with modulated biomass
MSGLRRLDGKIAIITGGASGIGAEAVRLFTDHGAKVVIVDIQEELGQNLAVSIGLDKASFYRCNVTDETDVENAVKFTVEKHGKLDVLFSNAGVLEAFGSVLDLDLEAFDRTMAVNVRGAAAFIKHAARSMVASGTRGSIVCTTSIAAEIGGPGPHSYTASKHALLGLIRSACAGLGQYGIRVNGVAPYGVATGMTSAYNEEAVKMLEEYGEALGNLKGVVLKARHIAEAALFLASDDSVYISGQNLVVDGGFSVVKLMST

SEQ ID NO: 14078 - protein, 374 aa, Zea mays
  misc_feature: Useful for making plants with modulated drought sensitivity
MGNCAGVEGNAEINPSFSAPNSSGTAGSKSVSKNAADTGTFGTKTSGSSSSVPPTPRTEAEILESSNVRKFSFGELKGSTRNFRPDSLLGEGGFGSVFKGWMDERTLAPVRPGAGIIVAVKKLKLDSFQGHREWLAEVNYLGQLSHPNLVKLIGYCLEDEQRLLVYEYMPRGSLEHHLFRRGSNFQPLPWNLRMKVALEAARGLAFLHGDQAKVIYRDFKTSNILLDSEYNAKLSDFGLAKDGPSGDKSHVSTRVMGTQGYAAPEYLATGHLTAKSDVYSYGVVLLELLSGQRALDKNRPPGQHNLVEWARPYITNKRRVIHVLDSRLGSQYSLPAAQKVATLALQCLSMDARCRPAMDQVVTALEQLQRPRAH

SEQ ID NO: 14079 - protein, 324 aa, Arabidopsis thaliana
  misc_feature: Useful for making plants with modulated heat sensitivity
MFLEREDLGKVFKGWLEDKTPGKQSNGTVIAVKKLNAESFQGFEEWQCEVNFLGRVSHPNLVKLLGYCLEGEELLLVYEYMQKGSLENHLFRKGSAVQPLSWEIRLKIAIGAAKGLAFLHASEKQVIYRDFKASNILLDGSYNAKISDFGLAKLGPSASQSHITTRVMGTHGYAAPEYVATGHLYVKSDVYGFGVVLAEILTGLHALDPTRPTGQHNLTEWIKPHLSEKRKLRSIMDPRLEGKYPFKSAFRVAQLALKCLGPEPKNRPSMKEVVESLELIEAANEKPLERRTTRASPSIRQQQGHYRPQQLSSFRPRHTVSRAH

SEQ ID NO: 14080 - protein, 573 aa, Nicotiana tabacum
  misc_feature: Useful for making plants with modulated drought sensitivity
  misc_feature: Useful for making plants with modulated heat sensitivity
DPSVQSDMKHWPFKVVPGPGDKPMIVVQYKGEEKQFAPEEISSMVLTKMKEVAEAFLGQTVKNAVVTVPAYFNDSQRQATKDAGAISGLNVMRIINEPTAAAIAYGLDKKASRSGEKNVLIFDLGGGTFDVSLLTIEEGIFEVKATAGDTHLGGEDFDNRLVNHFVQDFKRKHKKDISGNARALRRLRTACERAKRTLSSTAQTTIEIDSLYEGIDFYATITRARFEEMNMDLFRKCMEPVEKCLRDAKIDKSHVHDVVLVGGSTRIPKVQQLLQDFFNGKELCKSINPDEAVAYGAAVQAAILSGEGDQKVQDLLLLDVTPLSLGLETAGGVMTVLIPRNTTIPTKKEQIFSTYSDNQPGVLIQVYEGERPMTKDNNLLGKFELKGIPPAPRGVPQINVCFDIDANGILNVSAEDKTAGVKNKITITNDKGRLSKEEIERLVQEAERYKAEDESMKKKVEAKNSLENYAYNMRNTVRDEKFSGKLDPSDKQKIEKAVDETIDWLDGNQLVEVDEFEDKLKDLENLCNPIIAKMYQGGADGDVPMGGSADTGAGYGKAGSTNNGAGPKIEEVD

SEQ ID NO: 14081 - protein, 130 aa, Arabidopsis thaliana
  misc_feature: Useful for making plants with modulated nitrogen use efficiency
MTFKRRNGGRNKHNRGHVKPIRCSNCGKCCPKDKAIKRFIVRNIVEQAAIRDVQEASVYEGYTLPKLYAKTQYCVSCAIHSHVVRVRSRTNRRVRTPPPRFARRKEDTPKPAQPGQAPRPAGGAPAAPRA

SEQ ID NO: 14082 - protein, 280 aa, Glycine max
  misc_feature: Useful for making plants with modulated salt sensitivity
MSTTGTVLASTPTQRLLGKVALVTGGASGIGESIVRLFHIHGAKICIADVQDNLGKQVCQSLGDEANVVFVHCDVTVEDDVSHAVDFTVGKFGTLHIIVNNAGISGSPCSDIRNADLSEFDKVFSVNTKGVFHGMKHAARIMIPKKKGSIISLCSVASAIGGLGPHAYTGSKYAVLGLTKNVAAELGKHAIRVNCVSPYGVATGLALAHLPEDERTDDALVSFRDFTGRMANLQGVELTTHDVANAVLFLASDDAKYISGENLMVDGGFTSANHSLQVFR

SEQ ID NO: 14083 - protein, 285 aa, Arabidopsis thaliana
  misc_feature: Useful for making plants with modulated drought sensitivity
  misc_feature: Useful for making plants with modulated water use efficiency
MSTNTESSSYSSLPSQRLLGKVALITGGATGIGESIVRLFHKHGAKVCIVDLQDDLGGEVCKSLLRGESKETAFFIHGDVRVEDDISNAVDFAVKNFGTLDILINNAGLCGAPCPDIRNYSLSEFEMTFDVNVKGAFLSMKHAARVMIPEKKGSIVSLCSVGGVVGGVGPHSYVGSKHAVLGLTRSVAAELGQHGIRVNCVSPYAVATKLALAHLPEEERTEDAFVGFRNFAAANANLKGVELTVDDVANAVLFLASDDSRYISGDNLMIDGGFTCTNHSFKVFR

SEQ ID NO: 14084 - protein, 1174 aa, Arabidopsis thaliana
  misc_feature: Useful for making plants with altered cell wall content and/or composition
MESEGETAGKPMKNIVPQTCQICSDNVGKTVDGDRFVACDICSFPVCRPCYEYERKDGNQSCPQCKTRYKRLKGSPAIPGDKDEDGLADEGTVEFNYPQKEKISERMLGWHLTRGKGEEMGEPQYDKEVSHNHLPRLTSRQDTSGEFSAASPERLSVSSTIAGGKRLPYSSDVNQSPNRRIVDPVGLGNVAWKERVDGWKMKQEKNTGPVSTQAASERGGVDIDASTDILADEALLNDEARQPLSRKVSIPSSRINPYRMVIMLRLVILCLFLHYRITNPVPNAFALWLVSVICEIWFALSWILDQFPKWFPVNRETYLDRLALRYDREGEPSQLAAVDIFVSTVDPLKEPPLVTANTVLSILAVDYPVDKVSCYVSDDGAAMLSFESLAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKAKKESDKKKSGRHTDSTVPVFNLDDIEEGVEGAGFDDEKALLMSQMSLEKRFGQSAVFVASTLMENGGVPPSATPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYNGRLKFLERFAYVNTTIYPITSIPLLMYCTLPAVCLFTNQFIIPQISNIASIWFLSLFLSIFATGILEMRWSGVGIDEWWRNEQFWVIGGVSAHLFAVFQGILKVLAGIDTNFTVTSKASDEDGDFAELYLFKWTTLLIPPTTLLIVNLVGVVAGVSYAINSGYQSWGPLFGKLFFAFWVIVHLYPFLKGLMGRQNRTPTIVVVWSVLLASIFSLLWVRIDPFTSRVTGPDILECGINCLFKWTTLLIPPTTLLIVNLVGVVAGVSYAINSGYQSWGPLFGKLFFAFWVIVHLYPFLKGLMGRQNRTPTIVVVWSVLLASIFSLLWVRIDPFTSRVTGPDILECGINC

SEQ ID NO: 14085 - protein, 430 aa, Arabidopsis thaliana
  misc_feature: Useful for biocontainment applications
MEVNVLASKRSLLLFLLIVSLSLSQKVRHISAFNDTKPYRQVSSLRLARIQKHLNKINKSPVFTIQSPDGDVIDCVPKRKQPALDHPLLKHHKIQKAPKKMPKMKGKDDDVKEAENVLEGAWQMWHVNGTRCPKGTVPIRRNTMNDVLRAKSLFDFGKKRRSIYLDQRTEKPDALGTNGHEHAIAYTESSSEIYGAKATINVWDPKIEEVNEFSLSQIWILSGSFVGPDLNSIEAGWQVSPELYGDNRPRLFTYWTSDSYQATGCYNLLCSGFIQTNNKIAIGAAISPLSTFKGNQFDITILIWKDPKMGNWWMGLGDSTLVGYWPAELFTHLADHATTVEWGGEVVNTRASGRHTTTQMGSGHFPDEGFGKASYFRNLEVVDSDNSLVPVHDVKILAENTECYDIKSSYSNEWGTYFYYGGPGFNPRCN

SEQ ID NO: 14086 - protein, 301 aa, Glycine max
  misc_feature: Useful for making plants with modulated nitrogen use efficiency
MKDFPSCFGENAVQVADSSSSSSSKTAQNLVICVYQCRIWGKCCFITITWTKSLMGQGLSVGIDDYSSNQCLCKVDIKPWVFSKRRGCKSLEAYSCKIDVYWDLSNARFGVGPEPLEGFYVGVVVDRQMVLLLGDLRKEAFKKSSAIPLPSNAVFVAKKEHVFGKKMFGNKAVFCDNGQIHDLVIECDTSGVSDPCLIIRIDSKTVMQVKRLKWKFRGNHTILVDGLAVEVFWDVYNWLFGGTSLGNAVFMFRTCISAEKFWAGEPLSDANVVQWSFSQRFSETKSQGVGFSHILYAWKND

SEQ ID NO: 14087 - protein, 491 aa, Panicum virgatum
  misc_feature: Useful for making plants with altered carbohydrate content
MAGAEAEHGGAASPSPLHVVVFPWLAFGHMIPFLELSKRLARRGHAVTFVSTPRNAARLGAVPPELAARLRVAALELPGVEGLPRGAESTADVPPEKVGLLKKAFDGLAAPFADLVAEACAGANGDATAGFSRKPDFVIHDFAQNWIWPVAEEHEIPCAVFIIFPAAILAFVGSREANEAHPRSTAAEDYMVPPPWIDFPSTMAHRRHEARAIAALFRPNDSGVSDVERFWEMQRPCCRLVVLRSCPEAEPRLFPLLTELYARPVVPAGLLLPDELVGGDDDGAPGGDRPIPDVVRWLDGQPLRSVVYVALGSEAPVTAEHVRELALGLELSGARFLWALRRPVGHSGELLPDGFERRVAGRGVVRAGWVPQVRVLAHAAVGAFLTHCGWGSTVESLFRFGHPLVMLPFVADQGLIARAMAALGVGVEVPRNEDDGSFRGDDVAAAVRRVMEEEEGQELARNARELQEVVGDRARQEQYVDELVDHLRRCK

SEQ ID NO: 14088 - protein, 201 aa, Panicum virgatum
  misc_feature: Useful for making plants with altered carbohydrate content
MALARGGRGSSSRAAAAALAAALAAAVLAGVASGDFAADRAECANQLMGLATCLTFVQDKATAVAPTRDCCAGLKLVVAASKKCMCVLVKDRDEPALGFKINVTRAMDLPSLCNYPATFSDCPKILGMSPDAPEAEIFKEYARKHESQNGTATIPAAATGAAGGKSATSSSPAGGAGAGSKPGAVVVYLASALVAFVSVLA

SEQ ID NO: 14089 - protein, 472 aa, Panicum virgatum
  misc_feature: Useful for making plants with altered carbohydrate content
MGAPAHGALLLSLLLLAGAAAAAEDAAPREPTLPAAGAGGGGGAAVGINSNSVLVALLDSHYTELAELVEKALLLQTLEDAVGRHNVTIFAPRNEALERDLDPEFKRFLLEPRNLKSLQALLLYHVLPARLPSDSWPAASHPTLSGEEVELAAAAGGAAAGMRVGHAAVTRPDAVLRPDGVIHGIERLLVPRSVQEDFNRRRSLAAISAVLPTGAPEVDPRTHRLKKPAPPVPPGAPPVLPIWDAMAPGPSIAPAPAPGPSSGKHHFDGHSQVKDFIQTLLLYGGYNELADILVNLTSLATEMGRLVSEGYVLTVLAPNDEAMARLTTDQLSEPGSPENILYYHMVPEYQTEESMYNAVRRFGKVRYDTLRLPHKVVAREADGSVKFGQGEGSAYLFDPDIYTDGRISVQGIDAVLFPPGDKNATQTADPHRKPPAITTHKKIKLRRGKLLEASCQMAALFGQRSRFVSCQD

SEQ ID NO: 14090 - protein, 444 aa, Arabidopsis thaliana
  misc_feature: Useful for making plants with modulated flowering time
MREILHIQGGQCGNQIGAKFWEVICDEHGIDHTGQYVGDSPLQLERIDVYFNEASGGKYVPRAVLMDLEPGTMDSLRSGPFGQIFRPDNFVFGQSGAGNNWAKGHYTEGAELIDSVLDVVRKEAENSDCLQGFQVCHSLGGGTGSGMGTLLISKIREEYPDRMMMTFSVFPSPKVSDTVVEPYNATLSVHQLVENADECMVLDNEALYDICFRTLKLANPTFGDLNHLISATMSGVTCCLRFPGQLNSDLRKLAVNLIPFPRLHFFMVGFAPLTSRGSQQYSALSVPELTQQMWDAKNMMCAADPRHGRYLTASAVFRGKLSTKEVDEQMMNIQNKNSSYFVEWIPNNVKSSVCDIAPKGLKMASTFIGNSTSIQEMFRRVSEQFTAMFRRKAFLHWYTGEGMDEMEFTEAESNMNDLVAEYQQYQDATAGEEEYEEEEEEYET

SEQ ID NO: 14091 - protein, 44 aa, Arabidopsis thaliana
  misc_feature: Useful for making plants with modulated nitrogen use efficiency
MGHSNVWNSHPKKYGPGSRLCRVCGNSHGSDPEVWFELLQTVFP

SEQ ID NO: 14092 - protein, 450 aa, Arabidopsis thaliana
  misc_feature: Useful for making plants with altered cell wall content and/or composition
MREIISIHIGQAGIQVGNSCWELYCLEHGIQPDGMMPSDTTVGVAHDAFNTFFSETGAGKHVPRAVFVDLEPTVIDEVRTGTYRQLFHPEQLISGKEDAANNFARGHYTVGKEIVDLCLDRVRKLADNCTGLQGFLVFNAVGGGTGSGLGSLLLERLSVDYGKKSKLGFTIYPSPQVSTAVVEPYNSVLSTHSLLEHTDVAVLLDNEAIYDICRRSLDIERPTYTNLNRLISQIISSLTTSLRFDGAINVDITEFQTNLVPYPRIHFMLSSYAPVISAAKAYHEQLSVPEITNAVFEPASMMAKCDPRHGKYMACCLMYRGDVVPKDVNAAVGTIKTKRTVQFVDWCPTGFKCGINYQPPTVVPGGDLAKVQRAVCMISNNTAVAEVFSRIDHKFDLMYAKRAFVHWYVGEGMEEGEFSEAREDLAALEKDYEEVGAEGGDDEEDEGEDY

SEQ ID NO: 14093 - protein, 363 aa, Arabidopsis thaliana
  misc_feature: Useful for biocontainment applications
  misc_feature: Useful for making plants with modulated biomass
  misc_feature: Useful for making plants with modulated time to senescence
MDKYELVKDIGAGNFGVARLMKVKNSKELVAMKYIERGPKIDENVAREIINHRSLRHPNIIRFKEVVLTPTHLAIAMEYAAGGELFERICSAGRFSEDEARYFFQQLISGVSYCHAMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTIQKIMAVQYKIPDYVHISQDCKNLLSRIFVANSLKRITIAEIKKHSWFLKNLPRELTETAQAAYFKKENPTFSLQTVEEIMKIVADAKTPPPVSRSIGGFGWGGNGDADGKEEDAEDVEEEEEEVEEEEDDEDEYDKTVKEVHASGEVRIS

SEQ ID NO: 14094 - protein, 343 aa, Arabidopsis thaliana
  misc_feature: Useful for making plants with modulated water use efficiency
MERYEIVKDIGSGNFGVAKLVRDKFSKELFAVKFIERGQKIDEHVQREIMNHRSLIHPNIIRFKEVLLTATHLALVMEYAAGGELFGRICSAGRFSEDEARFFFQQLISGVNYCHSLQICHRDLKLENTLLDGSEAPRVKICDFGYSKSGVLHSQPKTTVGTPAYIAPEVLSTKEYDGKIADVWSCGVTLYVMLVGAYPFEDPSDPKDFRKTIGRILKAQYAIPDYVRVSDECRHLLSRIFVANPEKRITIEEIKNHSWFLKNLPVEMYEGSLMMNGPSTQTVEEIVWIIEEARKPITVATGLAGAGGSGGSSNGAIGSSSMDLDDLDTDFDDIDTADLLSPL

SEQ ID NO: 14095 - protein, 90 aa, Oryza sativa subsp. japonica
  misc_feature: Useful for making plants with modulated flowering time
MSKARVYADVNVLRPKEYWDYEALTVQWGEQDDYEVVRKVGRGKYSEVFEGINVNNNEKCIIKILKPVKKKKIKREIKILQNLCGGPNIV

SEQ ID NO: 14096 - protein, 108 aa, Arabidopsis thaliana
  misc_feature: Useful for making plants with altered lignin content
MKIIVSILVLASLLLISSSLASATISDAFGSGAVAPAPQSKDGPALEKWCGQKCEGRCKEAGMKDRCLKYCGICCKDCQCVPSGTYGNKHECACYRDKLSSKGTPKCP

SEQ ID NO: 14097 - protein, 99 aa, Arabidopsis thaliana
  misc_feature: Useful for making plants with altered terpenoid content
MAIFRSTLVLLLILFCLTTFELHVHAAEDSQVGEGVVKIDCGGRCKGRCSKSSRPNLCLRACNSCCYRCNCVPPGTAGNHHLCPCYASITTRGGRLKCP

SEQ ID NO: 14098 - protein, 754 aa, Arabidopsis thaliana
  misc_feature: Useful for making plants with modulated flowering time
MASSSSSSSSITIITTFLFLLLHTTAKKTYIIRVNHSDKPESFLTHHDWYTSQLNSESSLLYTYTTSFHGFSAYLDSTEADSLLSSSNSILDIFEDPLYTLHTTRTPEFLGLNSEFGVHDLGSSSNGVIIGVLDTGVWPESRSFDDTDMPEIPSKWKGECESGSDFDSKLCNKKLIGARSFSKGFQMASGGGFSSKRESVSPRDVDGHGTHTSTTAAGSAVRNASFLGYAAGTARGMATRARVATYKVCWSTGCFGSDILAAMDRAILDGVDVLSLSLGGGSAPYYRDTIAIGAFSAMERGVFVSCSAGNSGPTRASVANVAPWVMTVGAGTLDRDFPAFANLGNGKRLTGVSLYSGVGMGTKPLELVYNKGNSSSSNLCLPGSLDSSIVRGKIVVCDRGVNARVEKGAVVRDAGGLGMIMANTAASGEELVADSHLLPAIAVGKKTGDLLREYVKSDSKPTALLVFKGTVLDVKPSPVVAAFSSRGPNTVTPEILKPDVIGPGVNILAGWSDAIGPTGLDKDSRRTQFNIMSGTSMSCPHISGLAGLLKAAHPEWSPSAIKSALMTTAYVLDNTNAPLHDAADNSLSNPYAHGSGHVDPQKALSPGLVYDISTEEYIRFLCSLDYTVDHIVAIVKRPSVNCSKKFSDPGQLNYPSFSVLFGGKRVVRYTREVTNVGAASSVYKVTVNGAPSVGISVKPSKLSFKSVGEKKRYTVTFVSKKGVSMTNKAEFGSITWSNPQHEVRSPVAFSWNRF

SEQ ID NO: 14099 - protein, 305 aa, Lycopersicon peruvianum
  misc_feature: Useful for making plants with modulated biotic stress sensitivity
TNSINDALSSSYLVPFESYRVPLVDLEEATNNFDDKFFIGHGVFGKVYKGVLRDGTKVALKRRQPESSQGIEEFETEIETLSFCRHPHLVSLIGFCDERNEMVLIYKYMENGNLKRYLYGSDLPTMSMSWEQRLEICIGAARGLHYLHTRAVIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNKGQLEQIVDPNLADKIRPESLRKFGETAVKCLALSSEDRPSMGDVLWKLEYA

SEQ ID NO: 14100 - protein, 458 aa, Panicum virgatum
  misc_feature: Useful for making plants with altered carbohydrate content
MAAAAAPPRPRVMVLPFPAQGHVMPLMELSRRLVDHGFEVDFVNTEYNQARVLAALETAGGETGAAVHAGIHLVSIPDGMGADCDRTDVVKLGQGLPAAMLSRLEELIRARNTRWVVADVSMSWVLDLVATVSVRVALFLTYSAAIFALRAHVPKLIEDGIVDENGNVKRNERIQLSPKMPAITAAELPWTGVGTSPEARRAVIQGAIKYTPYTLADTILCNTFQEIESEALALLPKEPLAIGPLVASKPTSAGHFWPQDLTSLAWLDAQAPSSVVYVAFGSFTVFDTTRLQELADGLVLTGRQFLWVIRPNFTNGVDEGWLDEFRCRVGGKGLVVGWAPQQRVLSHPSVACFISHCGWNSTMEGVCHGVPFLCWPYFADQFLNQSYICDMWGTGLRICTDEQGIVTKEEIRDKVARLLGDEGIKARALSLKSKACMSIADGGPSNQDLLEFVNLLSA

SEQ ID NO: 14101 - protein, 456 aa, Panicum virgatum
  misc_feature: Useful for making plants with altered carbohydrate content
MAKPHILVLPLQFQGHVTPLMELSHRLVDHGFEVTFVNTEVPHARVVGALQAAGGAATLAGIHLASIPDGLEDGDRMDVGKIADSYDRHIPGHLERLIAEMEASGRPKVKWIVCDVYMLSSFLVAKKFGIRVAAVWATAAACLAISTKIPKLIEDGLVNDKGSPERDEMVQFAPGIPPVHTSQLPWINVIPLEWQRSLFDLYKQTERLSALVEMVVCNSFSELEAGAFTLLPNVLPIGPLTSDRELQKPVGQLLPEDTRCLPWLDAQPDGSVVYVAFGSSTFFDPRQFRELAEGLQLTGRPFLWVVRTDFTTGDVSKAWFDEFKARIAGAGMVVSWCPQQKVLAHRAVACFVSHCGWNSIMEGVRNGVPFLGWPYFADQFLDRNYVTDVWRTGLAVSPGADGVVTKEELRSKVEQVIGDDEIRERARLLRDAAGRAIGEGGASYENFRKFVDLLRE

SEQ ID NO: 14102 - protein, 197 aa, Arabidopsis thaliana
  misc_feature: Useful for biocontainment applications
MKVLLGLLLLLSLTNSSSAIYCLCKDGIGDTELQTSIDYACGTLADCNPIHDKGTCYQPDTIKSHCDWAVNSYFQNAAQVPGSCNFSGTATTNPNPPSNLANGCIYPSSPSSTRSPPSTTPPTGTTPTNGTTPFPGTPFPGTPFPGTPPVFGPTGVFNPSNPGSGASSLGTSSVFTLCFSLLAFLWGSDVRFGFSHV

SEQ ID NO: 14103 - protein, 147 aa, Arabidopsis thaliana
  misc_feature: Useful for making plants with modulated nitrogen use efficiency
MRFLRKRMNTKPSHGPIHFRAPSKIFWRTVRGMIPHKTKRGAAALARLKVFEGVPPPYDKVKRMVIPDALKVLRLQAGHKYCLLGRLSSEVVWNHYDTIKELEVKRKERSQALYERKKQLTKLRAKAEKVAEEKLGSQLDVLASIKY

SEQ ID NO: 14104 - protein, 449 aa, Panicum virgatum
  misc_feature: Useful for making plants with altered carbohydrate content
MAAGGRSVACCTAVLLAAALLLSAPTATEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFTSDGRRATQALMTWNVTCTYSQFLAQKTPSCCVSLSSFYNDTIVNCPTCSCGCQNPSGSNCVNEDSPNLQSAIDGPGKWTGQPLVQCTSHMCPIRIHWHVKLNYKEYWRVKITITNFNFRMNYTQWNLVVQHPNFDNITQLFSFNYKPLTPYGGGINDTAMFWGVKFYNDLLMQAGKLGNVQSELLLRKDSQAFTFEKGWAFPRRVYFNGDNCVMPSPENYPWLPNASPLTKQPLTLPLLVFWVVLATLLAYA

SEQ ID NO: 14105 - protein, 1122 aa, Arabidopsis thaliana
  misc_feature: Useful for making plants with modulated biomass
  misc_feature: Useful for making plants with modulated light quality response
  misc_feature: Useful for making plants with modulated light quality sensitivity
MSGSRPTQSSEGSRRSRHSARIIAQTTVDAKLHADFEESGSSFDYSTSVRVTGPVVENQPPRSDKVTTTYLHHIQKGKLIQPFGCLLALDEKTFKVIAYSENASELLTMASHAVPSVGEHPVLGIGTDIRSLFTAPSASALQKALGFGDVSLLNPILVHCRTSAKPFYAIIHRVTGSIIIDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASLVMAVVVNEEDGEGDAPDATTQPQKRKRLWGLVVCHNTTPRFVPFPLRYACEFLAQVFAIHVNKEVELDNQMVEKNILRTQTLLCDMLMRDAPLGIVSQSPNIMDLVKCDGAALLYKDKIWKLGTTPSEFHLQEIASWLCEYHMDSTGLSTDSLHDAGFPRALSLGDSVCGMAAVRISSKDMIFWFRSHTAGEVRWGGAKHDPDDRDDARRMHPRSSFKAFLEVVKTRSLPWKDYEMDAIHSLQLILRNAFKDSETTDVNTKVIYSKLNDLKIDGIQELEAVTSEMVRLIETATVPILAVDSDGLVNGWNTKIAELTGLSVDEAIGKHFLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNNAVTSQDPEKVSFAFFTRGGKYVECLLCVSKKLDREGVVTGVFCFLQLASHELQQALHVQRLAERTAVKRLKALAYIKRQIRNPLSGIMFTRKMIEGTELGPEQRRILQTSALCQKQLSKILDDSDLESIIEGCLDLEMKEFTLNEVLTASTSQVMMKSNGKSVRITNETGEEVMSDTLYGDSIRLQQVLADFMLMAVNFTPSGGQLTVSASLRKDQLGRSVHLANLEIRLTHTGAGIPEFLLNQMFGTEEDVSEEGLSLMVSRKLVKLMNGDVQYLRQAGKSSFIITAELAAANK

SEQ ID NO: 14106 - protein, 1660 aa, Arabidopsis thaliana
  misc_feature: Useful for making plants with altered low light response
  misc_feature: Useful for making plants with modulated biomass
  misc_feature: Useful for making plants with modulated flowering time
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQFICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYPLGVTPTDSQINDIVEWLVANHSDSTGLSTDSLGDAGYPRAAALGDAVCGMAVACITKRDFLFWFRSHTEKEIKWGGAKHHPEDKDDGQRMNPRSSFQTFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAMGKSLVRELIYKEYKETVDRLLSCALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSIDGKIIGAFCFLQIPSPELQQALEVQRRQESEYFSRRKELAYIFQVIKNPLSGLRFTNSLLEDMDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSSMVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAIPSPELQQALEVQRRQESEYFSRRKELAYIFQVIKNPLSGLRFTNSLLEDMDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 14107 - protein, 111 aa, Arabidopsis thaliana
  misc_feature: Useful for biocontainment applications
  misc_feature: Useful for making plants with modulated biomass
MDPRMWHKVAAISGMAALGLGTYGAHVFKPENPSYKQVWQTASLYHLVHTAALVSAPSTKYPNIFGGLLTAGIVAFSGTCYMVALREDRKFSTLAPFGGFAFIAAWATLLF

SEQ ID NO: 14108 - protein, 277 aa, Arabidopsis thaliana
  misc_feature: Useful for making plants with altered cell wall content and/or composition
MVVVTHISTSFHQISPSFFHLRLRNPSTTSSSRPKLDGGFALSIRAYIEKPNSFSTFANKVIGSLPVIGLLARIISDEGGVGRDLVDFAEFRKRVGNKCTPDDSRAFYEFQQRRGKAGEPLYVLLCCWVAAVGAGLLKSEEILEGVTRVSISNDLEFEEQNFIALMTEARQRRAKLNIDAPTIPMELRVEKALEGIYACCFRRGLIEEEDEKLLKVMLIAVFPSVEKSEIERIIKEKATRVEEGGEEENVMAKRLPKEAIQMQMKDLEFLQQQNIES

SEQ ID NO: 14109 - protein, 379 aa, Arabidopsis thaliana
  misc_feature: Useful for making plants with modulated heat sensitivity
MATQGQVITCKAAVAYEPNKPLVIEDVQVAPPQAGEVRIKILYTALCHTDAYTWSGKDPEGLFPCILGHEAAGIVESVGEGVTEVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 14110 - protein, 466 aa, Arabidopsis thaliana
  misc_feature: Useful for making plants with modulated nitrogen use efficiency
MAVALQFSRLCVRPDTFVRENHLSGSGSLRRRKALSVRCSSGDENAPSPSVVMDSDFDAKVFRKNLTRSDNYNRKGFGHKEETLKLMNREYTSDILETLKTNGYTYSWGDVTVKLAKAYGFCWGVERAVQIAYEARKQFPEERLWITNEIIHNPTVNKRLEDMDVKIIPVEDSKKQFDVVEKDDVVILPAFGAGVDEMYVLNDKKVQIVDTTCPWVTKVWNTVEKHKKGEYTSVIHGKYNHEETIATASFAGKYIIVKNMKEANYVCDYILGGQYDGSSSTKEEFMEKFKYAISKGFDPDNDLVKVGIANQTTMLKGETEEIGRLLETTMMRKYGVENVSGHFISFNTICDATQERQDAIYELVEEKIDLMLVVGGWNSSNTSHLQEISEARGIPSYWIDSEKRIGPGNKIAYKLHYGELVEKENFLPKGPITIGVTSGASTPDKVVEDALVKVFDIKREELLQLA

SEQ ID NO: 14111 - protein, 428 aa, Arabidopsis thaliana
  misc_feature: Useful for biocontainment applications
MADSFELIVTRKEPVLVSPASETPKGLHYLSNLDQNIAIIVKTFYYFKSNSRSNEESYEVIKKSLSEVLVHYYPAAGRLTISPEGKIAVDCTGEGVVVVEAEANCGIEKIKKAISEIDQPETLEKLVYDVPGARNILEIPPVVVQVTNFKCGGFVLGLGMNHNMFDGIAAMEFLNSWAETARGLPLSVPPFLDRTLLRPRTPPKIEFPHNEFEDLEDISGTGKLYSDEKLVYKSFLFGPEKLERLKIMAETRSTTFQTLTGFLWRARCQALGLKPDQRIKLLFAADGRSRFVPELPKGYSGNGIVFTYCVTTAGEVTLNPLSHSVCLVKRAVEMVNDGFMRSAIDYFEVTRARPSLTATLLITSWAKLSFHTKDFGWGEPVVSGPVGLPEKEVILFLPCGSDTNYQCAAWTSWLGYESVPRDYGYMNH

SEQ ID NO: 14112 - protein, 457 aa, Panicum virgatum
  misc_feature: Useful for making plants with altered carbohydrate content
MGAAARTVSSLLPIWLLSLVCASSAQPYIGVNYGEVADNLPPPEETARLLKSTAISKVRLYGVDAGLIRALAGSNISVVVGVANGDIPSLAADPAAASRWLAANVLPFVPATAISAVAVGNEVLESGDASLAAALLPAMQNLRAAAAGGAAAGVRFSTVNTMGVMAQSDPPSTGAFHPDITPQLQGILSFLSKTGAPFMINPYPWFAYQSDPRPDTLAFCLFQPNAGRVDAGSKIKYTNMFDAQLDAVKSAMVHAGYGNVDIVVAETGWPTRGDAGEPGASVENARAYVSNLVAHLRSGAGTPLMPGRPVETYLFALYDEDLKPGPASERSFGLYHTDLSMAYDAGLAGAGAAAPAAGQPRGGGGGGWCVARDGASDAELQANLDYACAQVGVDCGAIQPGGACFEPNTVRAHAAYAINQLYQAAGRHPWNCDFRASATLTSDNPSYGACVYTGGGQ

SEQ ID NO: 14113 - protein, 438 aa, Arabidopsis thaliana
  misc_feature: Useful for making plants with altered cell wall content and/or composition
MRASVYSLILLFFSCLLHLSKSQPFLGVNYGLTADNLPPPSASAKLLQSTTFQKVRLYGSDPAVIKALANTGIEIVIGASNGDVPGLASDPSFARSWVETNVVPYYPASKIVLIAVGNEITSFGDNSLMSQLLPAMKNVQTALEAASLGGGKIKVSTVHIMSVLAGSDPPSTAVFKPEHADILKGLLEFNSETGSPFAVNPYPFFAYQDDRRPETLAYCLFQANPGRVDPNSNLKYMNMFDAQVDAVYSALNSMGFKDVEIMVAETGWPYKGDPEEAGATVENARAYNKNLIAHLKSGSGTPLMPGRVIDTYLFALYDENLKPGKGSERAFGLFRPDLTMTYDIGLTKTTNYNQTSMAPLSPTRPRLPPAAAPTRQTLPSPPQMILPSPVTPSDKNSGQTDVHNSTPRSASLAHICRSLSISASMFFVSVLYALIILL

SEQ ID NO: 14114 - protein, 542 aa, Arabidopsis thaliana
  misc_feature: Useful for biocontainment applications
MAYMCTDSGNLMAIAQQLIKQKQQQQSQHQQQEEQEQEPNPWPNPSFGFTLPGSGFSDPFQVTNDPGFHFPHLEHHQNAAVASEEFDSDEWMESLINGGDASQTNPDFPIYGHDPFVSFPSRLSAPSYLNRVNKDDSASQQLPPPPASTAIWSPSPPSPQHPPPPPPQPDFDLNQPIFKAIHDYARKPETKPDTLIRIKESVSESGDPIQRVGYYFAEALSHKETESPSSSSSSSLEDFILSYKTLNDACPYSKFAHLTANQAILEATNQSNNIHIVDFGIFQGIQWSALLQALATRSSGKPTRIRISGIPAPSLGDSPGPSLIATGNRLRDFAAILDLNFEFYPVLTPIQLLNGSSFRVDPDEVLVVNFMLELYKLLDETATTVGTALRLARSLNPRIVTLGEYEVSLNRVEFANRVKNSLRFYSAVFESLEPNLDRDSKERLRVERVLFGRRIMDLVRSDDDNNKPGTRFGLMEEKEQWRVLMEKAGFEPVKPSNYAVSQAKLLLWNYNYSTLYSLVESEPGFISLAWNNVPLLTVSSWR

SEQ ID NO: 14115 - protein, 494 aa, Arabidopsis thaliana
  misc_feature: Useful for making plants with modulated nitrogen use efficiency
MVLATNSDSDEHLHSTFASRYVRAVVPRFKMPDHCMPKDAAYQVINDELMLDGNPRLNLASFVTTWMEPECDKLIMDSVNKNYVDMDEYPVTTELQNRCVNMIANFFHAPVGEDEAAIGCGTVGSSEAIMLAGLAFKRKWQHRRKAQGLPIDKPNIVTGANVQVCWEKFARYFEVELKEVKLSEDYYVMDPAKAVEMVDENTICVAAILGSTLTGEFEDVKQLNDLLAEKNAETGWETPIHVDAASGGFIAPFLYPDLEWDFRLPWVKSINVSGHKYGLVYAGVGWVVWRTKDDLPEELVFHINYLGADQPTFTLNFSKGSSQIIAQYYQFIRLGFEGYKNIMENCMDNARRLREGIEMTGKFNIVSKDIGVPLVAFSLKDSSKHTVFEIAESLRKFGWIIPAYTMPADAQHIAVLRVVIREDFSRGLADRLITHIIQVLKEIEGLPSRIAHLAAAAAVSGDDEEVKVKTAKMSLEDITKYWKRLVEHKRNIVC

SEQ ID NO: 14116 - protein, 1112 aa, Arabidopsis thaliana
  misc_feature: Useful for making plants with altered low light response
  misc_feature: Useful for making plants with modulated biomass
  misc_feature: Useful for making plants with modulated flowering time
  misc_feature: Useful for making plants with modulated nitrogen use efficiency
MGFESSSSAASNMKPQPQKSNTAQYSVDAALFADFAQSIYTGKSFNYSKSVISPPNHVPDEHITAYLSNIQRGGLVQPFGCLIAVEEPSFRILGLSDNSSDFLGLLSLPSTSHSGEFDKVKGLIGIDARTLFTPSSGASLSKAASFTEISLLNPVLVHSRTTQKPFYAILHRIDAGIVMDLEPAKSGDPALTLAGAVQSQKLAVRAISRLQSLPGGDIGALCDTVVEDVQRLTGYDRVMVYQFHEDDHGEVVSEIRRSDLEPYLGLHYPATDIPQAARFLFKQNRVRMICDCNATPVKVVQSEELKRPLCLVNSTLRAPHGCHTQYMANMGSVASLALAIVVKGKDSSKLWGLVVGHHCSPRYVPFPLRYACEFLMQAFGLQLQMELQLASQLAEKKAMRTQTLLCDMLLRDTVSAIVTQSPGIMDLVKCDGAALYYKGKCWLVGVTPNESQVKDLVNWLVENHGDDSTGLTTDSLVDAGYPGAISLGDAVCGVAAAEFSSKDYLLWFRSNTASAIKWGGAKHHPKDKDDAGRMHPRSSFTAFLEVAKSRSLPWEISEIDAIHSLRLIMRESFTSSRPVLSGNGVARDANELTSFVCEMVRVIETATAPIFGVDSSGCINGWNKKTAEMTGLLASEAMGKSLADEIVQEESRAALESLLCKALQGEEEKSVMLKLRKFGQNNHPDYSSDVCVLVNSCTSRDYTENIIGVCFVGQDITSEKAITDRFIRLQGDYKTIVQSLNPLIPPIFASDENACCSEWNAAMEKLTGWSKHEVIGKMLPGEVFGVFCKVKCQDSLTKFLISLYQGIAGDNVPESSLVEFFNKEGKYIEASLTANKSTNIEGKVIRCFFFLQIINKESGLSCPELKESAQSLNELTYVRQEIKNPLNGIRFAHKLLESSEISASQRQFLETSDACEKQITTIIESTDLKSIEEGKLQLETEEFRLENILDTIISQVMIILRERNSQLRVEVAEEIKTLPLNGDRVKLQLILADLLRNIVNHAPFPNSWVGISISPGQELSRDNGRYIHLQFRMIHPGKGLPSEMLSDMFETRDGWVTPDGLGLKLSRKLLEQMNGRVSYVREDERCFFQVDLQVKTMLGVESRGTEGSSSIK

SEQ ID NO: 14117 - protein, 587 aa, Arabidopsis thaliana
  misc_feature: Useful for making plants with altered carbon content
  misc_feature: Useful for making plants with altered nitrogen content
MEEKDVYTQDGTVDIHNNPANKEKTGNWKACRFILGNECCERLAYYGMGTNLVNYLESRLNQGNATAANNVTNWSGTCYITPLIGAFIADAYLGRYWTIATFVFIYVSGMTLLTLSASVPGLKPGNCNADTCHPNSSQTAVFFVALYMIALGTGGIKPCVSSFGADQFDENDENEKIKKSSFFNWFYFSINVGALIAATVLVWIQMNVGWGWGFGVPTVAMVIAVCFFFFGSRFYRLQRPGGSPLTRIFQVIVAAFRKISVKVPEDKSLLFETADDESNIKGSRKLVHTDNLKFFDKAAVKSQSDSIKDGEVNPWRLCSVTQVEELKSIITLLPVWATGIVFATVYSQMSTMFVLQGNTMDQHMGKNFEIPSASLSLFDTVSVLFWTPVYDQFIIPLARKFTRNERGFTQLQRMGIGLVVSIFAMITAGVLEVVRLDYVKTHNAYDQKQIHMSIFWQIPQYLLIGCAEVFTFIGQLEFFYDQAPDAMRSLCSALSLTTVALGNYLSTVLVTVVMKITKKNGKPGWIPDNLNRGHLDYFFYLLATLSFLNFLVYLWISKRYKYKKAVGRAHKCCSLEPIVQTFGNKVS

SEQ ID NO: 14118 - protein, 343 aa, Panicum virgatum
  misc_feature: Useful for making plants with altered carbohydrate content
MTVVDGGGAAAPGRGQTVCVTGAGGYIGSWIVKLLLERGYAVRGTVRNPDDAKNAHLRTLPGAAERLALCRADLLDYDAMRAAVAGCHGVFHTASPVTDDPEQMVEPAVRGTRHVIEAAAAEAGTVRRVVLTSSVGAVAMDPGRAPDAVVDESCWSDLDFCRRTRNWYCYGKAAAERAAWEAAAARGVDLVVVVPVLVQGPALQPAVNASLAHVLKYLDGSVATFANAVQAYVHVRDVADAHVRVFETPGAAGRYLCADAVLHREDVVRTLRKFFPEYPVPERCSDEVNPRKQPYKISNQRLRDLGMEFTPAAQALYETVICFQEKGILPVPATATPSPSSLP

SEQ ID NO: 14119 - protein, 332 aa, Arabidopsis thaliana
  misc_feature: Useful for making plants with altered lignin content
MPVDGKLVCVTGAGGYIASWIVKLLLERGYTVRGTVRNPTDPKNNHLRELQGAKERLTLHSADLLDYEALCAAIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYEYVKSLQEKGHLPLPQDSNQNEVIIEP

SEQ ID NO: 14120 - protein, 332 aa, Arabidopsis thaliana
  misc_feature: Useful for making plants with altered cell wall content and/or composition
MLVDGKLVCVTGAGGYIASWIVKLLLERGYTVRGTVRNPTDPKNNHLRELQGAKERLTLHSADLLDYEALCATIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYESVKSLQEKGHLPLPQDSNQNEVIIES

SEQ ID NO: 14121 - protein, 533 aa, Arabidopsis thaliana
  misc_feature: Useful for making plants with modulated biomass
MKRDHHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRKVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 14122 - protein, 382 aa, Zea mays subsp. mays
  misc_feature: Useful for making plants with modulated biomass
LGVPSVKHMFPFCDSSSPMDLPLYQQLQLSPSSPKTDQSSSFYCYPCSPPFAAADASFPLSYQIGSAAAADATPPQAVINSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKGNCRGEGKKPAKASKAAATPKPPRKSANNAHQVPDKETRAKARERARERTKEKHRMRWVKLASAIDVEAAAASVPSDRPSSNNLSHHSSLSMNMPCAAAELEERERCSSALSNRSAGRMQEITGASDVVLGFGNGGYGDGGGNYYCQEQWELGGVVFQQNSRFY

SEQ ID NO: 14123 - protein, 501 aa, Arabidopsis thaliana
  misc_feature: Useful for making plants with altered cell wall content and/or composition
MFLFLLLLSASRSGEESPSGDAVPLATGGLNRKSFPEGFLFGTATSAYQVEGETHQDGRGPSIWDAFVKIPGKIANNATAEITVDQYHRYKEDVDLMQNLNIDAYRFSISWSRIFPEGSGKINSNGVAYYNRLIDYLIEKGITPYANLYHYDLPLALEQKYQGLLSKQGRFCGLRRVLFQTFGDRVKNWMTFNEPRVVAALGYDNGIFAPGRCSEAFGNCTDGNSATEPYIVAHHLILAHAAAVQRYRQNYQEKQKGRVGILLDFVWFEPLTSSQADNDAAQRARDFHVGWFIHPIVYGEYPNTLQNIVKERLPKFTEEEVKMVKGSIDFVGINQYTTYFMSDPKISTTPKDLGYQQDWNVTFNFAKNGTPIGPRAHSEWLYNVPWGMYKALMYIEERYGNPTMILSENGMDDPGNITLTQGLNDTTRVKYYRDYLVQLKKAVDDGANLTGYFAWSLLDNFEWLSGYTSRFGIVYVDYKDLKRYPKMSALWFKQLLKRDQK

SEQ ID NO: 14124 - protein, 519 aa, Panicum virgatum
  misc_feature: Useful for making plants with altered carbohydrate content
MGRIKSGRRTTAPPAPLLLLLLLVGASLPGRCIAQGGGAGLTRGSFPKGFVFGTAAAAYQYEGAVEVDGRGPTIWDTFAHTFGKISDFSNADVAVDQYHRFQDDVQLMADMGMDAYRFSIAWSRILPNGTGQVNQADIDHYNKVIDALVSKGIQPYVTLYHWDLPQALEDRYNGWLNRQIVDDFAAYAETCFKAFGDRVKHWITINEPHTVAVQGCDAGLHAPGRCSVLLHLYCKSGNSGTEPYIVAHNFILAHATVSDIYRRKYKATQNGQIGIAFDVIWYEPMTNSTIDIEATKRAQEFQLGWFADPFFFGDYPATMRTRVAERLPKFTADESALVKGALDFMGINHYTTFYARHNTTNIIGRLLNDTLADTGTVSLPFDKNGKPIGDRANSIWLYIVPSGMRKLMNYVKERYNSPPVYITENGMDDGNSPFTSINDALKDNKRIKYHNDYLTSLAASIKEDGCDVRGYFAWSLLDNWEWATGYTSRFGLYFVDYRDNLKRYPKNSVQWFKSLLSSS

SEQ ID NO: 14125 - protein, 75 aa, Glycine max
  misc_feature: Useful for making plants with altered oil content
MDSNGYLVVGVVAFALLCSFRVSLTDSVPLFSPVHDAASLTRNSFPAGFIFGAGSSAYQFEGAAKEGGRGPSIWY

SEQ ID NO: 14126 - protein, 480 aa, Panicum virgatum
  misc_feature: Useful for making plants with altered carbohydrate content
MAGADGAVVSSRQREMHVVIFPWLAFGHLLPGLELAQRLASRGHRVSLVSTPRNLARLPPVPPALAPRVDLVALPLPRLDGLPDGAESTNDLPSAAFELHRKAFDGLAAPFSAFLDAACAQGPGSRPDWVLLDNFHHWAAAAAVDRKVPCAMLLHLPATIFAALADAAQTRPELAGPGDGQQQHEATGDGQPAAEAPRFEAEQNRNLYSTEGASGISVGQRFFLTMRCCSFVGLRTCAELEPEALSRLPTLFGKPLVPFGLLPPSPDGARAAGKDAGDAIVPWLDAQPAEAVVYVALGSEVPLSIELVHELALGLELTGFPFLWALRKPAGAGDADILPPGFEERTRGRGFVAMGWVPQISILAHGAVGAFLTHCGWNSTIEGLLFGRPLIMLPIHGDQGSNARLMEERQIGVQVPRDEEDGSFDRHAVARAVRAVMSKDESRETFVANAKKLREIVADRTCQERCIDEFVERLRSSCIE

SEQ ID NO: 14127 - protein, 351 aa, Arabidopsis thaliana
  misc_feature: Useful for making plants with altered cell wall content and/or composition
MSQHLLLLILLSLLLLHKPISATTIIQKFKEAPQFYNSADCPLIDDSESDDDVVAKPIFCSRRAVHVAMTLDAAYIRGSVAAVLSVLQHSSCPENIVFHFVASASADASSLRATISSSFPYLDFTVYVFNVSSVSRLISSSIRSALDCPLNYARSYLADLLPPCVRRVVYLDSDLILVDDIAKLAATDLGRDSVLAAPEYCNANFTSYFTSTFWSNPTLSLTFADRKACYFNTGVMVIDLSRWREGAYTSRIEEWMAMQKRMRIYELGSLPPFLLVFAGLIKPVNHRWNQHGLGGDNFRGLCRDLHPGPVSLLHWSGKGKPWARLDAGRPCPLDALWAPYDLLQTPFALDS

SEQ ID NO: 14128 - protein, 461 aa, Panicum virgatum
  misc_feature: Useful for making plants with altered carbohydrate content
MGAAARKRKPASSLLPIWLLCLACAASAQPYIGVNYGEVADNLPPPEETARLLKSTAISKVRLYGVDAGLIRALAGSNISVVVGVANGDIPSLAADPAAASRWLAANVLPFVPATAISAVAVGNEVLESGDASLAAALLPAMQNLRAAAAAAGGAAAGVRFSTVNTMGVMAQSDPPSTGAFHPDIAPQLQGILGFLSKTGSPFMINPYPWFAYQSDPRPDTLAFCLFQPNAGRVDAGSKIKYTNMFDAQLDAVKSAMVRAGFGNVDIVVAETGWPTRGDAGEPGASVENARAYVSNLVAHLRSGAGTPLMPGKPVETYLFALYDEDLKPGPASERSFGLYHTDLSMAYDAGLAAGAAAGAPAAGQPRAGGGWCVARDGASDAELQADLDYTCAQVGVDCGAIQPGGACFEPNTVRAHAAYAMNQLYQAAGRHPWNCDFRASATLTSNNPSYGACVYTGGGQ

SEQ ID NO: 14129 - protein, 456 aa, Arabidopsis thaliana
  misc_feature: Useful for making plants with altered cell wall content and/or composition
MALSILFLLLFILFSISPSNAQSFIGVNYGLLSDNLPPPSQTAKLLQSTSIQKVRLYNADSSIITSLVGTGIGIVIGVANGDLPSIASDLNIASQWINSNVLPFYPASNIILINVGNEVLLSNDLNLVNQLLPAMQNVQKALEAVSLGGKIKVSTVHAMTVLGNSEPPSAGSFAPSYQAGLKGILQFLSDTGSPFAINPYPFFAYQSDPRPETLAFCLFQPNPGRVDSNTGIKYMNMFDAQVDAVHSALKSIGFEKVEVLVAETGWPSTGDSNEVGPSVENAKAYNGNLIAHLRSMVGTPLMPGKSIDTYIFALFDENLKPGPSFEQSFGLFKPDLSMAYDIGLTKTTSSQTSQSPQLGKVTSMGWCVPKEDATQEQLQDSLDWVCGQGIDCGPIMPGGVCFEPNNVASHTAYAMNLYFQKSPENPTDCDFSKTARITSENPSKLFSSSSFISYLL

SEQ ID NO: 14130 - protein, 599 aa, Arabidopsis thaliana
  misc_feature: Useful for making plants with modulated water use efficiency
MASFTATAAVSGRWLGGNHTQPPLSSSQSSDLSYCSSLPMASRVTRKLNVSSALHTPPALHFPKQSSNSPAIVVKPKAKESNTKQMNLFQRAAAAALDAAEGFLVSHEKLHPLPKTADPSVQIAGNFAPVNEQPVRRNLPVVGKLPDSIKGVYVRNGANPLHEPVTGHHFFDGDGMVHAVKFEHGSASYACRFTQTNRFVQERQLGRPVFPKAIGELHGHTGIARLMLFYARAAAGIVDPAHGTGVANAGLVYFNGRLLAMSEDDLPYQVQITPNGDLKTVGRFDFDGQLESTMIAHPKVDPESGELFALSYDVVSKPYLKYFRFSPDGTKSPDVEIQLDQPTMMHDFAITENFVVVPDQQVVFKLPEMIRGGSPVVYDKNKVARFGILDKYAEDSSNIKWIDAPDCFCFHLWNAWEEPETDEVVVIGSCMTPPDSIFNESDENLKSVLSEIRLNLKTGESTRRPIISNEDQQVNLEAGMVNRNMLGRKTKFAYLALAEPWPKVSGFAKVDLTTGEVKKHLYGDNRYGGEPLFLPGEGGEEDEGYILCFVHDEKTWKSELQIVNAVSLEVEATVKLPSRVPYGFHGTFIGADDLAKQVV

SEQ ID NO: 14131 - protein, 725 aa, Arabidopsis thaliana
  misc_feature: Useful for making plants with altered cell wall content and/or composition
  misc_feature: Useful for making plants with altered lignin content
MEINGAHKSNGGGVDAMLCGGDIKTKNMVINAEDPLNWGAAAEQMKGSHLDEVKRMVAEFRKPVVNLGGETLTIGQVAAISTIGNSVKVELSETARAGVNASSDWVMESMNKGTDSYGVTTGFGATSHRRTKNGVALQKELIRFLNAGIFGSTKETSHTLPHSATRAAMLVRINTLLQGFSGIRFEILEAITSFLNNNITPSLPLRGTITASGDLVPLSYIAGLLTGRPNSKATGPNGEALTAEEAFKLAGISSGFFDLQPKEGLALVNGTAVGSGMASMVLFETNVLSVLAEILSAVFAEVMSGKPEFTDHLTHRLKHHPGQIEAAAIMEHILDGSSYMKLAQKLHEMDPLQKPKQDRYALRTSPQWLGPQIEVIRYATKSIEREINSVNDNPLIDVSRNKAIHGGNFQGTPIGVSMDNTRLAIAAIGKLMFAQFSELVNDFYNNGLPSNLTASRNPSLDYGFKGAEIAMASYCSELQYLANPVTSHVQSAEQHNQDVNSLGLISSRKTSEAVDILKLMSTTFLVAICQAVDLRHLEENLRQTVKNTVSQVAKKVLTTGVNGELHPSRFCEKDLLKVVDREQVYTYADDPCSATYPLIQKLRQVIVDHALINGESEKNAVTSIFHKIGAFEEELKAVLPKEVEAARAAYDNGTSAIPNRIKECRSYPLYRFVREELGTELLTGEKVTSPGEEFDKVFTAICEGKIIDPMMECLNEWNGAPIPIC

SEQ ID NO: 14132 - protein, 341 aa, Arabidopsis thaliana
  misc_feature: Useful for making plants with altered cell wall content and/or composition
MGSSSNGGVPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRLEDADDPQANPSEDGWVVCRVFMKKNLFKVVNEGSSSINSLDQHNHDASNNNHALQARSFMHRDSPYQLVRNHGAMTFELNKPDLALHQYPPIFHKPPSLGFDYSSGLARDSESAASEGLQYQQACEPGLDVGTCETVASHNHQQGLGEWAMMDRLVTCHMGNEDSSRGITYEDGNNNSSSVVQPVPATNQLTLRSEMDFWGYSK

SEQ ID NO: 14133 - protein, 177 aa, Arabidopsis thaliana
  misc_feature: Useful for making plants with altered lignin content
  misc_feature: Useful for making plants with altered terpenoid content
MAAVQQQQAMQKNTLYVGGLADEVNESILHAAFIPFGDIKDVKTPLDQANQKHRSFGFVTFLEREDASAAMDNMDGAELYGRVLTVNYALPEKIKGGEQGWAAHPLWADADTWFERQQQEKEILKMQAENKAAMETAEELHRKKLAEDRQGEMEEDTDTKDDPMARAEADALSHGDA

SEQ ID NO: 14134 - protein, 164 aa, Arabidopsis thaliana
  misc_feature: Useful for making plants with modulated nitrogen use efficiency
MVLKTELCRFSGQKIYPGRGIRFIRSDSQVFLFLNSKCKRYFHNKLKPSKLCWTAMYRKQHKKDAAQEAVKRRRRATKKPYSRSIVGATLEVIQKKRAEKPEVRDAAREAALREIKERIKKTKDEKKAKKVEYASKQQKSQVKGNIPKSAAPKAAKMGGGGGRR

SEQ ID NO: 14135 - protein, 140 aa, Panicum virgatum
  misc_feature: Useful for making plants with altered carbohydrate content
MGSTAADVAAAAAADEEACMYALQLASSSILPMTLKNAIELGLLEVLQKDPAAALAPEEVVARLPVAPANPDAAAMVDRMLRLLASYDVVRCRMEEGKDGRYSRRYAAAPVCKWLTPNEDGVSMAALALMNQDKVLMESW

SEQ ID NO: 14136 - protein, 84 aa, Zea mays
  misc_feature: Useful for making plants with modulated biomass
MGSKPGEAPTWADQWASGEGDGSIANGKAAGKRTVAGNVKAAASEGLVKAKAAALVGAHKLKTGTSSGIKWVREQYQKKRTSSK

SEQ ID NO: 14137 - protein, 329 aa, Arabidopsis thaliana
  misc_feature: Useful for making plants with altered cell wall content and/or composition
MAALKMTISCFLFLQVIYCLLSSFAPTNVQGLKVGFYDKACPKAELIVKKSVFEAVKNDRTIAAPLLRMFFHDCFVRGCEGSVLLELKNKKDEKNSIPNLTLRGFEIIDNVKAALEKECPGIVSCSDVLALVARDAMVALNGPSWEVETGRRDGLVTNITEALLNLPSPFNNISSLITQFQSKGLDKKDLVVLSGGHTIGNGHCPQITNRLYNFTGKGDSDPNLDTEYAVKLRGKCKPTDTTTALEMDPGSFKTFDESYFKLVSQRRGLFQSDAALLDNQETKSYVLKSLNSDGSTFFKDFGVSMVKMGRIGVLTGQVGEVRKKCRMVN

SEQ ID NO: 14138 - protein, 543 aa, Lolium perenne
  misc_feature: Useful for making plants with altered lignin content
MVGFAKIAMEWIQDPLSWLFIASVVFVVLQRRRRGNVAPFPPGPKPLPIVGNMSMMDQLTHRGLAALAKEYGGLLHIRLGKLHTFAVSTPEYAREVLQVQDGAFSNRPATIAIAYLTYDRADMAFAHYGPFWRQMRKLCVMKLFSRRRPETWLAVRDESAALVRAVARRTGESVDLGELIFKLTKNVIFRAAFGAGAVAADAEEGDGAGKQDEFIAILQEFSKLFGAFNIGDFIPWLSWADPQGINVRLRAARNALDEFIDKIIDEHMERGKNPDDADADMVDDMLAFLPEAKPKKGAAGDGVDDLQNTLRLTRDNIKAIIMDVMFGGTETVASAIEWAMAEMMHSPDDLRRLQQELVDVVGLDRNVDESDLDKLPFLKCVIKETLRLHPPIPLLLHETAEDCVVGGYSVPRGSRVMINVYAIGRDRRAWKDADVFRPSRFVQGEGEAAGLDFKGGCFEFLPFGSGRRSCPGMALGLYALELAVAQLAHGFSWELPDGMKPSELDMSDVFGLTAPRATRLFAVPTPRLACTQLLGADDAGRQA

SEQ ID NO: 14139 - protein, 520 aa, Arabidopsis thaliana
  misc_feature: Useful for making plants with altered cell wall content and/or composition
  misc_feature: Useful for making plants with altered lignin content
MESSISQTLSKLSDPTTSLVIVVSLFIFISFITRRRRPPYPPGPRGWPIIGNMLMMDQLTHRGLANLAKKYGGLCHLRMGFLHMYAVSSPEVARQVLQVQDSVFSNRPATIAISYLTYDRADMAFAHYGPFWRQMRKVCVMKVFSRKRAESWASVRDEVDKMVRSVSCNVGKPINVGEQIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSETADLQNSIKLTRDNIKAIIMDVMFGGTETVASAIEWALTELLRSPEDLKRVQQELAEVVGLDRRVEESDIEKLTYLKCTLKETLRMHPPIPLLLHETAEDTSIDGFFIPKKSRVMINAFAIGRDPTSWTDPDTFRPSRFLEPGVPDFKGSNFEFIPFGSGRRSCPGMQLGLYALDLAVAHILHCFTWKLPDGMKPSELDMNDVFGLTAPKATRLFAVPTTRLICAL

SEQ ID NO: 14140 - protein, 656 aa, Arabidopsis thaliana
  misc_feature: Useful for making plants with altered cell wall content and/or composition
MSSLICFIFLFLFSFITSFTASAQNPFYLYHNCSITTTYSSNSTYSTNLKTLLSSLSSRNASYSTGFQNATAGQAPDMVTGLFLCRGNVSPEVCRSCIALSVNESLSRCPNEREAVFYYEQCMLRYSNRNILSTLNTDGGVFMQNARNPISVKQDRFRDLVLNPMNLAAIEAARSIKRFAVTKFDLNALQSLYGMVQCTPDLTEQDCLDCLQQSINQVTYDKIGGRTFLPSCTSRYDNYEFYNEFNVGKGGNSSVIVIAVVVPITVLFLLFVAFFSVRRAKRKKTIGAIPLFKVKRKETEVTEPPAETTDGDDITTAGSLQFDFKAIVAATDIFLPINKLGQGGFGEVYKGTFPSGVQVAVKRLSKNSGQGEKEFENEVVVVAKLQHRNLVKLLGYCLEGEEKILVYEFVPNKSLDYFLFDPTMQGQLDWSRRYKIIGGIARGILYLHQDSRLTIIHRDLKAGNILLDADMNPKVADFGMARIFGMDQTEANTRRVVGTYGYMAPEYAMYGKFSMKSDVYSFGVLVLEIVSGMKNSSLDQMDGSISNLVTYTWRLWSNGSPSELVDPSFGDNYQTSEITRCIHIALLCVQEDANDRPTMSAIVQMLTTSSIALAVPRPPGFFLRSKQEQAERACPSMDTSDLFSIDEASITSVAPR

SEQ ID NO: 14141 - protein, 680 aa, Arabidopsis thaliana
  misc_feature: Useful for making plants with modulated biomass
MSSLISFNFLFLFSFLTSSFTASAQDPFYLNHYCPNTTTYSSNSTYSTNLRTLLSSLSSRNASYSTGFQNATAGKAPDRVTGLFLCRGDVSPEVCRNCVAFSVNQTLNLCPKVREAVFYYEQCILRYSHKNILSTAITNEGEFILSNTNTISPNQKQIDGFTSFVSSTMSEAAGKAANSSRKLYTVNTELTAYQNLYGLLQCTPDLTRADCLSCLQSSINGMALSRIGARLYWPSCTARYELYPFYNESAIETPPLPPPPPPPPPRESLVSTPPISSSSLPGKSGNSTVLVVAVVVLAVLLFIALVGYCFLAKKKKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQIQLDWMQRYNIIGGIARGILYLHQDSRLTIIHRDLKASNILLDADINPKIADFGMARIFGLDQTQDNTSRIVGTYFVVDSSGYMAPEYAMHGQFSMKSDVYSFGVLVLEIISGRKNSSFGESDGAQDLLTHAWRLWTNKKALDLVDPLIAENCQNSEVVRCIHIGLLCVQEDPAKRPAISTVFMMLTSNTVTLPVPRQPGFFIQCRAVKDPLDSDQSTTTKSFPASIDDESITDLYPR

SEQ ID NO: 14142 - protein, 100 aa, Arabidopsis thaliana
  misc_feature: Useful for making plants with modulated nitrogen use efficiency
MEFTAEQLSQYNGTDESKPIYVAIKGRVFDVTTGKSFYGSGGDYSMFAGKDASRALGKMSKNEEDVSPSLEGLTEKEINTLNDWETKFEAKYPVVGRVVS

SEQ ID NO: 14143 - protein, 195 aa, Arabidopsis thaliana
  misc_feature: Useful for making plants with modulated low light sensitivity
MDHIIGFMGTTNMSHNTNLMIAAAATTTTTSSSSSSSSGGSGTNQLSRYENQKRRDWNTFGQYLRNHRPPLSLSRCSGAHVLEFLRYLDQFGKTKVHTHLCPFFGHPNPPAPCACPLRQAWGSLDALIGRLRAAFEENGGSPETNPFGARAVRLYLREVRDSQAKARGISYEKKKRKRPPPPLPPAQPAISSSPN

SEQ ID NO: 14144 - protein, 77 aa, Arabidopsis thaliana
  misc_feature: Useful for making plants with modulated light quality response
MTTPGSSTKLNICVSESNQREDSLSRSHRRRPTTPEMDEFFSGAEEEQQKQFIEKYNFDPVNEQPLPGRFEWTKVDD

SEQ ID NO: 14145 - protein, 3137 aa, Arabidopsis thaliana
  misc_feature: Useful for making plants with altered cell wall content and/or composition
MYISWMQHRHSSFSAKICKVCGDEVKDDDNGQTFVACHVCVYPVCKPCYEYERSNGNKCCPQCNTLYKRHKGSPKIAGDEENNGPDDSDDELNIKYRQDGSSIHQNFAYGSENGDYNSKQQWRPNGRAFSSTGSVLGKDFEAERDGYTDAEWKERVDKWKARQEKRGLVTKGEQTNEDKEDDEEEYLDAEARQPLWRKVPISSSKISPYRIVIVLRLVILVFFFRFRILTPAKDAYPLWLISVICEIWFALSWILDQFPKWFPINRETYLDRLSMRFERDGEKNKLAPVDVFVSTVDPLKEPPIITANTILSILAVDYPVNKVSCYVSDDGASMLLFDTLSETSEFARRWVPFCKKYNVEPRAPEFYFSEKIDYLKDKVQTTFVKDRRAMKREYEEFKVRINALVAKAQKKPEEGWVMQDGTPWPGNNTRDHPGMIQVYLGKEGAFDIDGNELPRLVYVSREKRPGYAHHKKAGAMNAMVRVSAVLTNAPFMLNLDCDHYINNSKAIRESMCFLMDPQLGKKLCYVQFPQRFDGIDLNDRYANRNIVFFDINMRGLDGIQGPVYVGTGCVFNRPALYGYEPPVSEKRKKMTCDCWPSWICCCCGGGNRNHKSDSSKKKSGIKSLFSKLKKKTKKKSDDKTMSSYSRKRSSTEAIFDLEDIEEGLEGYDELEKSSLMSQKNFEKRFGMSPVFIASTLMENGGLPEATNTSSLIKEAIHVISCGYEEKTEWGKEIGWIYGSVTEDILTGFRMHCRGWKSVYCMPKRPAFKGSAPINLSDRLHQVLRWALGSVEIFFSRHCPLWYAWGGKLKILERLAYINTIVYPFTSIPLLAYCTIPAVCLLTGKFIIPTINNFASIWFLALFLSIIATAILELRWSGVSINDLWRNEQFWVIGGVSAHLFAVFQGLLKVLFGVDTNFTVTSKGASDEADEFGDLYLFKWTTLLIPPTTLIILNMVGVVAGVSDAINNGYGSWGPLFGKLFFAFWVIVHLYPFLKGLMGRQNRTPTIVVLWSILLASIFSLVWVRIDPFLPKQTGPLLKQCGVDCMASFDDEHRHSSFSAKICKVCGDEVKDDDNGQTFVACHVCVYPVCKPCYEYERSNGNKCCPQCNTLYKRHKGSPKIAGDEENNGPDDSDDELNIKYRQDGSSIHQNFAYGSENGDYNSKQQWRPNGRAFSSTGSVLGKDFEAERDGYTDAEWKERVDKWKARQEKRGLVTKGEQTNEDKEDDEEEYLDAEARQPLWRKVPISSSKISPYRIVIVLRLVILVFFFRFRILTPAKDAYPLWLISVICEIWFALSWILDQFPKWFPINRETYLDRLSMRFERDGEKNKLAPVDVFVSTVDPLKEPPIITANTILSILAVDYPVNKVSCYVSDDGASMLLFDTLSETSEFARRWVPFCKKYNVEPRAPEFYFSEKIDYLKDKVQTTFVKDRRAMKREYEEFKVRINALVAKAQKKPEEGWVMQDGTPWPGNNTRDHPGMIQVYLGKEGAFDIDGNELPRLVYVSREKRPGYAHHKKAGAMNAMVRVSAVLTNAPFMLNLDCDHYINNSKAIRESMCFLMDPQLGKKLCYVQFPQRFDGIDLNDRYANRNIVFFDINMRGLDGIQGPVYVGTGCVFNRPALYGYEPPVSEKRKKMTCDCWPSWICCCCGGGNRNHKSDSSKKKSGIKSLFSKLKKKTKKKSDDKTMSSYSRKRSSTEAIFDLEDIEEGLEGYDELEKSSLMSQKNFEKRFGMSPVFIASTLMENGGLPEATNTSSLIKEAIHVISCGYEEKTEWGKEIGWIYGSVTEDILTGFRMHCRGWKSVYCMPKRPAFKGSAPINLSDRLHQVLRWALGSVEIFFSRHCPLWYAWGGKLKILERLAYINTIVYPFTSIPLLAYCTIPAVCLLTGKFIIPTINNFASIWFLALFLSIIATAILELRWSGVSINDLWRNEQFWVIGGVSAHLFAVFQGLLKVLFGVDTNFTVTSKGASDEADEFGDLYLFKWTTLLIPPTTLIILNMVGVVAGVSDAINNGYGSWGPLFGKLFFAFWVIVHLYPFLKGLMGRQNRTPTIVVLWSILLASIFSLVWVRIDPFLPKQTGPLLKQCGVDCMEPNTMASFDDEHRHSSFSAKICKVCGDEVKDDDNGQTFVACHVCVYPVCKPCYEYERSNGNKCCPQCNTLYKRHKGSPKIAGDEENNGPDDSDDELNIKYRQDGSSIHQNFAYGSENGDYNSKQQWRPNGRAFSSTGSVLGKDFEAERDGYTDAEWKERVDKWKARQEKRGLVTKGEQTNEDKEDDEEEYLDAEARQPLWRKVPISSSKISPYRIVIVLRLVILVFFFRFRILTPAKDAYPLWLISVICEIWFALSWILDQFPKWFPINRETYLDRLSMRFERDGEKNKLAPVDVFVSTVDPLKEPPIITANTILSILAVDYPVNKVSCYVSDDGASMLLFDTLSETSEFARRWVPFCKKYNVEPRAPEFYFSEKIDYLKDKVQTTFVKDRRAMKREYEEFKVRINALVAKAQKKPEEGWVMQDGTPWPGNNTRDHPGMIQVYLGKEGAFDIDGNELPRLVYVSREKRPGYAHHKKAGAMNAMVRVSAVLTNAPFMLNLDCDHYINNSKAIRESMCFLMDPQLGKKLCYVQFPQRFDGIDLNDRYANRNIVFFDINMRGLDGIQGPVYVGTGCVFNRPALYGYEPPVSEKRKKMTCDCWPSWICCCCGGGNRNHKSDSSKKKSGIKSLFSKLKKKTKKKSDDKTMSSYSRKRSSTEAIFDLEDIEEGLEGYDELEKSSLMSQKNFEKRFGMSPVFIASTLMENGGLPEATNTSSLIKEAIHVISCGYEEKTEWGKEIGWIYGSVTEDILTGFRMHCRGWKSVYCMPKRPAFKGSAPINLSDRLHQVLRWALGSVEIFFSRHCPLWYAWGGKLKILERLAYINTIVYPFTSIPLLAYCTIPAVCLLTGKFIIPTINNFASIWFLALFLSIIATAILELRWSGVSINDLWRNEQFWVIGGVSAHLFAVFQGLLKVLFGVDTNFTVTSKGASDEADEFGDLYLFKWTTLLIPPTTLIILNMVGVVAGVSDAINNGYGSWGPLFGKLFFAFWVIVHLYPFLKGLMGRQNRTPTIVVLWSILLASIFSLVWVRIDPFLPKQTGPLLKQCGVDC

SEQ ID NO: 14146 - protein, 1049 aa, Arabidopsis thaliana
  misc_feature: Useful for making plants with altered cell wall content and/or composition
  misc_feature: Useful for making plants with modulated biomass
MEPNTMASFDDEHRHSSFSAKICKVCGDEVKDDDNGQTFVACHVCVYPVCKPCYEYERSNGNKCCPQCNTLYKRHKGSPKIAGDEENNGPDDSDDELNIKYRQDGSSIHQNFAYGSENGDYNSKQQWRPNGRAFSSTGSVLGKDFEAERDGYTDAEWKERVDKWKARQEKRGLVTKGEQTNEDKEDDEEEYLDAEARQPLWRKVPISSSKISPYRIVIVLRLVILVFFFRFRILTPAKDAYPLWLISVICEIWFALSWILDQFPKWFPINRETYLDRLSMRFERDGEKNKLAPVDVFVSTVDPLKEPPIITANTILSILAVDYPVNKVSCYVSDDGASMLLFDTLSETSEFARRWVPFCKKYNVEPRAPEFYFSEKIDYLKDKVQTTFVKDRRAMKREYEEFKVRINALVAKAQKKPEEGWVMQDGTPWPGNNTRDHPGMIQVYLGKEGAFDIDGNELPRLVYVSREKRPGYAHHKKAGAMNAMVRVSAVLTNAPFMLNLDCDHYINNSKAIRESMCFLMDPQLGKKLCYVQFPQRFDGIDLNDRYANRNIVFFDINMRGLDGIQGPVYVGTGCVFNRPALYGYEPPVSEKRKKMTCDCWPSWICCCCGGGNRNHKSDSSKKKSGIKSLFSKLKKKTKKKSDDKTMSSYSRKRSSTEAIFDLEDIEEGLEGYDELEKSSLMSQKNFEKRFGMSPVFIASTLMENGGLPEATNTSSLIKEAIHVISCGYEEKTEWGKEIGWIYGSVTEDILTGFRMHCRGWKSVYCMPKRPAFKGSAPINLSDRLHQVLRWALGSVEIFFSRHCPLWYAWGGKLKILERLAYINTIVYPFTSIPLLAYCTIPAVCLLTGKFIIPTINNFASIWFLALFLSIIATAILELRWSGVSINDLWRNEQFWVIGGVSAHLFAVFQGLLKVLFGVDTNFTVTSKGASDEADEFGDLYLFKWTTLLIPPTTLIILNMVGVVAGVSDAINNGYGSWGPLFGKLFFAFWVIVHLYPFLKGLMGRQNRTPTIVVLWSILLASIFSLVWVRIDPFLPKQTGPLLKQCGVDC

SEQ ID NO: 14147 - protein, 483 aa, Arabidopsis thaliana
  misc_feature: Useful for making plants with altered cell wall content and/or composition
MMLQRSCIVLFFSLFLLVPQMVFSMLNRTLLLIPHPDPELVAYQVQWKVNASITRRQALDTTDQAGSTPCITGNPIDDCWKCDPNWPNNRQGLADCGIGFGQYALGGKGGQFYFVTDSSDDDAVNPKPGTLRYGVIQEEPLWIVFPSNMMIKLKQELIFNSYKTLDGRGANVHIVGGGCITLQYVSNIIIHNIHIHHCYQSGNTNVRSSPTHYGFRTKSDGDGISIFGSKDIWIDHCSLSRCKDGLIDAVMGSTGITISNNFFSHHNEVMLLGHSDHYEPDSGMQVTIAFNHFGEKLIQRMPRCRRGYIHVVNNDFTQWEMYAIGGSGNPTINSQGNRYTAPTNPFAKEVTKRVETPDGDWKGWNWRSEGDILVNGAFFVASGEGAEMRYEKAYSVEPKSASFITQITFHSGVLGVGGRNNNLGMWTTTGSEGTSGLDSYNDYTDEMSGAGSTNRLSFSVLVFLLSSISYLVVFTSSTQMFML

SEQ ID NO: 14148 - protein, 552 aa, Arabidopsis thaliana
  misc_feature: Useful for making plants with modulated light quality sensitivity
MKESDLTTEPIAQNLIKLISNVCFSVFVFTVLIFTVIAVTYQPPDPWLESAPALTKLLTETENATFKIDGSILKTGEDLASSPSSSPPSNSTEQVTEATIEKSEAKIGNMTVKNSIDCDEDLKIVNCSDPRVLVAVERFNLKVFKSIVFLEYETPVNGSKLDECDVSWRFRNKKEKSWRRYRDFRRFRFGFGENCTYKVFHTSGWHSGVNARRPRISRPSSSRGARGGDSEINDTIPTLGSQTSFRRGKYLYYSRGGDYCKGMNQYMWSFLCGLGEAMYLNRTFVMDLSLCLSSSYSSKGKDEEGKDFRYYFDFEHLKETASIVEEGEFLRDWKKWNRLHKRKVPVRKVKTHRVSPLQLSKDKSTIIWRQFDTPEPENYWYRVCEGQASKYVERPWHALWKSKRLMNIVSEISGKMDWDFDAVHVVRGEKAKNKKLWPHLDADTWPDAILTKLKGLVQVWRNLYVATNEPFYNYFDKLRSQYKVHLLDDYSYLWGNKSEWYNETSLLNNGKPVEFDGYMRVAVDTEVFYRGKTRVETFYNLTTDCKDGINTC

SEQ ID NO: 14149 - protein, 328 aa, Arabidopsis thaliana
  misc_feature: Useful for making plants with altered cell wall content and/or composition
MKTQTKVMGGHVLLTVFTLCMLCSGVRAQLSPDIYAKSCPNLVQIVRKQVAIALKAEIRMAASLIRLHFHDCFVNGCDASLLLDGADSEKLAIPNINSARGFEVIDTIKAAVENACPGVVSCADILTLAARDSVVLSGGPGWRVALGRKDGLVANQNSANNLPSPFEPLDAIIAKFVAVNLNITDVVALSGAHTFGQAKCAVFSNRLFNFTGLGNPDATLETSLLSNLQTVCPLGGNSNITAPLDRSTTDTFDNNYFKNLLEGKGLLSSDQILFSSDLAVNTTKKLVEAYSRSQSLFFRDFTCAMIRMGNISNGASGEVRTNCRVINN

SEQ ID NO: 14150 - protein, 823 aa, Zea mays
  misc_feature: Useful for making plants with modulated biomass
  misc_feature: Useful for making plants with modulated flowering time
MPYPHPYPWQSSRRRRRRRGRDGAPRQPQARRVVERAAAGPGHATTTQQPDNVSSAKVFQTSRVETESKLRNGRKPQDLEDEHQAEEAELQPLIDQVRAMLRSMNDGDTSASAYDTAWVAMVPKVGGDGGAQPQFPATVRWIVDHQLPDGSWGDSALFSAYDRMINTLACVVALTKWSLEPARCEAGLSFLHENMWRLAEEEAESMPIGFEIAFPSLIQTARDLGVVDFPYGHPALQSIYANREVKLKRIPRDMMHRVPTSILHSLEGMPDLDWPRLLNLQSCDGSFLFSPSATAYALMQTGDKKCFEYIDRIVKKFNGGVPNVYPVDLFEHIWVVDRLERLGISRYFQREIEQCMDYVNRHWTEDGICWARKSNVKDVDDTAMAFRLLRLHGYNVSPSVFKNFEKDGEFFCFVGQSTQAVTGMYNLNRASQISFQGEDVLHRARVFSYEFLRQREEQGMIRDKWIVAKDLPGEVQYTLDFPWYASLPRVEARTYLDQYGGKDDVWIGKTLYRMPLVNNDTYLELAIRDFNHCQALHQLECNGLQTWYKDNCLDAFGVEPQDVLRSYFLAAACIFEPSRAAERLAWARTSMIANAISTHLRDISEDKKRLECFVHCLYEENDVSWLKRNPNDVILERALRRLINLLAQEALPIHEGQRFIHSLLSLAWTEWMLQKANKEENKYHKCSGIEPQYMVHDRQTYLLLVQVIEICAGRIGEAVSMINNKDNDWFIQLTCATCDSLNHRMLLSQDTMKNEARINWIEKEIELNMQELAQSLLLRCDEKTSNKKTKKTLWDVLRSLYYATHSPQHMIDRHVSRVIFEPV

SEQ ID NO: 14151 - protein, 317 aa, Arabidopsis thaliana
  misc_feature: Useful for making plants with altered cell wall content and/or composition
MATTRMVRVSQDGSGDYCSVQDAIDSVPLGNTCRTVIRLSPGIYRQPVYVPKRKNFITFAGISPEITVLTWNNTASKIEHHQASRVIGTGTFGCGSVIVEGEDFIAENITFENSAPEGSGQAVAIRVTADRCAFYNCRFLGWQDTLYLHHGKQYLKDCYIEGSVDFIFGNSTALLEHCHIHCKSQGFITAQSRKSSQESTGYVFLRCVITGNGQSGYMYLGRPWGPFGRVVLAYTYMDACIRNVGWHNWGNAENERSACFYEYRCFGPGSCSSERVPWSRELMDDEAGHFVHHSFVDPEQDRPWLCLRMGVKTPYSA

SEQ ID NO: 14152 - protein, 92 aa, Triticum aestivum
  misc_feature: Useful for making plants with modulated nitrogen use efficiency
  misc_feature: Useful for making plants with modulated seedling growth
MSSRRSRSRQSGSSRITDEQISDLVSKLQDLLPEARLRGNDRVPSSRVLQETCTYIRSLHREVDDLSERLSELLATSDMSSAQAAIIRSLLM

SEQ ID NO: 14153 - protein, 178 aa, Zea mays
  misc_feature: Useful for making plants with modulated nitrogen use efficiency
  misc_feature (115)..(115): Xaa is any aa, unknown, or other
MGQRRFEDERAALATVASLLLILTTAQAAAAAASGRHLSLPTQKAAAARMNDTSSSDMQVITPAPLAISTAARMGPDGCSGEDVAVYQSSANPLPSGIPAYTVRIINVCSGGCTXYDVHVSCGDFASTELVDPAKFQRVGFNDCVVKGGGALEPSETVSFQYSNSFSYHLSVASVACR

SEQ ID NO: 14154 - protein, 262 aa, Arabidopsis thaliana
  misc_feature: Useful for making plants with modulated biomass
MSGGGNTITAVGGGGGGCGGGGSSGGGGSSGGGGGGPCGACKFLRRKCVPGCIFAPYFDSEQGSAYFAAVHKVFGASNVSKLLLHIPVHRRSDAVVTICYEAQARIRDPIYGCVAHIFALQQQVVNLQAEVSYLQAHLASLELPQPQTRPQPMPQPQPLFFTPPPPLAITDLPASVSPLPSTYDLASIFDQTTSSSAWATQQRRFIDPRHQYGVSSSSSSVAVGLGGENSHDLQALAHELLHRQGSPPPAATDHSPSRTMSR

SEQ ID NO: 14155 - protein, 423 aa, Panicum virgatum
  misc_feature: Useful for making plants with altered carbohydrate content
MPSRAMAALIPLLPALLLLLPSTPEATSSALLGISYGRVGNNLPPATSVPRILASLGVGRVRLYDADPATIRAFANTGVELAVGVPDECLAAVSTPTGAASWVRSNIAPALPATKIAFLTVGNEVLTGANSSSLSRYLLPAMQCLHDALAQAGLDKKIAVTTAHNLGVLATSYPPSSAYFRKDLLPVLCPILDFHARAGSPFLVNAYPYFAYAEEPTGVELEYALLEPGHAGVADPGSGLHYTNMLAAQVDAVYHAIGAANSAAARAVEVRVSETGWPSAGDANETGATPQNAARYNGNVMRLVAQGKGTPLRPSMPLRVYMFALFNENMKPGPASERNYGLFKPDGTPAYELSYRLPQDNNTSSGSSSGIAGGGVYNGHGYGSENGGYYSISAAGKATMGWWTWAQAAAAACVVVLVMQLWL

SEQ ID NO: 14156 - protein, 425 aa, Arabidopsis thaliana
  misc_feature: Useful for making plants with altered cell wall content and/or composition
  misc_feature: Useful for making plants with altered lignin content
MASSSLQSLFSLFCLALFSLPLIVSSIGINYGQVANNLPPPKNVIPLLKSVGATKVKLYDADPQALRAFAGSGFELTVALGNEYLAQMSDPIKAQGWVKENVQAYLPNTKIVAIVVGNEVLTSNQSALTAALFPAMQSIHGALVDCGLNKQIFVTTAHSLAILDVSYPPSATSFRRDLLGSLTPILDFHVKTGSPILINAYPFFAYEENPKHVSLDFVLFQPNQGFTDPGSNFHYDNMLFAQVDAVYHALDAVGISYKKVPIVVSETGWPSNGDPQEVGATCDNARKYNGNLIKMMMSKKMRTPIRPECDLTIFVFALFNENMKPGPTSERNYGLFNPDGTPVYSLGIKTSSTHSSGSGSSNSTGGSSSGGGGNTGGSSSGGGIYQPVTGNPSPDYMSISSAGGKGRFVECVLFFFLLCIIKLRL

SEQ ID NO: 14157 - protein, 401 aa, Arabidopsis thaliana
  misc_feature: Useful for making plants with modulated low light sensitivity
  misc_feature: Useful for making plants with modulated nitrogen use efficiency
MDLSDIRNNNNDTAAVATGGGARQLVDASLSIVPRSTPPEDSTLATTSSTATATTTKRSTKDRHTKVDGRGRRIRMPALCAARVFQLTRELGHKSDGETIEWLLQQAEPAIVAATGTGTIPANFSTLSVSLRSSGSTLSAPPSKSVPLYGALGLTHHQYDEQGGGGVFAAHTSPLLGFHHQLQHHQNQNQNQDPVETIPEGENFSRKRYRSVDLSKENDDRKQNENKSLKESETSGPTAAPMWAVAPPSRSGAGNTFWMLPVPTTAGNQMESSSNNNTAAGHRAPPMWPFVNSAGGGAGGGGGAATHFMAGTGFSFPMDQYRGSPLQLGSFLAQPQPTQNLGLSMPDSNLGMLAALNSAYSRGGNANANAEQANNAVEHQEKQQQSDHDDDSREENSNSSE

SEQ ID NO: 14158 - protein, 335 aa, Arabidopsis thaliana
  misc_feature: Useful for making plants with altered cell wall content and/or composition
MAVTNLPTCDGLFIISLIVIVSSIFGTSSAQLNATFYSGTCPNASAIVRSTIQQALQSDTRIGASLIRLHFHDCFVNGCDASILLDDTGSIQSEKNAGPNVNSARGFNVVDNIKTALENACPGVVSCSDVLALASEASVSLAGGPSWTVLLGRRDSLTANLAGANSSIPSPIESLSNITFKFSAVGLNTNDLVALSGAHTFGRARCGVFNNRLFNFSGTGNPDPTLNSTLLSTLQQLCPQNGSASTITNLDLSTPDAFDNNYFANLQSNDGLLQSDQELFSTTGSSTIAIVTSFASNQTLFFQAFAQSMINMGNISPLTGSNGEIRLDCKKVNGS

SEQ ID NO: 14159 - protein, 320 aa, Panicum virgatum
  misc_feature: Useful for making plants with altered carbohydrate content
MASSSCFSPLVLLLAALCGLLMLASAHGYPPSAAGSALSSAFYDASCPGAHDVVRRVIQDARVSDPRIPASLIRLHFHDCFVNGCDGSLLLDDDLPTIRTEKAVPANDNSARGFPVVDDIKAALEHACPGVVSCADILALAAEISVELAGGPRWRVLLGRRDGTTTNIESAKNLPSPFDALDVLQEKFRNVNLDDTDLVALQGAHTFGKVQCQFTRENCTAGQPEGALENLDQVTPNLFDNKYYGNLLHGQAQLPSDQVMLSDPVAPTTTAPIVHRFASNQKDFFRNFAASMIKMGNISQLTGKDGEIRKNCRRVNSKGY

SEQ ID NO: 14160 - protein, 441 aa, Arabidopsis thaliana
  misc_feature: Useful for biocontainment applications
  misc_feature: Useful for making plants with modulated biomass
  misc_feature: Useful for making plants with modulated flowering time
MANKYVSSVLKSLLVLLHLVFLSKQHVDSASIVKSLPGFEGQLPFELETGYIGVGEEEEVQLFYYFIKSERNPKEDPLILWLTGGPGCSAISGLLFENGPLTMKLDVYNGTLPSLVSTTYSWTKTSSIIFLDQPVGTGFSYSRTQQFNKPSDSGEAKRIHEFLQKWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKGGGHTAESKPEEASIMFQRWINGQPL

SEQ ID NO: 14161 - protein, 566 aa, Arabidopsis thaliana
  misc_feature: Useful for making plants with altered cell wall content and/or composition
MAATHLHIPPNPKTQTSHQNPPFWFSSKTGIYTSKFPSLHLPVDPNLDAVSALFSHKHHGDTALIDSLTGFSISHTELQIMVQSMAAGIYHVLGVRQGDVVSLVLPNSVYFPMIFLSLISLGAIVTTMNPSSSLGEIKKQVSECSVGLAFTSTENVEKLSSLGVSVISVSESYDFDSIRIENPKFYSIMKESFGFVPKPLIKQDDVAAIMYSSGTTGASKGVLLTHRNLIASMELFVRFEASQYEYPGSSNVYLAALPLCHIYGLSLFVMGLLSLGSTIVVMKRFDASDVVNVIERFKITHFPVVPPMLMALTKKAKGVCGEVFKSLKQVSSGAAPLSRKFIEDFLQTLPHVDLIQGYGMTESTAVGTRGFNSEKLSRYSSVGLLAPNMQAKVVDWSSGSFLPPGNRGELWIQGPGVMKGYLNNPKATQMSIVEDSWLRTGDIAYFDEDGYLFIVDRIKEIIKYKGFQIAPADLEAVLVSHPLIIDAAVTAAPNEECGEIPVAFVVRRQETTLSEEDVISYVASQVAPYRKVRKVVMVNSIPKSPTGKILRKELKRILTNSVSSRL

SEQ ID NO: 14162 - protein, 1145 aa, Arabidopsis thaliana
  misc_feature: Useful for making plants with altered cell wall content and/or composition
MASNKHFDKSRSNLSNNSDIQEPGRPPAGHSVKFAQRTSSGRYINYSRDDLDSELGGQDFMSYTVHIPPTPDNQPMDPSISQKVEEQYVANSMFTGGFKSNTRAHLMHKVIETEPNHPQMAGSKGSSCAIPGCDAKVMSDERGQDLLPCECDFKICRDCFIDAVKTGGGICPGCKEPYKNTHLTDQVDENGQQRPMLPGGGGSKMERRLSMVKSTNKSALMRSQTGDFDHNRWLFETTGTYGYGNAFWTKDGDFGSGKDGDGDGDGMGMEAQDLMSRPWRPLTRKLKIPAGVISPYRLLIFIRIVVLALFLTWRVKHQNPDAVWLWGMSVVCELWFALSWLLDQLPKLCPINRATDLQVLKEKFETPTASNPTGKSDLPGFDVFVSTADPEKEPPLVTANTILSILAAEYPVEKLSCYVSDDGGALLTFEAMAEAASFANIWVPFCRKHAIEPRNPDSYFSLKRDPYKNKVKSDFVKDRRRVKREFDEFKVRVNSLPDSIRRRSDAYHAREEIKAMKMQRQNRDDEPMEPVKIPKATWMADGTHWPGTWLTSASDHAKGDHAGIIQVMLKPPSDEPLHGVSEGFLDLTDVDIRLPLLVYVSREKRPGYDHNKKAGAMNALVRASAIMSNGPFILNLDCDHYIYNSEALREGMCFMMDRGGDRLCYVQFPQRFEGIDPSDRYANHNTVFFDVNMRALDGLMGPVYVGTGCLFRRIALYGFNPPRSKDFSPSCWSCCFPRSKKKNIPEENRALRMSDYDDEEMNLSLVPKKFGNSTFLIDSIPVAEFQGRPLADHPAVKNGRPPGALTIPRELLDASTVAEAIAVISCWYEDKTEWGSRIGWIYGSVTEDVVTGYRMHNRGWKSVYCVTKRDAFRGTAPINLTDRLHQVLRWATGSVEIFFSRNNALLASSKMKILQRIAYLNVGIYPFTSIFLIVYCFLPALSLFSGQFIVQTLNVTFLVYLLIISITLCLLALLEIKWSGISLEEWWRNEQFWLIGGTSAHLAAVLQGLLKVVAGVEISFTLTSKSGGDDIDDEFADLYMVKWTSLMIPPITIIMVNLIAIAVGFSRTIYSVVPQWSKLIGGVFFSFWVLAHLYPFAKGLMGRRGRTPTIVYVWSGLVAITISLLWVAINPPAGNTEIGGNFSFP

SEQ ID NO: 14163 - protein, 435 aa, Arabidopsis thaliana
  misc_feature: Useful for making plants with altered cell wall content and/or composition
MASKSTVTTLTIFFFFFFFFIEPKVQSQQISAVDSECTNRWIHIRTLPSRFNLDLLSTCNRYPITDDLCPYLANHGLGPKTHTRTRSWYRTDPLLLELIFHRRILEYPCLTPDPNLASAIYLPYYAGIDSLRYLYGPDLNSSADHGSDLLEFLTRDQPEIWSRRSGHDHFLVMARPAWDFSQPLTVDPPIWGTSFLERREFFNLTALTLESRYWPWQEQAVPYPTSFHPHSLPFLESWIRRVRRSRRTSLMLFAGGGGTSSSPNIRRSIRLECTSINATQSDNKICDFVDCSNGICEHDPIRFMRPMLQSSFCLQPPGDTPTRKATFDGIIAGCIPVFFEDQTAKMQYKWHLPESEFAEFSVTIPKEDVVFRGVRIQDVLMSIPKEEVTRMRERVIEMMPRVMYRRHGASMGLMNKKDAVDIAIDGVLDRIISRV

SEQ ID NO: 14164 - protein, 539 aa, Arabidopsis thaliana
  misc_feature: Useful for making plants with altered cell wall content and/or composition
MESSLFSPSSSSYSSLFTAKPTRLLSPKPKFTFSIRSSIEKPKPKLETNSSKSQSWVSPDWLTTLTRTLSSGKNDESGIPIANAKLDDVADLLGGALFLPLYKWMNEYGPIYRLAAGPRNFVIVSDPAIAKHVLRNYPKYAKGLVAEVSEFLFGSGFAIAEGPLWTARRRAVVPSLHRRYLSVIVERVFCKCAERLVEKLQPYAEDGSAVNMEAKFSQMTLDVIGLSLFNYNFDSLTTDSPVIEAVYTALKEAELRSTDLLPYWKIDALCKIVPRQVKAEKAVTLIRETVEDLIAKCKEIVEREGERINDEEYVNDADPSILRFLLASREEVSSVQLRDDLLSMLVAGHETTGSVLTWTLYLLSKNSSALRKAQEEVDRVLEGRNPAFEDIKELKYITRCINESMRLYPHPPVLIRRAQVPDILPGNYKVNTGQDIMISVYNIHRSSEVWEKAEEFLPERFDIDGAIPNETNTDFKFIPFSGGPRKCVGDQFALMEAIVALAVFLQRLNVELVPDQTISMTTGATIHTTNGLYMKVSQR

SEQ ID NO: 14165 - protein, 293 aa, Arabidopsis thaliana
  misc_feature: Useful for making plants with altered cell wall content and/or composition
MALSLIFLALLVLCPSSGHSQRSPSPGYYPSSRVPTSPFDREFRTLWGSQHQRREQDVVTLWLDKSTGSGFKSLRPYRSGYFGASIKLQPGFTAGVDTSLYLSNNQEHPGDHDEVDIEFLGTTPGKPYSLQTNVFVRGSGDRNVIGREMKFTLWFDPTQDFHHYAILWNPNQIVFFVDDVPIRTYNRKNEAIFPTRPMWVYGSIWDASDWATENGRIKADYRYQPFVAKYKNFKLAGCTADSSSSCRPPSPAPMRNRGLSRQQMAALTWAQRNFLVYNYCHDPKRDHTQTPEC

SEQ ID NO: 14166 - protein, 365 aa, Arabidopsis thaliana
  misc_feature: Useful for biocontainment applications
MSSPATTITFFFFFTLSSFFYITSSLQNNNNNNNKHTATVNSLNIPSAAAEITLVNPKLPPRSLSLTSSKKFEGSSNLVHLRYHMGPVLSSSPINIYVIWYGQWSRPHKSLIRDFLNSISDAKAPSPSVSEWWRTASLYTDQTGSNVSRSVLIAGEYSDSKYSHGQHLTRLTIQEVIASAARSASFPVDHKNGMYLVLTSHDVTMQDFCRAVCGFHYFTFPSMVGYTMPYAWVGQSGKQCPEVCAYPFALPGYMGHGGPGELRPPNGETGVDGMVSVIGHELAEVVSNPLINAWYAGEDPTAPTEIGDLCEGLYGSGGGGGYIGQVMRDREGKTFNMNGKGGRKFLVQWIWNPNLKACSGPNSVD

SEQ ID NO: 14167 - protein, 271 aa, Panicum virgatum
  misc_feature: Useful for making plants with altered carbohydrate content
MAVPVHLAASSLVLLLLVLLLPPLLASACDRCVHRSRAAYYASSLTLAGGSCGYGAEAASMGAGFLAAAGPALYRAGVSCGACFQVRCKDRKLCAAAGARVVVTDRARTNRADLVLSGPAFAAMARPGMAARLAKLRTVDVEYKRVPCEYKHRNLSVRVEQKSRAPAELTIRFLYQGGQTDIVAVDVAQVGSSNWKFMARDYGPAWSTSQAPPGPLQLRVVVTGGYDGKWVWADREVLPRRWRAGEVYDTGVQIADIAQEGCYPCDTHEWE

SEQ ID NO: 14168 - protein, 217 aa, Arabidopsis thaliana
  misc_feature: Useful for making plants with altered cell wall content and/or composition
MATSFFAGHIAAAIPSIYKDGAGCGACFQVRCKNPKLCSTKGTIVMITDLNKSNQTDLVLSSRAFRAMAKPIVGADKDLLKQGIVDIEYQRVPCDYGNKNMNVRVEEASKKPNYLEIKLLYQGGQTEVVSIDIAQVGSSPNWGYMTRSHGAVWVTDKVPTGAIQFRFVVTGGYDGKMIWSQSVLPSNWEAGKIYDAGVQITDIAQEGCDPCDAHIWN

SEQ ID NO: 14169 - protein, 517 aa, Panicum virgatum
  misc_feature: Useful for making plants with altered carbohydrate content
MKGGGGKETVTATFLRSLLLLLLPLTALYFFYTLHLLLATASPAASNCPPDSSVSVSRASANLTAAAAAAAEEKRPGSAAAAPTPTTLQHVVFGIAASSRLWDKRKEYIKVWWRPRGAMRGYVWLDRAVRESNMSTARTGLPAIRISNDTSAFPYTHRRGHRSAIRISRIVSETFRLGLPGVRWFVMGDDDTIFFPDNLLTVLNKFDHSQPYYIGSLSESHLQNIYFSYGMAYGGGGFAISRPLAEALARMQDGCIRRYPALYGSDDRIQACLAELGVPLTKHPGFHQYDVYGDLLGLLAAHPVAPLVTLHHLDVVKPLFPDARSRPAAVRRLFDGPVKLDTAGLMQQSICYDDANRWTVSVAWGFVVLVARGVMSPREMKMPARTFLNWYPRADYTAYAFNTRPMARSPCQKPAVYYMSSARRAPDRDGGETTVTRYERWRHPNETRPACRWDIADPDAHLDNIVVFKRPDPGLWDRSPRRNCCRVVSSPKEGSGKKMTIDVGVCREGEFTQVAAV

SEQ ID NO: 14170 - protein, 262 aa, Arabidopsis thaliana
  misc_feature: Useful for making plants with altered cell wall content and/or composition
MGPISSSWSFNKFFSIVFVVFAISGEFVAGYYRPGPWRYAHATFYGDETGGETMGGACGYGNLFNSGYGLSTAALSTTLFNDGYGCGQCFQITCSKSPHCYSGKSTVVTATNLCPPNWYQDSNAGGWCNPPRTHFDMAKPAFMKLAYWRAGIIPVAYRRVPCQRSGGMRFQFQGNSYWLLIFVMNVGGAGDIKSMAVKGSRTNWISMSHNWGASYQAFSSLYGQSLSFRVTSYTTGETIYAWNVAPANWSGGKTYKSTANFR

SEQ ID NO: 14171 - protein, 359 aa, Arabidopsis thaliana
  misc_feature: Useful for making plants with altered alkaloid content
MISKDPRSSLPPGFRFHPTDEELILHYLRKKVSSSPVPLSIIADVDIYKSDPWDLPAKAPFGEKEWYFFSPRDRKYPNGARPNRAAASGYWKATGTDKLIAVPNGEGFHENIGIKKALVFYRGKPPKGVKTNWIMHEYRLADSLSPKRINSSRSGGSEVNNNFGDRNSKEYSMRLDDWVLCRIYKKSHASLSSPDVALVTSNQEHEENDNEPFVDRGTFLPNLQNDQPLKRQKSSCSFSNLLDATDLTFLANFLNETPENRSESDFSFMIGNFSNPDIYGNHYLDQKLPQLSSPTSETSGIGSKRERVDFAEETINASKKMMNTYSYNNSIDQMDHSMMQQPSFLNQELMMSSHLQYQG

SEQ ID NO: 14172 - protein, 483 aa, Panicum virgatum
  misc_feature: Useful for making plants with altered carbohydrate content
MENGNGGPSSCCNGNGSVAPPHVAMLVTPGMGHLIPLAELAKRLASRHGATATLLTFASTASATQRAFLASLPPAVSSRALPPVDLSDLPRGAAIETLMSEECARSVPALTGILRDLRRTTRLVAFVADLFGADSFDAARAAGVARRYIFFPTNLHVLTLLLHLPELDASVPGEFRDLAEPLRLPGCVPIPGPDVLMPLQDKSNPCYKWMVHHGAKYREADAILVNSFDAVEPGPAKILRQPAPGNPAVFPIGPLIQADRGGSDDGPCPCLEWLDRQPARSVIFVSFGSGGALPAEQMRELALGLELSGQRFLWVVRSPSDEGAVNDNYYDAESKKDPFAYLPEGFVERTRAVGLVVPSWAPQIKVLAHGATGGFLTHCGWNSVLESLVYGVPMVAWPLYAEQRQNAAMLSEGVGAAIRVPESKGREKIAAAVREVMQGEGRGAAVRAKVAELQKAAAEGLREGGAAAAALAEVVEKWTCGEN

SEQ ID NO: 14173 - protein, 480 aa, Glycine max
  misc_feature: Useful for making plants with altered lignin content
MEEEAPPVPPAPPIVAMLPSPGMGHLIPMIEFAKRAVRYHNLAVTFVIPTDGPPSKAQKAVFQALPDSISHTFLPPVNLSDFPPGTKIETLISHTVLLSLPSLRQAFHSLSSTYTLAAVVVDLFATDAFDVAAEFNASPYVFYPSTATVLSIALHLPTLDKQVQCEFRDLPEPVTIPGCIPLPVKDFLDPVLERTNEAYKWVLHHSKRYREAEGIIENSFAELEPGAWNELQREQPGRPPVYAVGPLVRMEPGPADSECLRWLDEQPRGSVLFVSFGSGGTLSSAQINELALGLENSQQRFLWVVKSPNDAIANATYFNAESHEDPLQFLPEGFVERTKGRGFLVKSWAPQPQVLAHQSTGGFLSHCGWNSILESVVNGVPLIAWPLFAEQRTNAFMLMHEVKVALRPKVAEDTGLVQSQEIASVVKCLMEGHEGKKLRYRIKDLKEAAAKALSPNGSSTDHISNLVLKWTNKTTISTSG

SEQ ID NO: 14174 - protein, 254 aa, Arabidopsis thaliana
  misc_feature: Useful for making plants with modulated nitrogen use efficiency
MIMASSAAASISMITLRNLSRNHQSHQSTFLGFSRSFHNQRISSNSPGLSTRARSTTSSTGGFFRTICSSSSNDYSRPTKIQELNVYEFNEGDRNSPAVLKLGKKPDQLCLGDLVPFTNKLYTGDLTKRIGITAGLCVLIQHVPEKKGDRFEASYSFYFGDYGHISVQGPYLTYEDTFLAITGGSGVFEGAYGQVKLRQLVYPTKLFYTFYLKGVAADLPVELTGKHVEPSKEVKPAAEAQATQPGATIANFTN

SEQ ID NO: 14175 - protein, 2004 aa, Arabidopsis thaliana
  misc_feature: Useful for making plants with modulated biomass
MEEKTHHHHHSTNKHIPSSKSRTPLLHKPYHHHVQTNPPPFLLHPSSHQNLNLVASNLPSSYYYYYYCYFYSQFHNSLPPPPPPHLLPLSPPLPPLLPLPPPHSMTRFHKSLPVSQVVERKQQHQQKKKIQVSNNKVSGSIAIEEAALVVAKRPDFGGQDGSVIYLLANHFLVKFDSSQRIYHYNVEISPQPSKEIARMIKQKLVETDRNSFSGVVPAFDGRQNIYSPVEFQGDRLEFFVNLPIPSCKAVMNYGDLREKQPQKKIEKLFRVNMKLVSKFDGKEQRKEGEDWAPLPPEYIHALDVILRENPMEKCTSIGRSFYSSSMGGSKEIGGGAVGLRGFFQSLRHTQQGLALNMDLSITAFHESIGVIAYLQKRLEFLTDLPRNKGRELSLEEKREVEKALKNIRVFVCHRETVQRYRVYGLTEEITENIWFPDREGKYLRLMSYFKDHYGYEIQFKNLPCLQISRARPCYLPMELCMICEGQKFLGKLSDDQAAKIMKMGCQKPNERKAIIDKVMTGSVGPSSGNQTREFNLEVSREMTLLKGRILQPPKLKLDRPRNLKESKVFKGTRIERWALMSIGGSSDQKSTIPKFINELTQKCEHLGVFLSKNTLSSTFFEPSHILNNISLLESKLKEIQRAASNNLQLIICVMEKKHKGYGDLKRISETRIGVVTQCCLYPNITKLSSQFVSNLALKINAKIGGSMTELYNSIPSHIPRLLRPDEPVIFMGADVTHPHPFDDCSPSVAAVVGSINWPEANRYVSRMRSQTHRQEIIQDLDLMVKELLDDFYKAVKKLPNRIIFFRDGVSETQFKKVLQEELQSIKTACSKFQDYNPSITFAVVQKRHHTRLFRCDPDHENIPPGTVVDTVITHPKEFDFYLCSHLGVKGTSRPTHYHILWDENEFTSDELQRLVYNLCYTFVRCTKPISIVPPAYYAHLAAYRGRLYIERSSESNGGSMNPSSVSRVGPPKTIPLPKLSDNVKNLMFYCMEEKTHHHHHSTNKHIPSSKSRTPLLHKPYHHHVQTNPPPFLLHPSSHQNLNLVASNLPSSYYYYYYCYFYSQFHNSLPPPPPPHLLPLSPPLPPLLPLPPPHSMTRFHKSLPVSQVVERKQQHQQKKKIQVSNNKVSGSIAIEEAALVVAKRPDFGGQDGSVIYLLANHFLVKFDSSQRIYHYNVEISPQPSKEIARMIKQKLVETDRNSFSGVVPAFDGRQNIYSPVEFQGDRLEFFVNLPIPSCKAVMNYGDLREKQPQKKIEKLFRVNMKLVSKFDGKEQRKEGEDWAPLPPEYIHALDVILRENPMEKCTSIGRSFYSSSMGGSKEIGGGAVGLRGFFQSLRHTQQGLALNMDLSITAFHESIGVIAYLQKRLEFLTDLPRNKGRELSLEEKREVEKALKNIRVFVCHRETVQRYRVYGLTEEITENIWFPDREGKYLRLMSYFKDHYGYEIQFKNLPCLQISRARPCYLPMELCMICEGQKFLGKLSDDQAAKIMKMGCQKPNERKAIIDKDRSVHRGNSNNLSFYIRVLKHRKEFNILVLYFDSGNQTREFNLEVSREMTLLKGRILQPPKLKLDRPRNLKESKVFKGTRIERWALMSIGGSSDQKSTIPKFINELTQKCEHLGVFLSKNTLSSTFFEPSHILNNISLLESKLKEIQRAASNNLQLIICVMEKKHKGYGDLKRISETRIGVVTQCCLYPNITKLSSQFVSNLALKINAKIGGSMTELYNSIPSHIPRLLRPDEPVIFMGADVTHPHPFDDCSPSVAAVVGSINWPEANRYVSRMRSQTHRQEIIQDLDLMVKELLDDFYKAVKKLPNRIIFFRDGVSETQFKKVLQEELQSIKTACSKFQDYNPSITFAVVQKRHHTRLFRCDPDHENIPPGTVVDTVITHPKEFDFYLCSHLGVKGTSRPTHYHILWDENEFTSDELQRLVYNLCYTFVRCTKPISIVPPAYYAHLAAYRGRLYIERSSESNGGSMNPSSVSRVGPPKTIPLPKLSDNVKNLMFYC

SEQ ID NO: 14176 - protein, 445 aa, Panicum virgatum
  misc_feature: Useful for making plants with altered carbohydrate content
MGLRRDSAAALVALVLAVTCCSVAVVAYDPLDPNGNITIKWDVISWTPDGYVAMVTMSNYQMYRHIMAPGWTVGWSWAKKEVIWSIVGAQATEQGDCSKFKAGIPHCCKRTPAVVDLLPGVPYNQQIANCCKAGVVAAYGQDPTAAVSAFQVSVGLAGTTNKTVKLPTNFTLQGPGPGYTCGPARVVPSTVYLTPDRRRRTQALMTWTVTCTYSQQLASRYPSCCVSFSSFYNSTIVPCAHCACGCGHGGHGGAGCIAGDSKRALSPGVNTPRRDGQPLLQCTPHMCPVRVHWHVKLNYKDYWRAKIAITNFNYRINYTQWTLVAQHPNLDNVTEVFSFQYRPLLPYGAINDTGMFYGLKFYNDLLMEAGPFGNVQSEVLMRKDARTFTFSQGWAFPRKIYFNGDECKMPPPDSYPYLPNRSARVAAPSVIASAFLLALLLLLAP

SEQ ID NO: 14177 - protein, 326 aa, Arabidopsis thaliana
  misc_feature: Useful for making plants with altered lignin content
MSRSLVFFFLFLVLVVPCLSHGTGGDHDDDEAPHVKSSDLKSKSLISVKIACLVIIFVLTFISGVSPYFLKWSQGFLVLGTQFAGGVFLATALMHFLSDADETFRDLLTAEGESEPSPAYPFAYMLACAGFMLTMLADSVIAHIYSKTQNDLELQGEDKSNQRSATTETSIGDSILLIVALCFHSVFEGIAIGISETKSDAWRALWTITLHKIFAAIAMGIALLRMIPDRPLFSSITYSFAFAISSPIGVAIGIVIDATTQGSIADWIFALSMSLACGVFVYVSVNHLLAKGYRPNKKVHVDEPRYKFLAVLFGVVVIAIVMIWDT

SEQ ID NO: 14178 - protein, 361 aa, Arabidopsis thaliana
  misc_feature: Useful for making plants with modulated biomass
MDKYELVKDIGAGNFGVARLMRVKNSKELVAMKYIERGPKIDENVAREIINHRSLRHPNIIRFKEVVLTPTHIAIAMEYAAGGELFERICSAGRFSEDEARYFFQQLISGVSYCHAMQICHRDLKLENTLLDGSPAPRLKICDFGYSKSSLLHSMPKSTVGTPAYIAPEVLSRGEYDGKMADVWSCGVTLYVMLVGAYPFEDQEDPKNFKKTIQRIMAVKYKIPDYVHISQDCKHLLSRIFVTNSNKRITIGDIKKHPWFLKNLPRELTEIAQAAYFRKENPTFSLQSVEEIMKIVEEAKTPARVSRSIGAFGWGGGEDAEGKEEDAEEEVEEVEEEEDEEDEYDKTVKQVHASMGEVRVS

SEQ ID NO: 14179 - protein, 312 aa, Arabidopsis thaliana
  misc_feature: Useful for making plants with altered terpenoid content
MSDAFCSDCKRHTEVVFDHSAGDTVCSECGLVLESHSIDETSEWRTFANESGDNDPVRVGGPTNPLLADGGLTTVISKPNGSSGDFLSSSLGRWQNRGSNPDRGLIVAFKTIATMADRLGLVATIKDRANEIYKRVEDQKSSRGRNQDALLAACLYIACRQEDKPRTVKEICSVANGATKKEIGRAKEYIVKQLGLETGQLVEMGTIHAGDFMRRFCSNLGMTNQTVKAAQESVQKSEEFDIRRSPISIAAAVIYIITQLSDEKKPLRDISVATGVAEGTIRNSYKDLYPHLSKIIPAWYAKEEDLKNLQSP

SEQ ID NO: 14180 - protein, 249 aa, Arabidopsis thaliana
  misc_feature: Useful for making plants with altered cell wall content and/or composition
MGHLGFLVMIMVGVMASSVSGYGGGWINAHATFYGGGDASGTMGGACGYGNLYSQGYGTSTAALSTALFNNGLSCGSCFEIRCENDGKWCLPGSIVVTATNFCPPNNALANNNGGWCNPPLEHFDLAQPVFQRIAQYRAGIVPVSYRRVPCRRRGGIRFTINGHSYFNLVLITNVGGAGDVHSAAIKGSRTVWQAMSRNWGQNWQSNSYLNGQALSFKVTTSDGRTVVSFNAAPAGWSYGQTFAGGQFR

SEQ ID NO: 14181 - protein, 229 aa, Panicum virgatum
  misc_feature: Useful for making plants with altered carbohydrate content
MAARRPGSPASRWLRPSALLLLVAFALLSAPRPARALLFDLESGHTKCISDEIKINSMAVDKYHVVGPDPNFPDAQLPESHRISLRVTSPYGNSMHYAENVQSGHFAFTATEAGDYLACFWAPDHKPPVTIGFEFDWRSGVSAKDWPSVAKKGKVDMMELELKKLEETIKNIHEEMFYLREREEEMQDLNRRTNSRMAWLGFLSLGICLSVAGLQLWHLKTFFERKKLL

SEQ ID NO: 14182 - protein, 214 aa, Arabidopsis thaliana
  misc_feature: Useful for making plants with altered cell wall content and/or composition
MFLRSLNLCTILLFLAISSQVSQSLHFELQSGRTKCISEDIKSNSMTVGKYTVVNPNEAHPSPQSHKISIRVTSSYGNTYHHAEDVESGQFAFTAVESGDYMACYTAVDHKPEVTLSIDFDWRTGVQSKSWSSVAKKSQVEVMEFDVKRLIETVNSIHEEMFYLREREEEMQNLNRATNSKMAWLSFLSLFVCLGVAGMQFVHLKTFFEKKKVI

SEQ ID NO: 14183 - protein, 519 aa, Panicum virgatum
  misc_feature: Useful for making plants with altered carbohydrate content
MELPPWAAFLGVVLATVMLLKAVLGRRGRRAYNLPPGPKPWPIIGNLDLMGALPHRSIHELSRKYGPLMQLRFGSFPVVVGSSVDMAKFFLKTHDVMFTDRPKTAAGKYTTYNNRDITWSPYGAYWRQARKMCLTELFSAKRLQSYEYIRAAEVQALLRDLHAASGSGRAVMLKDYLSTVSLNVITRMVLGKKYLDKEVVAGGCSVTTPGEFKWMLDELFLLNGVLNIGDSIPWLDWMDLQGYIRRMKKISKMFDRFLEHVVEEHNQRRLREGKSFVAKDMVDVLLQIADDPTLEVELNKESVKAFTQDLIAGGTESSAVTVEWAISELLKKPEVIAKATEELDRVIGRSRWVTEKDIPQLPYVDAIVKETMRLHPVAPLLVPRLAREDATVDGYDIPAGTRVLVSVWSIGRDPALWDAPEEFMPERFLGSKLDVKGQDYELLPFGSGRRMCPGYSLGLKVIQVSLANLLHGFTWSLPNGMTKEELSMEEIFGLSTPRKFPLEAVVEPKLPAHLYATEA

SEQ ID NO: 14184 - protein, 351 aa, Arabidopsis thaliana
  misc_feature: Useful for making plants with altered cell wall content and/or composition
MASRSLSYTQLLGLLSFILLLVTTTTMAVRVGVILHKPSAPTLPVFREAPAFRNGDQCGTREADQIHIAMTLDTNYLRGTMAAVLSLLQHSTCPENLSFHFLSLPHFENDLFTSIKSTFPYLNFKIYQFDPNLVRSKISKSIRQALDQPLNYARIYLADIIPSSVDRIIYLDSDLVVVDDIEKLWHVEMEGKVVAAPEYCHANFTHYFTRTFWSDPVLVKVLEGKRPCYFNTGVMVVDVNKWRKGMYTQKVEEWMTIQKQKRIYHLGSLPPFLLIFAGDIKAVNHRWNQHGLGGDNFEGRCRTLHPGPISLLHWSGKGKPWLRLDSRKPCIVDHLWAPYDLYRSSRHSLEE

SEQ ID NO: 14185 - protein, 377 aa, Panicum virgatum
  misc_feature: Useful for making plants with altered carbohydrate content
MLWVTRLSGFFSAAMVMVVLSPSLQSFPPAEAIRSSQFDGSVRFPGQIAGGARGIAFRRAPSFRNAADCGGGGGAGNGTAVNVCDPSLVHIAITLDEEYLRGSVAAVHSVVQHARCPESVFFHFLVSDPGLGDLVRAVFPQLRFKVYYFDPDRVRGLISTSVRQALEQPLNYARNYLADLLEPCVRRVIYLDSDLVLVDDVAKLWRTDLGGRTVGAPEYCHANFTKYFTGRFWSDQRFAGTFAGRRPCYFNTGVMVLDLERWRQASYTQRIERWMEIQKSSPGRIYELGSLPPFLLVFAGHVAPIEHRWNQHGLGGDNVLGSCRDLHPGPVSLLHWSGSGKPWARLGAGRPCPLDALWAPFDLYGPAGAGAGAEESW

SEQ ID NO: 14186 - protein, 345 aa, Arabidopsis thaliana
  misc_feature: Useful for making plants with modulated biomass
MGRFKNNKKSRVIGKPIAKKNQEDVSHVTGDKIPKSFVFSRMKLAGPVKQLQMDLRKLMLPYTALSLKEKKRNTLRDFLNVSGPMGVTHFLMLSKTASSLSLRVARTPQGPTLTFKIHQYSLASDIAQSQLRPRCPQDLFKSPPLIVLSGFGSQELHLKLATIMFQNIFPAIDINTVKLSTCQRLVLLNYNKDTKLIDFRHYSIRLQPVGVSRRIRKFVQNHQVPDLRNLQDVSDFVTKAGYGSESEGDEEAATVTLSSDLGRVNKGATKSAVKLQEIGPRMTMQLVKVEEGLCTGGIIFSEYDVDGKKEKLKKKQDEEEEEDSEEEGEEGSEEDGEDMDEDFED

SEQ ID NO: 14187 - protein, 484 aa, Panicum virgatum
  misc_feature: Useful for making plants with altered carbohydrate content
MDNGSAKQTVVLIPGGGVGHVGPMTQLAKVFLDHGFDVTMVLIEPPIKSTDSGASFIERVAASNPSITFHVLPPIPPPDFASSPKHPFLLMLDFMCQYNEKLESFLSSIPRPRLHSIIIDMFCSHVIDVAAKLGLPVYTFFASGAGVLAVFTQLPALLAGRRTGLKELGDTPLEFLGVPPMPASHLVRELLEDPEDELCRTMMNNWKRNTDTHGVLVNTFCSLESRALQAFRDPLCVPGRVLPPVYAIGPLVGRGRSGPDEEEAERPECLAWLDAQPERSVVFLCWGSKGSLPEKQIKEIAAGLEKSGQRFLWAVRTPAGSDDPKRYLEHRPEPDLDALLPKEFLERTKGRGFVIKSWAPQVDILRHPATGAFVTHCGWNSTLEAIAAGVPMLCWPLGAEQKMNKVLMTADMGVGVELEGYKAGLVKAEEIEAKVKLVLESEEGRELRERAAERKKEAEEALKDGGSSRAAFLRFLSDVENLRA

SEQ ID NO: 14188 - protein, 187 aa, Zea mays subsp. mays
  misc_feature: Useful for making plants with modulated nitrogen use efficiency
MGIDLVAGGRNKKTKRTAPKSDDVYLKLLVKLYRFLVRRTKSNFNAVILKRLFMSKTNRPPISMRRLVKFMEGKEKNIAVIVGTVTDDKRIQEVPAMKVTALRFTETARARIVNAGGECLTFDQLALRAPLGENTVLLRGPKNAREAVRHFGKAPGVPHSHTKPYVRSKGRKFEKARGRRNSRGFKV

SEQ ID NO: 14189 - protein, 512 aa, Arabidopsis thaliana
  misc_feature: Useful for making plants with modulated cold sensitivity
MEISVASVTISVVLAVVSWWIWRTLQWVWFKPKMLEHYLRRQGLAGTPYTPLVGDLKKNFTMLSEARSKPLKLTDDISPRVVPYPLQMFKTYGRTYFTWFGPIPTITIMDPEQIKEVFNKVYDFQKPHTFPLATIIAKGLANYDGDKWAKHRRIINPAFHIEKIKNMVPAFHQSCREVVGEWDQLVSDKGSSCEVDVWPGLVSMTADVISRTAFGSSYKEGQRIFELQAELAQLIIQAFRKAFIPGYSYLPTKSNRRMKAAAREIQVILRGIVNKRLRAREAGEAPSDDLLGILLESNLRQTEGNGMSTEDLMEECKLFYFAGQETTSVLLVWTMVLLSQHQDWQARAREEVKQVFGDKEPDAEGLNQLKVMTMILYEVLRLYPPVTQLTRAIHKELKLGDLTLPGGVQISLPILLVQHDIELWGNDAAEFNPDRFKDGLSKATKSQVSFFPFAWGPRICIGQNFALLEAKMAMALILRRFSFEISPSYVHAPYTVITIHPQFGAQLIMHKL

SEQ ID NO: 14190 - protein, 508 aa, Arabidopsis thaliana
  misc_feature: Useful for biocontainment applications
  misc_feature: Useful for making plants with modulated biomass
  misc_feature: Useful for making plants with modulated flowering time
MEIVIASLALVVVLWCIWRILEWVWLKPKMLESYLRRQGLVGTRYTPLVGDVRRSFSMLKEARSKPMKPTDDLISLVMPYSFHMLNTYGKTFFTWSGPIPAITIMNPQLIKEVYNKFYDFEKTHTFPLTSLLTDGLANADGDKWVKHRKIINPAFHFEKIKNMVPTFYKSCIEVMCEWEKLVSDKGSSCELDVWPWIVNMTGDVISRTAFGSSYKEGQRIFILQAELAHLIILALGKNYIPAYRHFPTKNNRRMKTIVKEIQVILRGIISHREKARDAGEAPSDDLLGILLKSNSEQSKGNGLNMEEIMEECKLFYFAGQETTSVLLAWTMVLLSQHQDWQARAREEVMQVFGHNKPDLQGINQLKVMTMIIYEVLRLYPPVIQMNRATHKEIKLGDMTLPGGIQVHMPVLLIHRDTKLWGDDAAEFKPERFKDGIAKATKNQVCFLPFGWGPRICIGQNFALLEAKMALALILQRFSFELSPSYVHSPYRVFTIHPQCGAHLILHKL

SEQ ID NO: 14191 - protein, 512 aa, Arabidopsis thaliana
  misc_feature: Useful for making plants with modulated nitrogen use efficiency
MEISVASVTVSVAVVVVSWWVWRTLQRVWLKPKMLESYLRRQGLAGTPYTPLVGDLKRNFSMLAEARSKPINLTDDITPRIVPYPLQMLKTHGRTFFTWFGPIPTITIMDPEQIKEVFNKVYDFQKAHTFPLGRLIAAGLVSYDGDKWTKHRRIINPAFHLEKIKNMVPAFHQSCSEIVGEWDKLVTDKQSSCEVDIWPWLVSMTADVISRTAFGSSYKEGQRIFELQAELAQLIIQAFRKAIIPGYRYFPTKGNRRMKAAAREIKFILRGIVNKRLRAREAGEAPSDDLLGILLESNLGQTKGNGMSTEELMEECKLFYFAGQETTTVLLVWTMVLLSQHQDWQARAREEVKQVFGDKEPDAEGLNQLKVMTMILYEVLRLYPPVVQLTRAIHKEMQLGDLTLPGGVQISLPILLIQRDRELWGNDAGEFKPDRFKDGLSKATKNQVSFFPFAWGPRICIGQNFALLEAKMAMTLILRKFSFELSPSYVHAPYTVLTTHPQFGAPLILHKL

SEQ ID NO: 14192 - protein, 467 aa, Panicum virgatum
  misc_feature: Useful for making plants with altered carbohydrate content
MARTLLLPLAATTVLVASTIFLFAAAGARWRPADTGLLVPPRAVSVPVTASASSNTTGARKELSFLDENSGPDDPGSGAARCDPRAAAVRVFMYDLPPEFHFGLLGWSPPSPGSVWPDLTNDAAAPPPRYPGGLNQQHSVAYWLTLDLLSSSSAPCGAAVRVADPRDADLVFVPFFASLSYNRHSRPVPPEKVSRDKALQEKLVMYLSARLEWKRYGGADHVIVAHHPNSLLHARAVLSPAVFVLSDFGRYHPRVASLEKDVIAPYKHMAKTFVNDSAGFDHRPTLLYFRGAIYRKEGGSIRQELYYMLKDEKDVYFSFGSVQDHGASKASQGMHSSKFCLNIAGDTPSSNRLFDAIVSHCVPVIISDDIELPYEDVLDYSKFSIFVRSSDAVKKGYLMRLISGVSKEQWTRMWNRLKEVDKHFEYQYPSQKDDAVQMIWQALARRVPAIQLKVHRSSRFSRSDRGK

SEQ ID NO: 14193 - protein, 475 aa, Arabidopsis thaliana
  misc_feature: Useful for making plants with altered cell wall content and/or composition
MAMVEKNSSAIGYVARNLLLSLFVVTTILFALSCYFVLRSTAHNRFLSSTFPSKSFVDVRPEKANCRCVKDEKSSVIAGPLKVYMYNMDPEFHFGLLDWKKKEGSDSSVWPDIQKYIPPYPGGLNLQHSIEYWLTLDLLASEYENAPRSVAAKRVYNSSEADVIFVPFFSSLSYNRFSKVNPHQKTSRNKDLQGKLVTFLTAQEEWKRSGGRDHVVLAHHPNSMLDARNKLFPAMFILSDFGRYPPTVANVEKDVIAPYKHVIKAYENDTSGFDSRPILLYFQGAIYRKDGGFVRQELFYLLQDEKDVHFSFGSVRNGGINKASQGMHNSKFCLNIAGDTPSSNRLFDAIASHCVPVIISDDIELPFEDVIDYSEFSVFVRTSDALKENFLVNLIRGITKEEWTRMWNRLKEVEKYYEFHFPSKVDDAVQMIWQAIARKVPGVKMRIHKSRRYSGSVSETGKESRWSSLIPRSFW

SEQ ID NO: 14194 - protein, 344 aa, Panicum virgatum
  misc_feature: Useful for making plants with altered carbohydrate content
MAPEIAGKMTAKAAAAAAAAAAAVKPATRAYVTFLAGDGDYWKGVVGLAKGLRKVGSAYPLVVAVLPDVPEAHRRILVSQGCIVREIEPVYPPENQTQFAMAYYVINYSKLRIWEFVEYERMVYLDADIQVFDNIDELFELEKGHFYAVMDCFCEKTWSHTPQYKIGYCQQCPDKVAWPTAELGPPPALYFNAGMFVHEPSMATAKALLETLRVTPPTPFAEQDFLNMFFREQYKPIPLVYNLVLAMLWRHPENVQLEKVKVVHYCAAGSKPWRYTGKEANMDREDIKMLVKKWWDIYNDESLDFKGLPAADDDDEVEAVAKKPIRAALAEAGTVKYVTAPSAA

SEQ ID NO: 14195 - protein, 344 aa, Arabidopsis thaliana
  misc_feature: Useful for making plants with altered cell wall content and/or composition
MAPGLTQTADAMSTVTITKPSLPSVQDSDRAYVTFLAGNGDYVKGVVGLAKGLRKVKSAYPLVVAMLPDVPEEHRRILVDQGCIVREIEPVYPPENQTQFAMAYYVINYSKLRIWKFVEYSKMIYLDGDIQVYENIDHLFDLPDGYLYAVMDCFCEKTWSHTPQYKIRYCQQCPDKVQWPKAELGEPPALYFNAGMFLYEPNLETYEDLLRTLKITPPTPFAEQDFLNMYFKKIYKPIPLVYNLVLAMLWRHPENVELGKVKVVHYCAAGSKPWRYTGKEANMEREDIKMLVKKWWDIYDDESLDYKKPVTVVDTEVDLVNLKPFITALTEAGRLNYVTAPSAA

SEQ ID NO: 14196 - protein, 335 aa, Arabidopsis thaliana
  misc_feature: Useful for making plants with modulated water use efficiency
MAPEINTKLTVPVHSATGGEKRAYVTFLAGTGDYVKGVVGLAKGLRKAKSKYPLVVAVLPDVPEDHRKQLVDQGCVVKEIEPVYPPENQTEFAMAYYVINYSKLRIWEFVEYNKMIYLDGDIQVFDNIDHLFDLPNGQFYAVMDCFCEKTWSHSPQYKIGYCQQCPDKVTWPEAKLGPKPPLYFNAGMFVYEPNLSTYHNLLETVKIVPPTLFAEQDFLNMYFKDIYKPIPPVYNLVLAMLWRHPENIELDQVKVVHYCAAGAKPWRFTGEEENMDREDIKMLVKKWWDIYNDESLDYKNVVIGDSHKKQQTLQQFIEALSEAGALQYVKAPSAA

SEQ ID NO: 14197 - protein, 68 aa, Arabidopsis thaliana
  misc_feature: Useful for making plants with modulated nitrogen use efficiency
MPSSIRWWWPIHFTSSGSVPRWLSWRRPELSLLSVVVDDVVWKVVTAFESVALVSMLCFFFLFCGCTV

SEQ ID NO: 14198 - protein, 1172 aa, Arabidopsis thaliana
  misc_feature: Useful for making plants with modulated light quality response
  misc_feature: Useful for making plants with modulated light quality sensitivity
MVSGVGGSGGGRGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGIMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQLSKQMADGFAAIRTEFRMACPGEGLPPELVRDMFHSSRWTSPEGLGLSVCRKILKLMNGEVQYIRESERSYFLIILELPVPRKRPLSTASGSGDMMLMMPY

SEQ ID NO: 14199 - protein, 395 aa, Zea mays
  misc_feature: Useful for making plants with altered lignin content
  misc_feature: Useful for making plants with modulated drought sensitivity
MERSQRQSPPPPSPSSSSSSVSADTVLVPPGKRRRAATAKAGAEPNKRIRKDPAAAAAGKRSSVYRGVTRHRWTGRFEAHLWDKHCLAALHNKKKGRQVYLGAYDSEEAAARAYDLAALKYWGPETLLNFPVEDYSSEMPEMEAVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEPQPDQSETGTTEQEPESSEAKTPDGSAEPDENAVPDDTAEPLSTVDDSIEEGLWSPCMDYELDTMSRPNFGSSINLSEWFADADFDCNIGCLFDGCSAADEGSKDGVGLADFSLFEAGDVQLKDVLSDMEEGIQPPAMISVCN

SEQ ID NO: 14200 - protein, 137 aa, Arabidopsis thaliana
  misc_feature: Useful for biocontainment applications
MEDVKGKEIIDDAPIDNKVSDEMESEENAIKKKYGGLLPKKIPLISKDHERAFFDSADWALGKQKGQKPKGPLEALRPKLQPTPQQQPRARRMAYSSGETEDTEIDNNEAPDDQACASAVDSTNLKDDGGAKDNIKS

SEQ ID NO: 14201 - protein, 361 aa, Arabidopsis thaliana
  misc_feature: Useful for making plants with altered cell wall content and/or composition
MLWIMRFSGLFSAALVIIVLSPSLQSFPPAEAIRSSHLDAYLRFPSSDPPPHRFSFRKAPVFRNAADCAAADIDSGVCNPSLVHVAITLDFEYLRGSIAAVHSILKHSSCPESVFFHFLVSETDLESLIRSTFPELKLKVYYFDPEIVRTLISTSVRQALEQPLNYARNYLADLLEPCVRRVIYLDSDLIVVDDIAKLWMTKLGSKTIGAPEYCHANFTKYFTPAFWSDERFSGAFSGRKPCYFNTGVMVMDLERWRRVGYTEVIEKWMEIQKSDRIYELGSLPPFLLVFAGEVAPIEHRWNQHGLGGDNVRGSCRDLHPGPVSLLHWSGSGKPWFRLDSRRPCPLDTLWAPYDLYGHYSR

SEQ ID NO: 14202 - protein, 83 aa, Arabidopsis thaliana
  misc_feature: Useful for making plants with altered cell wall content and/or composition
QSFIDNHIDPAGWFPWDGEFALSTLYYGEYANTGPGADTSKRVNWKGFKVIKDSKEAEQFTVAKLIQGGLWLKPTGVTFQEWL

SEQ ID NO: 14203 - protein, 580 aa, Arabidopsis thaliana
  misc_feature: Useful for making plants with altered cell wall content and/or composition
MDVTKSLLCFISFVAFLLFSSVAEANKAHHHEFIIQATKVKRLCETHNSITVNGMFPGPMLVVNNGDTLVVKVINRARYNITIHWHGVRQMRTGWADGPEFVTQCPIRPGSSYTYRFTIQGQEGTLWWHAHSSWLRATVYGSLLVFPPAGSSYPFTKPHRNVPLLLGEWWDANPVDVLRESIRTGGAPNNSDAYTINGQPGDLYKCSSQDTTVVPINVGETILLRVINSALNQPLFFTVANHKLTVVGADASYLKPFTTNVIVLGPGQTTDVLITGDQPPNRYYMAARAYQSAQNAPFGNTTTTAILQYKSAPCCGVGGGSGTKKGNSFKPIMPILPAYNDTNTVTRFSQSFRSLRRAEVPTEIDENLFVTIGLGLNNCPKNFRSRRCQGPNGTRFTASMNNVSFALPSNYSLLQAHHHGIPGVFTTDFPAKPPVKFDYTGNNISRSLYQPDRGTKLYKLKYGSRVQIVLQDTGIVTPENHPIHLHGYDFYIIAEGFGNFNPKKDTAKFNLEDPPLRNTVGVPVNGWAVIRFIADNPGVWIMHCHLDAHISWGLAMAFLVENGNGVLQTIEQPPHDLPVC

SEQ ID NO: 14204 - protein, 557 aa, Arabidopsis thaliana
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
  misc_feature: Useful for making plants with modulated low light sensitivity
MKMGFLFLFCYLLAFLGYSPVDAAVKKYQFDVQVKNISRICNAKPIVTVNGMFPGPTVYAREGDRVIINVTNHVQYNMSIHWHGLKQYRNGWADGPAYITQCPIQTGQSYLYDFNVTGQRGTLWWHAHILWLRATVYGAIVILPAPGKPYPFPQPYQESNIILGEWWNKDVETAVNQANQLGAPPPMSDAHTINGKPGPLFPCSEKHTFVIEAEAGKTYLLRIINAALNDELFFGIAGHNMTVVEIDAVYTKPFTTKAILLGPGQTTNVLVKTDRSPNRYFMAASPFMDAPVSVDNKTVTAILQYKGVPNTVLPILPKLPLPNDTSFALDYNGKLKSLNTPNFPALVPLKVDRRLFYTIGLGINACPTCVNGTNLAASINNITFIMPKTALLKAHYSNISGVFRTDFPDRPPKAFNYTGVPLTANLGTSTGTRLSRVKFNTTIELVLQDTNLLTVESHPFHLHGYNFFVVGTGVGNFDPKKDPAKFNLVDPPERNTVGVPTGGWAAIRFRADNPGVWFMHCHLEVHTMWGLKMAFVVENGETPELSVLPPPKDYPSC

SEQ ID NO: 14205 - protein, 571 aa, Panicum virgatum
  misc_feature: Useful for making plants with altered carbohydrate content
MEAPPGLALLLFFGTLLVLPQSSHGATRYYTFNVTMQNVTRLCTTRAIPTVNGKFPGPKIVTREGDRVVVKVVNNVKDNVTIHWHGVRQLRTGWSDGPAYVTQCPIRTGQSYVYNFTITGQRGTLLWHAHVSWMRATLYGPIVILPKRGVPYPFPVKPYKEVPIIFGEWFKTDPEAIIAQALKTGAGPNVSDAFTINGLPGPLYNCSSKDTFKLKVQPGKWYLLRLINAALNEDLFFSIANHTLTVVDVDAAYVKPFHADVVLITPGQTTNVLLRAEPDAGCPAATHLMLARPYSTGQPGTFDNTTVAAVLEYAPPGHIKSLPLLRPPLPTLNDTAFAANYSAKLRSLATPEYPANVPRGVDRSFFFTVGLGTNPCPANRTCQGPNGSMFTASMNNVSFGMPTTALLQAHYSNIAGVYATDFPAAPLEAFNYTGTPPNNTHVSNGTKVVELQYNTSVEVVLQGTSILGAESHPLHLHGFDFFVVGQGFGNYDSSKDPAKFNLVDPVQRNTVGVPAAGWVAIRFFADNPGVWFMHCHLEVHTSWGLKMAWVVNDGPLPEQKLMPPPADLPKC

SEQ ID NO: 14206 - protein, 106 aa, Arabidopsis thaliana
  misc_feature: Useful for making plants with modulated nitrogen use efficiency
  misc_feature: Useful for making plants with modulated oxidative stress sensitivity
MSSAVDATGNPIPTSAVLTASAKHIGMRCMPENVAFLKCKKNDPNPEKCLDKGRDVTRCVLGLLKDLHQKCQKEMDDYVGCMYYYTNEFDLCRKEQEAFEKVCPLK

SEQ ID NO: 14207 - protein, 217 aa, Arabidopsis thaliana
  misc_feature: Useful for biocontainment applications
  misc_feature: Useful for making plants with modulated flowering time
MASISNEPERENRDEEETGANEDEDTGAQVAPIVRLEEVAVTTGEEDEDTILDLKSKLYRFDKDGSQWKERGAGTVKFLKHRVSGKIRLVMRQSKTLKICANHLVGSGMSVQEHAGNDKSCVWHARDFSDGELKDELFCIRFASVENCKAFMQKFKEVAESEEEKEESKDASDTAGLLEKLTVEEKESEKKPVEKAEENKKSEAVEEKKTEESVPSA

SEQ ID NO: 14208 - protein, 333 aa, Arabidopsis thaliana
  misc_feature: Useful for making plants with modulated nitrogen use efficiency
MRLTHFTGLKECGRGIIDPGFDCQTYGRPDSDYLKFRWKPFNCNVPRFNGVKFLQEMRDKTIMFVGDSLGRNQWESLICMISSSAPSINTHIIHEDPLSTFKILDYNVKVSFYRAPYLVDIDKINGKTTLKLDEISVDASNAWRTADVLLFNTGHWWSHTGSLRGWEQMETGGRYYGDMDRLVALRKGLGTWSSWVLRYNNSPLTRVFFLSVSPTHYNPNEWTSRSKTSTITQGGKSCYGQTTPFSGTTYPTSSYVNQKKVIDDVVKEMKSHVSLMDITMLSALRVDGHPSIYSGDLNPSLKRNPDRSSDCSHWCLPGLPDTWNQLFYAALLY

SEQ ID NO: 14209 - protein, 238 aa, Arabidopsis thaliana
  misc_feature: Useful for making plants with modulated salt sensitivity
MAVSSLSIRCGGFSPTISHKTEILCPNPSLKACCLLSSGGKADSSESTYQKGSGNNWKRRQALVGVGTLVATSIPATLLLAEEIPKSYSPFVDREDGYSYYYPSDWREFDFRAHDSAFKDRYLQLQNVRVRFIPTEKNDIHEVGPMEEVVYDLVKHKFAAPNQVATIYDMKERVEDGKNYYTFEYGLRTPIYATTSFATVAVGNNRYYTLIVGANERRWRKVKKQLQVVADSLKILQI

SEQ ID NO: 14210 - protein, 542 aa, Panicum virgatum
  misc_feature: Useful for making plants with altered carbohydrate content
MGSVDESAAAEVVFRSKLPDIEINNSQPLHAYCFGKMPEVAGRPCLIDGQTGASYTYAEVESLSRRAAAGLRRMGVGKGDVVMSLLRNCPEFAFAFLGAARLGAATTTANPFYTPHEIHRQAEAAGAKLIVTEACAVDKVREFAAARGIPVVTVDGRFDGCAEFVEVIAAEELEADADIHPDDVVALPYSSGTTGLPKGVMLTHRSLITSVAQQVDGENPNLNFRTDDVVLCLLPLFHIYSLNSVLLAGLRAGCAIVIMRKFDLGALVDLVRAHGITIAPFVPPIVVEIAKSPRVTAADLASIRMVMSGAAPMGKDLQDAFMAKIPNAVLGQGYGMTEAGPVLAMCLAFAKEPFQVKSGSCGTVVRNAELKIVDPDTGAALGRNQPGEICIRGEQIMKGYLNDPKSTKNTIDKDGWLHTGDIGYVDDDDEIFIVDRLKEIIKYKGFQVPPAELEALLITHPEIKDAAVVSMKDDLTGEIPVAFIVRTEGSQLTEDEIKQFVAKEVVFYKKIHKVFFTDSIPKNPSGKILRKDLRARLAAGVH

SEQ ID NO: 14211 - protein, 561 aa, Arabidopsis thaliana
  misc_feature: Useful for making plants with altered lignin content
MAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVAMKEEAAGEVPVAFVVKSKDSELSEDDVKQFVSKQVVFYKRINKVFFTESIPKAPSGKILRKDLRAKLANGL

SEQ ID NO: 14212 - protein, 668 aa, Panicum virgatum
  misc_feature: Useful for making plants with altered carbohydrate content
MATPYKPKNILITGAAGFIASHVATRIVKKYPDYKIVVLDKLDYCSNLKNLLSVSSSPNFKFVKGDIASADLVNFILVTENIDTVMHFAAQTHVDNSFGNSFEFTKNNIYGTHVLLEACRQITGQIKRFIHVSTDEVYGETDEDAVVGNHEMSQLLPTNPYAATKAGAEMLVMAYGRSYGLPVITTRGNNVYGPNQFPEKLIPKFILLAMRGQPLPIHGDGSNVRSYLYCEDVAEAFEVILHRGEVGHVYNIGTKKERTVMNVAKDICKLFNLEADKAIKFVDNRPFNDQRYFLNNEKLMSLGWSEHTHWEEGLRKTMEWYVSNSDYWGDVSGALLPHPKAMVMPGGYEGSKEIKGILAQFNNIQTKVAPTSDSVLETHPFKFLIYGRTGWIGGLLGKICEKQGIQYEYGKGRLQERSSLILDIQTIKPTHVFNAAGVTGRPNVDWCESHKPETIRTNVVGTLTLADVCREHGLLMINYATGCIFEYDAQHPEGSGIGFKEEDTPNFTGSFYSKTKAMVEELLKEYENVCTLRVRMPISSDLSNPRNFVTKISRYDKVVNIPNSMTILDELLPISIEMAKRNLRGIYNFTNPGVVSHNEVLEMYKQYIDPSFKWTNFTLEEQAKVIVAPRSNNELDTTKLEQEFPELLSIKDSLIKYVFEPNRKVPAN

SEQ ID NO: 14213 - protein, 301 aa, Arabidopsis thaliana
  misc_feature: Useful for making plants with altered cell wall content and/or composition
MVADANGSSSSSFNFLIYGKTGWIGGLLGKLCEAQGITYTYGSGRLQDRQSIVADIESVKPSHVFNAAGVTGRPNVDWCESHKVETIRTNVAGTLTLADICREKGLVLINYATGCIFEYDSGHPLGSGIGFKEEDTPNFTGSFYSKTKAMVEELLKNYENVCTLRVRMPISSDLTNPRNFITKIARYEKVVDIPNSMTILDELLPISIEMAKRNLTGIYNFTNPGVVSHNEILEMYRDYIDPSFTWKNFTLEEQAKVIVAPRSNNELDATKLKTEFPELMSIKESLIKFVFEPNKKTEVKA

SEQ ID NO: 14214 - protein, 669 aa, Arabidopsis thaliana
  misc_feature: Useful for making plants with altered cell wall content and/or composition
MASYTPKNILITGAAGFIASHVANRLIRSYPDYKIVVLDKLDYCSNLKNLNPSKHSPNFKFVKGDIASADLVNHLLITEGIDTIMHFAAQTHVDNSFGNSFEFTKNNIYGTHVLLEACKVTGQIRRFIHVSTDEVYGETDEDALVGNHEASQLLPTNPYSATKAGAEMLVMAYGRSYGLPVITTRGNNVYGPNQFPEKLIPKFILLAMRGQVLPIHGDGSNVRSYLYCEDVAEAFEVVLHKGEVGHVYNIGTKKERRVNDVAKDICKLFNMDPEANIKFVDNRPFNDQRYFLDDQKLKKLGWSERTTWEEGLKKTMDWYTQNPEWWGDVSGALLPHPRMLMMPGGRHFDGSEDNSLAATLSEKPSQTHMVVPSQRSNGTPQKPSLKFLIYGKTGWIGGLLGKICDKQGIAYEYGKGRLEDRSSLLQDIQSVKPTHVFNSAGVTGRPNVDWCESHKTETIRANVAGTLTLADVCREHGLLMMNFATGCIFEYDDKHPEGSGIGFKEEDTPNFTGSFYSKTKAMVEELLKEYDNVCTLRVRMPISSDLNNPRNFITKISRYNKVVNIPNSMTVLDELLPISIEMAKRNLKGIWNFTNPGVVSHNEILEMYRDYINPEFKWANFTLEEQAKVIVAPRSNNEMDASKLKKEFPELLSIKESLIKYAYGPNKKT

SEQ ID NO: 14215 - protein, 350 aa, Panicum virgatum
  misc_feature: Useful for making plants with altered carbohydrate content
MAQKETNGSNGEHTTSRPPPTPSPLRFSKFFQANLRILVTGGAGFIGSHLVDKLMENEKHEVIVADNFFTGSKDNLKKWIGHPRFELIRHDVTQPLLVEVDQIYHLACPASPIFYKHNPVKTIKTNVIGTLNMLGLAKRVGARILLTSTSEVYGDPLEHPQTEAYWGNVNPIGVRSCYDEGKRVAETLMFDYHRQHGIEIRIARIFNTYGPRMNIDDGRVVSNFIAQAVRGEPLTVQKPGTQTRSFCYVADMVDGLIKLMNGNNTGPINLGNPGEFTMLELAENVKELINPEVTVMMTENTPDDPRQRKPDITKAKEVLGWEPKVVLRDGLVLMEGDFRERLAVPKKTKA

SEQ ID NO: 14216 - protein, 341 aa, Arabidopsis thaliana
  misc_feature: Useful for making plants with altered cell wall content and/or composition
MASSDKQTSPKPPPSPSPLRNSKFCQSNMRILISGGAGFIGSHLVDKLMENEKNEVIVADNYFTGSKDNLKKWIGHPRFELIRHDVTEPLLIEVDQIYHLACPASPIFYKYNPVKTIKTNVIGTLNMLGLAKRVGARILLTSTSEVYGDPLIHPQPESYWGNVNPIGVRSCYDEGKRVAETLMFDYHRQHGIEIRIARIFNTYGPRMNIDDGRVVSNFIAQALRGEALTVQKPGTQTRSFCYVSDMVDGLMRLMEGDDTGPINIGNPGEFTMVELAETVKELINPSIEIKMVENTPDDPRQRKPDITKAKEVLGWEPKVKLREGLPLMEEDFRLRLGVHKN

SEQ ID NO: 14217 - protein, 577 aa, Arabidopsis thaliana
  misc_feature: Useful for making plants with altered cell wall content and/or composition
MALQLLLAVFSCVLLLPQPAFGITRHYTLEIKMQNVTRLCHTKSLVSVNGQFPGPKLIAREGDQVLIKVVNQVPNNISLHWHGIRQLRSGWADGPAYITQCPIQTGQSYVYNYTIVGQRGTLWYHAHISWLRSTVYGPLIILPKRGVPYPFAKPHKEVPMIFGEWFNADTEAIIRQATQTGGGPNVSDAYTINGLPGPLYNCSAKDTFRLRVKPGKTYLLRLINAALNDELFFSIANHTVTVVEADAIYVKPFETETILIAPGQTTNVLLKTKSSYPSASFFMTARPYVTGQGTFDNSTVAGILEYEPPKQTKGAHSRTSIKNLQLFKPILPALNDTNFATKFSNKLRSLNSKNFPANVPLNVDRKFFFTVGLGTNPCNHKNNQTCQGPTNTTMFAASISNISFTMPTKALLQSHYSGQSHGVYSPKFPWSPIVPFNYTGTPPNNTMVSNGTNLMVLPYNTSVELVMQDTSILGAESHPLHLHGFNFFVVGQGFGNFDPNKDPRNFNLVDPIERNTVGVPSGGWAAIRFLADNPGVWFMHCHLEVHTSWGLRMAWLVLDGDKPDQKLLPPPADLPKC

SEQ ID NO: 14218 - protein, 706 aa, Panicum virgatum
  misc_feature: Useful for making plants with altered carbohydrate content
MSAPAPSSPATPVNPPAPVPPTPAPVPPTPSPVPPTPAPVLPTPSPLPPTPSPVPPTPSPLPPSPTPTPSPPPPVVTPSPPPPVPVVPTPSPPPPATVPTASPPPPATVPTPSPPPPATVPTPSPPPPATAPTPSPPPPVRRPPPPPSDVPTSPPPPTGVPASPAPPPPSHLSLPPPPPPSSPGTPPTSSPSKSTVNGTAVGIGVAVGAVVLLGLAAGLIYFFVGRKRRRRPPPSQGYPAEFYDPRRPVTTPPHMSHAPSTTPSSSTPPLMHSWQSSRGPSEPLMPPLNPSPAMTGGTFAYDDLAAATDGFSDANLLGQGGFGHVYRGTLGGQEVAIKKLRAGSGQGDREFRAEVEIISRVHHKNLVSLVGYCLYGEQRLLVYEYVPNKTLEFHLHGSGRPTLDWPRRWKIAVGSAKGLAYLHEDCHPKIIHRDIKAANILLDYNYEPKVADFGLAKYQAAEVTAVSTRVMGTFGYLAPEYAATGKVSDRSDVFSFGVMLLELITGRKPIMTSSAYQPETLVSWARPLLTRAVEEENYDELIDPRLETNYDAYDMARLIACAAAAVRQTARSRPRMSQIVRYLEGELSVEDLNAGVRPGQSAMQRSGGDTTDQIGRLRRMAFGPGAGGSTTGTGAGTITEYASSEFSDPTSEYGLNPSSEYTASSGGDTGEVPPAAQGQGQQWPGRRAAGDTERMSRRTIGRRGQT

SEQ ID NO: 14219 - protein, 315 aa, Arabidopsis thaliana
  misc_feature: Useful for making plants with modulated biomass
  misc_feature: Useful for making plants with modulated flowering time
MANPWWTGQVNLSGLETTPPGSSQLKKPDLHISMNMAMDSGHNNHHHHQEVDNNNNDDDRDNLSGDDHEPREGAVEAPTRRPRGRPAGSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSGGVVPGQLGGGGSPLSSGAGGGDGNQGLPVYNMPGNLVSNGGSGGGGQMSGQEAYGWAQARSGF

SEQ ID NO: 14220 - protein, 310 aa, Arabidopsis thaliana
  misc_feature: Useful for making plants with modulated light quality response
MANPWWVGNVAIGGVESPVTSSAPSLHHRNSNNNNPPTMTRSDPRLDHDFTTNNSGSPNTQTQSQEEQNSRDEQPAVEPGSGSGSTGRRPRGRPPGSKNKPKSPVVVTKESPNSLQSHVLEIATGADVAESLNAFARRRGRGVSVLSGSGLVTNVTLRQPAASGGVVSLRGQFEILSMCGAFLPTSGSPAAAAGLTIYLAGAQGQVVGGGVAGPLIASGPVIVIAATFCNATYERLPIEEEQQQEQPLQLEDGKKQKEENDDNESGNNGNEGSMQPPMYNMPPNFIPNGHQMAQHDVYWGGPPPRAPPSY

SEQ ID NO: 14221 - protein, 337 aa, Zea mays
  misc_feature: Useful for making plants with altered lignin content
MAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNSELEDQIKHLGVEVGAWQQRAKYNESLINALKYNLEQVCAHQSKDFKEGCGDSEVDDTASCPYGGAVNLQLMPKENRQPKNLTACRVCKSSEACMLLLPCRHLCLCKECESKLSICPLCQSSKILGMEIYYA

SEQ ID NO: 14222 - protein, 178 aa, Arabidopsis thaliana
  misc_feature: Useful for making plants with modulated low light sensitivity
MDEGREGEIEKKKKKDEEGEVKEGVASIALLPCGTISGHFIQMPSSICYGLHGTELACETECSRGEDYRLIKLTIIDYNRKKEQTVVVECKGHDAARINDVEHAHGWEEDVIGLVEEKHGKKKVSVSFECETLKADEAAEDHIRQFMPKLAGLDAVINIGPMKISGLDFAAVEEGHIN

SEQ ID NO: 14223 - protein, 481 aa, Panicum virgatum
  misc_feature: Useful for making plants with altered carbohydrate content
MAPQLTGAPGSAAAGGVAAAVKPQFHHYHHHRLPPRHYHPAPASLLSKLAFWSVCSLSLLLAFLLLSPSSAPAPRAAPESPRRSLHASPSSTASWGGAAWEKKVRASARVRRPRGHSVLVTGAAGFVGCHAAAALRRRGDGVLGLDNFNDYYDTALKRGRAALLARSGVYVVDGDIADSELLAKLFDVVPFTHVLHLAAQAGVRHALVDPMSYVRANVAGLVALLEAARSANPQPAIVWASSSSVYGLNSHVPFSEHDRTDRPASLYAATKKAGEEIAHVYNHIYGLSLTALRFFTVYGPWGRPDMAYFFFTRDILAGRPITVYESAGGGSHQTTISRDFTYIDDIVKGCVAALDTAGRSTGSGGKKRGPAPFRTYNLGNTSPVPVTQLVDLLEKLLKVKAVRKVVKMPRNGDVPYTHANVSLAQRELGYRPSTDLQTGLKKFVRWYLEYYHPDLAEKQKQHAGSNGKGSRGRNGSLSSAR

SEQ ID NO: 14224 - protein, 434 aa, Arabidopsis thaliana
  misc_feature: Useful for making plants with altered cell wall content and/or composition
MSHLDDIPSTPGKFKMMDKSPFFLHRTRWQSSVAKLAFWSLVFFGLLFIFFYRSPISNPDSSRRSLRTYSWGGPAWEKRVRSSARVRTRNGVSVLVTGAAGFVGTHVSAALKRRGDGVLGLDNFNDYYDTSLKRSRQALLERSGVFIVEGDINDLSLLKKLFEVVPFTHVMHLAAQAGVRYAMENPGSYVHSNIAGFVNLLEVCKSANPQPAIVWASSSSVYGLNTKVPFSEKDRTDQPASLYAATKKAGEEIAHTYNHIYGLSLTGLRFFTVYGPWGRPDMAYFFFTRDILKGKAISIFEGANHGTVARDFTYIDDIVKGCLGALDTAEKSTGSGGKKRGAAQLRVFNLGNTSPVPVTDLVSILERLLKVKAKRNMMKLPRNGDVPFTHANISSAQREFGYKPSTDLQTGLKKFVRWYLGYYKQGGKKVAAAA

SEQ ID NO: 14225 - protein, 442 aa, Panicum virgatum
  misc_feature: Useful for making plants with altered carbohydrate content
MAPRRLLRAGWGPQRPCGSRLAAALCAAVAALALAPAADATSASLVGINYGRVGSNLPPPQSVLPLLEGLGIGRVRVYDADPAVLRAFARTGVELVVGVPDECLAAVADPGGAAQWLKRSIVPFLQDTKIAVLTIGNEVLTGGNSSALSRVLLPAMQSLHGAVAALGLDKQITVTTAHNLGVLGTSYPPSAGAFRKDLLPYLCPILDYLARTGSPFLVNAYPYFAYSDDPKGVQLDYALLEPGYAGVQDPNSRLHYPNLLVAQVDAVYHAIAAANTAASRVVEVRVSETGWPSAGAANETGATPQNAARYNSNAMRLVAEGRGTPLKPGVPLRAYVFALFNENLKPGLASERYYGLFKPDGTPAYELSFKLPRDNSTFGHGGGFGGSGGGNANGSSGYFNGGGNSGGYYDISAAAPARDPPGRWWRTWAQAAVAAAVLVVAV

SEQ ID NO: 14226 - protein, 227 aa, Arabidopsis thaliana
  misc_feature: Useful for making plants with modulated heat sensitivity
MASTLSFAASALCSPLAPSPSVSSKSATPFSVSFPRKIPSRIRAQDQRENSIDVVQQGQQKGNQGSSVEKRPQQRLTMDVSPFGLLDPLSPMRTMRQMLDTMDRMFEDTMPVSGRNRGGSGVSEIRAPWDIKEEEHEIKMRFDMPGLSKEDVKISVEDNVLVIKGEQKKEDSDDSWSGRSVSSYGTRLQLPDNCEKDKIKAELKNGVLFITIPKTKVERKVIDVQIQ

SEQ ID NO: 14227 - protein, 328 aa, Panicum virgatum
  misc_feature: Useful for making plants with altered carbohydrate content
MACSTMAFLAVFVAAAAGSCLPAAAAGGPLPPAGTPLSFREGYTQLFGDSNLALHGDGRRVHISLDERTGAGFASQGAYLHGLFSARIKLPANHTASVVVAFYMSNGDVYERTHDELDFEFLGNVRGREWRVQTNVYGNGNTAAGREERYGLWFDPTEDFHRYAILWSRDRIIFYVDETPIREVVRTESMGAQFPSKPMSLYATIWDGSSWATSGGRYKVDYKYAPYVAEFADLALRGCAVGGRACEEPGGGTAAPAMSPAQRSAMEAFRAQHMTYGYCYDRLRYPAPLPECSVGPEAAAFLPSGDARAALRRRGRRHQTRGGADSAV

SEQ ID NO: 14228 - protein, 332 aa, Arabidopsis thaliana
  misc_feature: Useful for making plants with altered cell wall content and/or composition
MGFITRFLVFMSLFTSLVSGFALQKLPLIQFDEGYTQLFGDQNLIVHRDGKSVRLTLDERTGSGFVSNDIYLHGFFSSSIKLPADYSAGVVIAFYLSNGDLYEKNHDEIDFEFLGNIRGREWRIQTNIYGNGSTHLGREERYNLWFDPTEDFHQYSILWSLSHIIFYVDNVPIREVKRTASMGGDFPAKPMSLYSTIWDGSKWATDGGKYGVNYKYAPYVSQFTDLILHGCAVDPTEKFPSCKDEAVQNLRLASEITESQRNKMEIFRQKHMTYSYCYDHMRYKVVLSECVVNPAEAKRLRVYDPVTFGGIPHGHRRGKHRSRSRLARTESI

SEQ ID NO: 14229 - protein, 120 aa, Arabidopsis thaliana
  misc_feature: Useful for biocontainment applications
MEISQARSSFVCLLLLLSIFFIPCVFSKSPRPISDVEIRQKKSECYGDIESGLWGWQCKSSAIAKENCALRCLSPVCYQLIYESDPLEEGEKDLIRSQEYKYCMYKSSLGESLEGVRGIF

SEQ ID NO: 14230 - protein, 276 aa, Arabidopsis thaliana
  misc_feature: Useful for making plants with modulated heat sensitivity
SKTTITSAAFSSSSNTGGQNHYAVLGIARNATQGDIKRAYRLLARKFHPDVNKDSKAGELFKSVRCSYEVLSNEATRTQYDRALKLQENSRFHRVKRHSYTPEVEDAMKYYYTWSEKRQRSRHGRFYGHYSTYPNSHFYAETEPQEEEGVETAPDQRDSFVEALKSAFLSMFLLYTFGCLASLTFSTFTALLDKELDMGYKVGFMIAWILGGKGGILLTLCLTFASWLCGKASSSVVVLVLVAMWVGSNLARHAPLPQGALLTLLYMSIKLQVDST

SEQ ID NO: 14231 - protein, 500 aa, Panicum virgatum
  misc_feature: Useful for making plants with altered carbohydrate content
MKKLLLVFFLFLLGVAAVHGEDGAYIGVNIGTAMSSVPAPTQITTLLRSQNIRHVRLYDADPAMLAALANTGIRVIVSVPNEQLLAIGNSNATAANWVARNVAAHFPAVNITAIAVGSEVLSAQANAAPLLMPAMRYLQNALVAAALDRYIKISTPHSSSIILDSFPPSQAFFNRSLDNVLVPMLKFLQSTGSPLMLNVYPYYDYMRSNGVIPLDYALFRPLPPNKEAVDANTLLHYTNVFDAVVDAAYFAMSYLNVTNVPVMVTETGWPHKGDPSSEPDATAENADTYNSNLIRHVMNSTGTPKHPGVAVPTFIYELYDEDTRPGSTSEKYWSLFDMNGVPAYTLHLTGSGVLLANDTTNQTYCVAREDADPKMLQAALDWACGPGKVDCSALTQGQPCYEPDTVEAHATYAFNAYYHGMGMGSGTCYFSGVAVITTTDPSHGSCVYAGKNGSALLNGTSLAPSSNSTEGGSGTHRAVGDVSALARVVSAALLLSVLLL

SEQ ID NO: 14232 - protein, 501 aa, Arabidopsis thaliana
  misc_feature: Useful for making plants with altered cell wall content and/or composition
MAALLLLFLFLFASSALSQDSLIGVNIGTEVTNMPSPTQVVALLKSQNINRVRLYDADRSMLLAFAHTGVQVIISVPNDQLLGISQSNATAANWVTRNVAAYYPATNITTIAVGSEVLTSLTNAASVLVSALKYIQAALVTANLDRQIKVSTPHSSTIILDSFPPSQAFFNKTWDPVIVPLLKFLQSTGSPLLLNVYPYFDYVQSNGVIPLDYALFQPLQANKEAVDANTLLHYTNVFDAIVDAAYFAMSYLNFTNIPIVVTESGWPSKGGPSEHDATVENANTYNSNLIQHVINKTGTPKHPGTAVTTYIYELYNEDTRPGPVSEKNWGLFYTNGTPVYTLRLAGAGAILANDTTNQTFCIAKEKVDRKMLQAALDWACGPGKVDCSALMQGESCYEPDDVVAHSTYAFNAYYQKMGKASGSCDFKGVATVTTTDPSRGTCVFPGSAKSNQTLGNNTSALAPSANSTTSGCIPKYYHHPHASFGDLTLLSLLLIIALVFL

SEQ ID NO: 14233 - protein, 205 aa, Zea mays
  misc_feature: Useful for biocontainment applications
MDMVSQSEHLCYVRCTYCNTVLAVGVPCKRLMDTVTVKCGHCNNLSYLSPRPPMVQPLSPTDHPLGPFQCQGPCNDCRRNQPLPLASPSSTELSPRMPFVVKPPEKKHRLPSAYNRFMREEIQRIKAAKPDIPHREAFSMAAKNWAKCDPRCSTAASTETSNSAPAEPRVVPTPQLTEPRFDLEDRAKGQVIESFDIFKHIERSI

SEQ ID NO: 14234 - protein, 181 aa, Arabidopsis thaliana
  misc_feature: Useful for biocontainment applications
  misc_feature: Useful for making plants with modulated flowering time
MNLEEKPTMTASRASPQAEHLYYVRCSICNTILAVGIPLKRMLDTVTVKCGHCGNLSFLTTTPPLQGHVSLTLQMQSFGGSDYKKGSSSSSSSSTSSDQPPSPSPPFVVKPPEKKQRLPSAYNRFMRDEIQRIKSANPEIPHREAFSAAAKNWATYIPNSPTSITSGGHNMIHGLGFGEKK

SEQ ID NO: 14235 - protein, 361 aa, Panicum virgatum
  misc_feature: Useful for making plants with altered carbohydrate content
MGSTAADVAAAADEEACMYALQLASSSILPMTLKNAIELGLLEVLQKDPAAALAPEEVVARLPVAPANPDAAAMVDRMLRLLASYDVVRCRMEEGKDGRYSRRYSAAPVCKWLTPNEDGVSMAALALMNQDKVLMESWYYLKDAVLEGGIPFNKAYGMTAFEYHGTDPRFNRVFNEGMKNHSVIITKKLLEFYAGFEGVGTLVDVGGGVGATLHAITSRYPGIRGVNFDLPHVISEAPPFPGVEHVGGDMFKAVPAGDAILMKWILHDWSDAHCAAILKNCYDALPAGGKVIAVECILPVNPEATPKAQGVFHVDMIMLAHNPGGKERYEREFEELAKGAGFTGFKATYIYANAWAIEFTK

SEQ ID NO: 14236 - protein, 287 aa, Oryza sativa
  misc_feature: Useful for biocontainment applications
MMNMMTDLSCGPSSMTELTAAAAPAGSGSSAAVAAGSSEKMGRGKIEIKRIENTTNRQVTFCKRRNGLLKKAYELSVLCDAEVALIVFSSRGRLYEYANNSVKSTVERYKKANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGSRPSISFGVDTVRTHVR

SEQ ID NO: 14237 - protein, 510 aa, Arabidopsis thaliana
  misc_feature: Useful for making plants with altered cell wall content and/or composition
MAHRRLIMTMTKMMMMVTMMMMMDKTCICADISRGSFPKGFVFGTASSAFQHEGAVKAEGRGPTIWDTFSHTFGKITDFSNADVAVDQYHRYEEDVQLMKNMGMDAYRFSISWTRIFPNGVGHINEAGIDHYNKLINALLAKGIEPYVTLYHWDLPQALHDRYLGWLNPQIINDFAAYAEVCFQRFGDRVKHWITFNEPHTFAIQGYDVGLQAPGRCTILFKLTCREGNSSTEPYIVGHNVILTHATVSDIYRKKYKAKQGGSLGIAFDVMWFEPESNKTEDIEAAQRAQDFQLGWFLDPLMFGDYPSSMRSRVGSRLPVFTGSQSSLVKGSLDFVGINHYTTYYARNNATNLIGTLLHDAVSDSGTVTLPFKGLSTIGDRASSIWLYIVPRGMRSLMNYIKHRYGNPPVFITENGMDDPNSILISRKDALKDAKRIKYHHDYLSSLQASIKEDGCNVKGYFVWSLLDNWEWAAGYSSRFGLYFVDYRDNLKRYPKDSVHWFTSFLNSTS

SEQ ID NO: 14238 - protein, 495 aa, Panicum virgatum
  misc_feature: Useful for making plants with altered carbohydrate content
MFDELRGRLRMGLVNIRREDVLALGVEGEAMRVDLERVSDVFRWSDLFPEWIDEEEDDEGPSCPELPMPDLSRIDGEVDVVVASLPCNRTAPGGWNRDVFRLQVHLAAARVAARKGRRDGGGAVRVVLRSECEPMMDLFRCDEAVGREGDWWMYRVNVERLEEKLRLPVGSCNLALPLWGSGGIHEVFNVSSEPPTTTGRRPRREAYATVLHSSDTYLCGAIVLAQSIRRSGSTRDLVLLHDHTVSKPALRALSAAGWTPRRIKRIRNPRAARGSYNEYNYSKFRLWQLTEYDRVVFVDADILVLRNLDALFGFPQLSAVGNDGPLFNSGVMVIEPSACTFEALVRKRRTVRSYNGGDQGFLNEVFVWWHRLPRRVNYLKNFWANTTGERALKGRLFRAEPAEVWAIHYLGMKPWTCYRDYDCNWNVADQRVYASDEAHARWWQVYDRMGEPMRGPCRLSERRKVEIAWDRHVAQEMGFADQHWKINITDPRKWE

SEQ ID NO: 14239 - protein, 793 aa, Arabidopsis thaliana
  misc_feature: Useful for making plants with altered cell wall content and/or composition
MFSHQKWKFSWSQIATVASVIVLVSLVHLFLGPVVPSFDSITVRQAQNLCGPSNESISQVTKNSSQSLVVVAFDRRFPADSHGAVVYRNASWKAEIGQWLSSCDAVAKEVDIIEPIGGRKCMSDCSGQGVCNHEFGLCRCFHGFTGEDCSQKLRLDCNYEKTPEMPYGKWVVSICSRHCDTTRAMCFCGEGTKYPNRPVPESCGFQINSPTNPDEPKMTDWSKPDLDILTTNSSKQGWCNVDPEDAYAMKVKIKEECDCKYDCLWGRFCEIPVQCTCVNQCSGHGKCRGGFCQCDKGWFGTDCSIPSTLSTVGEWPQWLRPAHLEVPSEKNVPGNLINLSAVVKKKRPLIYIYDLPPDFNSLLIEGRHFKFECVNRIYDERNATVWTDYLYGSQMAFYENILATAHRTMNGEEADFFFVPVLDSCIINRADDAPHINMQNHTGLRSSLTLEFYKRAYEHIVEKYPYWNRSAGRDHIWFFSWDEGACYAPKEIWNSMMLVHWGNTNSKHNHSTTAYFGDNWDDISDERRGDHPCFDPRKDLVIPAWKVPDPYSMRKNYWERPREKRKTLFYFNGNLGPAYEKGRPEDSYSMGIRQKLAEEFGSSPNKEGKLGKQHAEDVIVTPLRSDNYHKDIANSIFCGAFPGDGWSGRMEDSILQGCVPVIIQDGIYLPYENMLNYESFAVRVNEDDIPNLINTLRGFSEAEIQFRLGNVKELWQRFLFRDSILLEAERQKATYGHEEDWAVQFSKLKHDDIFATIIQTLHFKLHNDPWRREQAVNRTKDYGLPQECLHKTS

SEQ ID NO: 14240 - protein, 277 aa, Arabidopsis thaliana
  misc_feature: Useful for biocontainment applications
  misc_feature: Useful for making plants with modulated biomass
MEKSSSMKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 14241 - protein, 91 aa, Glycine max
  misc_feature: Useful for making plants with altered terpenoid content
  misc_feature: Useful for making plants with modulated nitrogen use efficiency
MSSRRSRQQSASTRISDDQIIDLVSKLRQLVPEIRDRRSDKVSASKVLQETCNYIRSLHREVDDLSERLSQLLATIDADSPEAAIIRSLIN

SEQ ID NO: 14242 - protein, 93 aa, Arabidopsis thaliana
  misc_feature: Useful for making plants with altered lignin content
  misc_feature: Useful for making plants with modulated biomass
  misc_feature: Useful for making plants with modulated nitrogen use efficiency
MSGRRSRSRQSSGTSRISEDQINDLIIKLQQLLPELRDSRRSDKVSAARVLQDTCNYIRNLHREVDDLSERLSELLANSDTAQAALIRSLLTQ

SEQ ID NO: 14243 - protein, 94 aa, Arabidopsis thaliana
  misc_feature: Useful for making plants with altered alkaloid content
  misc_feature: Useful for making plants with altered lignin content
  misc_feature: Useful for making plants with modulated biomass
  misc_feature: Useful for making plants with modulated flowering time
  misc_feature: Useful for making plants with modulated nitrogen use efficiency
  misc_feature: Useful for making plants with modulated seedling growth
MSSSRRSRQASSSSRISDDQITDLISKLRQSIPEIRQNRRSNTVSASKVLQETCNYIRNLNKEADDLSDRLTQLLESIDPNSPQAAVIRSLING

SEQ ID NO: 14244 - protein, 86 aa, Zea mays
  misc_feature: Useful for making plants with modulated nitrogen use efficiency
MSSGRRGRISDDEINELISKLQALLPESSRRRNASRSSASKLLKETCAYIKSLHREVDDLSERLSGLMSTMDNDSPQAEIIRSLLR

SEQ ID NO: 14245 - protein, 87 aa, Zea mays
  misc_feature: Useful for making plants with altered terpenoid content
  misc_feature: Useful for making plants with modulated nitrogen use efficiency
MSSGGRRGRISDDEINELISKLQALLPESSRRRNASRSSASKLLKETCAYVKSLHREVDDLSERLSGLMETMDNDSPQAEIIRSLLR

SEQ ID NO: 14246 - protein, 92 aa, Glycine max
  misc_feature: Useful for making plants with altered lignin content
  misc_feature: Useful for making plants with modulated nitrogen use efficiency
MSSRRSRQHSGSTRISDDQIIELVSKLRQLVPEIRNRRSDKVSASKVLQETCNYIRGLHREVSDLSERLSQLLTTIDADSAEAGIIRSLLNQ

SEQ ID NO: 14247 - protein, 294 aa, Arabidopsis thaliana
  misc_feature: Useful for making plants with altered lignin content
MSCNNGMSFFPSNFMIQTSYEDDHPHQSPSLAPLLPSCSLPQDLHGFASFLGKRSPMEGCCDLETGNNMNGEEDYSDDGSQMGEKKRRLNMEQVKTLEKNFELGNKLEPERKMQLARALGLQPRQIAIWFQNRRARWKTKQLEKDYDTLKRQFHTLKAENDLLQTHNQKLQAEIMGLKNREQTESINLNKETEGSCSNRSDNSSDNLRLDISTAPPSNDSTLTGGHPPPPQTVGRHFFPPSPATATTTTTTMQFFQNSSSGQSMVKEENSISNMFCAMDDHSGFWPWLDQQQYN

SEQ ID NO: 14248 - protein, 262 aa, Arabidopsis thaliana
  misc_feature: Useful for making plants with altered cell wall content and/or composition
MTATAFRVGLWLAVTASFLLTATNAKIPGVYSGGPWQNAHATFYGGSDASGTMGGACGYGNLYSQGYGVNTAALSTALFNNGFSCGACFEIKCTDDPRWCVPGNPSILVTATNFCPPNFAQPSDDGGWCNPPREHFDLAMPMFLKIGLYRAGIVPVSYRRVPCRKIGGIRFTVNGFRYFNLVLVTNVAGAGDINGVSVKGSKTDWVRMSRNWGQNWQSNAVLIGQSLSFRVTASDRRSSTSWNVAPATWQFGQTFSGKNFRV

SEQ ID NO: 14249 - protein, 87 aa, Arabidopsis thaliana
  misc_feature: Useful for making plants with altered oil content
MGQIQYSEKYFDDTFEYRHVVLPPEVAKLLPKNRLLSENEWRAIGVQQSRGWVHYAVHRPEPHIMLFRRPLNYQQQQENQAQNMLVK

SEQ ID NO: 14250 - protein, 534 aa, Arabidopsis thaliana
  misc_feature: Useful for biocontainment applications
  misc_feature: Useful for making plants with modulated flowering time
  misc_feature: Useful for making plants with modulated nitrogen use efficiency
  misc_feature (497)..(497): Xaa is any aa, unknown, or other
MATKLDTSSLLLALLSKCSLLTQTNLALSLLVASLASLALSLFFWSHPGGPAWGKYFLHRRRQTTVIPGPRGLPFVGSMSLMSNTLAHRCIAATAEKFRAERLMAFSLGETRVIVTCNPDVAKEILNSPVFADRPVKESAYSLMFNRAIGFAPYGVYWRTLRKIASNHLFSPKQIKRSETQRSVIANQIVKCLTKQSNTKGLCFARDLIKTASLNNMMCSVFGKEYELEEEHEEVSELRELVEEGYDLLGTLNWTDHLPWLSEFDPQRIRSRCSNLVPKVNRFVNRIISDHREQTRDSPSDFVDVLLSLDGPDKLSDPDIIAVLWEMIFRGTDTVAVLIEWILARMVLHPDIQSTVHNELDQIVGRSRAVEESDVVSLVYLTAVVKEVLRLHPPGPLLSWARLAITDTIIDGRRVPAGTTAMVNMWAIAHDPHVWENPLEFKPERFVAKEGEVEFSVLGSDLRLAPFGSGRRVCPGKNLGLTTVTFWTATLLHEFEXLTPSDEKTVDLSEKLRLSCEMANPLAAKLRPRRSFSV

SEQ ID NO: 14251 - protein, 526 aa, Oryza sativa subsp. japonica
  misc_feature: Useful for making plants with modulated phosphate use efficiency
MAGDQMHVLSALDSAKTQWYHFTAIVIAGMGFFTDAYDLFCISLVTKLIGRVYYTADGASKPGSLPPNVSAAVNGVAFVGTLTGQLFFGWLGDRVGRKSVYGMTLLLMIICSVASGLSFGDTPTSVMATLCFFRFWLGFGIGGDYPLSATIMSEYANKRTRGAFIAAVFAMQGFGILAGGAVAIGITAIFRSRFPAPPFAADPAASTPPQADYVWRLILMFGALPAALTFYWRMRMPETARYTAIVAKNAERAAADMSKVLQVKITAEQAEMASPVDKPFTSKPFGLFSGEFARRHGFHLLGTTSTWLLLDIAYYSQNLFQKDIFSAIGWIPEAKTMSALDELYHIARAQTLIALCGTVPGYWFTVALIDVVGRFKIQAAGFFVMTAFMLALAVPYDHWTAAGNQIGFVVLYALTFFFANFGPNATTFIVPAEIYPARLRATCHGISAASGKVGAIVGSFGFLYLAQSPVPAKAAAHGYPPGIGVRNSLFALAGCSLLGFLLTFLVPEPKGKSLEEMSRENEVGQP

SEQ ID NO: 14252 - protein, 547 aa, Panicum virgatum
  misc_feature: Useful for making plants with altered carbohydrate content
MAPPPPVDPRSGYCAATRSFRSKRADVPLPADLDLDVVTFLASRRHAGTVALVDAATGRRVTFADLWRAVAGAATALAAPPLSLRKGQAALILSPNSVHFPVAALAAMSLGAVLTTANPLNTPAEIAKQVADARPVLAFTTRDLLPKLPAAGLRVVLLEPERLPSDPAAVVATIGEISATTPDPARRRERVTQDDPATLLYSSGTTGPSKGVVATHRSLISMVQIIMTRFRLESSDRTEAFLCTVPMFHVYGLVAFATGLLGCGATIVVLSKYELPEMLRAINEYGVTYLPLVPPILVAMVAHPKPLPLGQLRKVLSGGAPLSKEIIEGFRDKYPQVEILQGYGLTESTAIGASTDSAEESRRYGTAGLLSPNTEAKIVDPDTGEALPVNRTGELWIRGPYVMKGYFKNTEATQSTLTPDGWLKTGDLCYIDEDGYLFVVDRLKELIKYKGYQVPPAELEALLLTHPEIADVAVIPFPDREVGQFPMAYVVRKKGSNLSDREVMEFVAKQVAPYKKVRKVAFVTEIPKNASGKILRKDLIKLATSKL

SEQ ID NO: 14253 - protein, 546 aa, Arabidopsis thaliana
  misc_feature: Useful for making plants with altered cell wall content and/or composition
MASVNSRSGFCNSNSTFYSKRTPIPLPPNPSLDVTTFISSQAHRGRIAFIDASTGQNLTFTELWRAVESVADCLSEIGIRKGHVVLLLSPNSILFPVVCLSVMSLGAIITTTNPLNTSNEIAKQIKDSNPVLAFTTSQLLPKISAAAKKLPIVLMDEERVDSVGDVRRLVEMMKKEPSGNRVKERVDQDDTATLLYSSGTTGMSKGVISSHRNLIAMVQTIVNRFGSDDGEQRFICTVPMFHIYGLAAFATGLLAYGSTIIVLSKFEMHEMMSAIGKYQATSLPLVPPILVAMVNGADQIKAKYDLSSMHTVLCGGAPLSKEVTEGFAEKYPTVKILQGYGLTESTGIGASTDTVEESRRYGTAGKLSASMEGRIVDPVTGQILGPKQTGELWLKGPSIMKGYFSNEEATSSTLDSEGWLRTGDLCYIDEDGFIFVVDRLKELIKYKGYQVAPAELEALLLTHPEITDAAVIPFPDKEVGQFPMAYVVRKTGSSLSEKTIMEFVAKQVAPYKRIRKVAFVSSIPKNPSGKILRKDLIKIATSNSKL

SEQ ID NO: 14254 - protein, 1922 aa, Arabidopsis thaliana
  misc_feature: Useful for making plants with altered cell wall content and/or composition
MLDSEVVPSSLVEIAPILRVANEVEASNPRVAYLCRFYAFEKAHRLDPTSSGRGVRQFKTALLQRLERENETTLAGRQKSDAREMQSFYQHYYKKYIQALLNAADKADRAQLTKAYQTAAVLFEVLKAVNQTEDVEVADEILETHNKVEEKTQIYVPYNILPLDPDSQNQAIMRLPEIQAAVAALRNTRGLPWTAGHKKKLDEDILDWLQSMFGFQKDNVLNQREHLILLLANVHIRQFPKPDQQPKLDDRALTIVMKKLFRNYKKWCKYLGRKSSLWLPTIQQEVQQRKLLYMGLYLLIWGEAANLRFMPECLCYIYHHMAFELYGMLAGSVSPMTGEHVKPAYGGEDEAFLQKVVTPIYQTISKEAKRSRGGKSKHSVWRNYDDLNEYFWSIRCFRLGWPMRADADFFCQTAEELRLERSEIKSNSGDRWMGKVNFVEIRSFWHIFRSFDRLWSFYILCLQAMIVIAWNGSGELSAIFQGDVFLKVLSVFITAAILKLAQAVLDIALSWKARHSMSLYVKLRYVMKVGAAAVWVVVMAVTYAYSWKNASGFSQTIKNWFGGHSHNSPSLFIVAILIYLSPNMLSALLFLFPFIRRYLERSDYKIMMLMMWWSQPRLYIGRGMHESALSLFKYTMFWIVLLISKLAFSYYAEIKPLVGPTKDIMRIHISVYSWHEFFPHAKNNLGVVIALWSPVILVYFMDTQIWYAIVSTLVGGLNGAFRRLGEIRTLGMLRSRFQSIPGAFNDCLVPQDNSDDTKKKRFRATFSRKFDQLPSSKDKEAARFAQMWNKIISSFREEDLISDREMELLLVPYWSDPDLDLIRWPPFLLASKIPIALDMAKDSNGKDRELKKRLAVDSYMTCAVRECYASFKNLINYLVVGEREGQVINDIFSKIDEHIEKETLITELNLSALPDLYGQFVRLIEYLLENREEDKDQIVIVLLNMLELVTRDIMEEEVPSLLETAHNGSYVKYDVMTPLHQQRKYFSQLRFPVYSQTEAWKEKIKRLHLLLTVKESAMDVPSNLEARRRLTFFSNSLFMDMPPAPKIRNMLSFSVLTPYFSEDVLFSIFGLEQQNEDGVSILFYLQKIFPDEWTNFLERVKCGNEEELRAREDLEEELRLWASYRGQTLTKTVRGMMYYRKALELQAFLDMAKDEELLKGYKALELTSEEASKSGGSLWAQCQALADMKFTFVVSCQQYSIHKRSGDQRAKDILRLMTTYPSIRVAYIDEVEQTHKESYKGTEEKIYYSALVKAAPQTKPMDSSESVQTLDQLIYRIKLPGPAILGEGKPENQNHAIIFTRGEGLQTIDMNQDNYMEEAFKMRNLLQEFLEKHGGVRCPTILGLREHIFTGSVSSLAWFMSNQENSFVTIGQRVLASPLKVRFHYGHPDIFDRLFHLTRGGICKASKVINLSEDIFAGFNSTLREGNVTHHEYIQVGKGRDVGLNQISMFEAKIANGNGEQTLSRDLYRLGHRFDFFRMLSCYFTTIGFYFSTMLTVLTVYVFLYGRLYLVLSGLEEGLSSQRAFRNNKPLEAALASQSFVQIGFLMALPMMMEIGLERGFHNALIEFVLMQLQLASVFFTFQLGTKTHYYGRTLFHGGAEYRGTGRGFVVFHAKFAENYRFYSRSHFVKGIELMILLLVYQIFGQSYRGVVTYILITVSIWFMVVTWLFAPFLFNPSGFEWQKIVDDWTDWNKWIYNRGGIGVPPEKSWESWWEKELEHLRHSGVRGITLEIFLALRFFIFQYGLVYHLSTFKGKNQSFWVYGASWFVILFILLIVKGLGVGRRRFSTNFQLLFRIIKGLVFLTFVAILITFLALPLITIKDLFICMLAFMPTGWGMLLIAQACKPLIQQLGIWSSVRTLARGYEIVMGLLLFTPVAFLAWFPFVSEFQTRMLFNQAFSRGLQISRILGGQRKDRSSKNKE

SEQ ID NO: 14255 - protein, 446 aa, Arabidopsis thaliana
  misc_feature: Useful for making plants with modulated salt sensitivity
MTKKMRRVGKYEVGRTIGEGTFAKVKFARNTDTGDNVAIKIMAKSTILKNRMVDQIKREISIMKIVRHPNIVRLYEVLASPSKIYIVLEFVTGGELFDRIVHKGRLEESESRKYFQQLVDAVAHCHCKGVYHRDLKPENLLLDTNGNLKVSDFGLSALPQEGVELLRTTCGTPNYVAPEVLSGQGYDGSAADIWSCGVILFVILAGYLPFSETDLPGLYRKINAAEFSCPPWFSAEVKFLIHRILDPNPKTRIQIQGIKKDPWFRLNYVPIRAREEEEVNLDDIRAVFDGIEGSYVAENVERNDEGPLMMNAFEMITLSQGLNLSALFDRRQDFVKRQTRFVSRREPSEIIANIEAVANSMGFKSHTRNFKTRLEGLSSIKAGQLAVVIEIYEVAPSLFMVDVRKAAGETLEYHKFYKKLCSKLENIIWRATEGIPKSEILRTITF

SEQ ID NO: 14256 - protein, 469 aa, Arabidopsis thaliana
  misc_feature: Useful for making plants with modulated biomass
MEESNRSSTVLFDKYNIGRLLGTGNFAKVYHGTEISTGDDVAIKVIKKDHVFKRRGMMEQIEREIAVMRLLRHPNVVELREVMATKKKIFFVMEYVNGGELFEMIDRDGKLPEDLARKYFQQLISAVDFCHSRGVFHRDIKPENLLLDGEGDLKVTDFGLSALMMPEGLGGRRGSSDDLLHTRCGTPAYVAPEVLRNKGYDGAMADIWSCGIVLYALLAGFLPFIDENVMTLYTKIFKAECEFPPWFSLESKELLSRLLVPDPEQRISMSEIKMIPWFRKNFTPSVAFSIDETIPSPPEPPTKKKKKDLNEKEDDGASPRSFNAFQFITSMSSGFDLSNLFEIKRKPKRMFTSKFPAKSVKERLETAAREMDMRVKHVKDCKMKLQRRTEGRKGRLSVTAEVFEVAPEVSVVEFCKTSGDTLEYYLFCEDDVRPALKDIVWSWQGDDDEDDVTTNDNVDTNDNKINNVS

SEQ ID NO: 14257 - protein, 202 aa, Panicum virgatum
  misc_feature: Useful for making plants with altered carbohydrate content
MSNQETSFVTIGQLVLANPLRVRFHYGHSDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMITVWTVYVFLYGRLYLVLSGLDEALATGKRFIHNEPLQVALASQSFVQLGFLMALPMMMEIGLERGF

SEQ ID NO: 14258 - protein, 874 aa, Panicum virgatum
  misc_feature: Useful for making plants with altered carbohydrate content
MAVLAILLLLLLVTFLPYSALAAFSPAFPFFLACGADSSVSFPRDSPARTFIKDDPFLTSSRAQALKNANANSAASPFYAAARASSSAFSYNLPITDDSAGQAAFVVLRLHFVPFAASQSGVSIESASFAVSVRDAYTVLSSFSPPSAGVVKEFFIPAAGSGDFRITFTPDAGSAAFVNAVEVFPAPSELLWNSSVTQVGTAAHADMAQWQQQALETVYRLNVGGPMVTKENGTLWRTWLPDDPFLFGPAGISMVNTTNTPIVYDDAAYTREVAPDIIYKTQRATNASAGRLSLQPPLFNVTWAFPAEPGSSYLVRLHFCDYELVSSVVGEGIMFNVFIGPDMGTPDLMPTKTIATQANRAFYLDYAAAAPIAGGNLTVSIGKSVKSSADEGGFLNGVEIMQLRPSDSSFKTTGSRASSNKRTVLIITLSSVLGASVLACAALCWMALLRRRRHAPRPAPEVEKEASTLPWSPYTQDSSSGWPVEPSSRSGTTGAMQQRVGAQQLHIPLEELKAATDNFHERNLIGVGGFGNVYRGALRDGTRVAVKRATRASKQGLPEFQTEIVVLSRIRHRHLVSLIGYCNEQAEMILVYEYMEMGTLRSHLYGGPEPDSSGEDAPPPLSWKQRLEICIGAARGLHYLHTGYSENIIHRDVKSTNILLGDGFIAKVADFGLSRVGPSLGETHVSTAVKGSFGYLDPEYFKTQQLTDRSDVYSFGVVLLEVLCARPVIDQQAPDRDQINLAEWAVACQRRGQLGKVADPRILGQMNDNSLRKFAETAVRCLADYGQERPSMGDVLWNLEYCLQLQETHVRRDAFEDSGAVGAQFPDDVVVPRWVPSSTSFLTTGDTDETAICVTDVGVANSKVFSQLSSGEGR

SEQ ID NO: 14259 - protein, 456 aa, Panicum virgatum
  misc_feature: Useful for making plants with altered carbohydrate content
MATRRIPRPAAVAVALCAAALLAACAGASRAGCRKHVAKITDYGAVGDGKTLNTAAFAKAVADLSARARRGGAALVVPPGKWLTGPFNLTSHFTLYLDEGAEILASQDMKDWPLIAPLPSYGRGRDEPGPRYSNFIAGSNLTDVIITGKNGTINGQGQVWWDKYHAKELQFTRGYLLELLYSDNIIISNVTFVDSPSWNLHPTYCTNVTISGVTILAPVHSPNTDGIDPDSSSHVKIEDCYIVSGDDCIAVKSGWDQYGIKFNMPSQHIVIRRLTCISPTSAMIALGSEMSGGIRDVRAEDNVAISTESAVRVKSGVGRGGFVKDIFVRRLSLHTMKWVFWMTGNYGQHPDNSSDPNAMPEVTGINYSDVFAENVTMAGRMEGIPNDPYTGICISNVTAQLAPDAKELQWNCTNIKGVTSAVTPKPCPELGAEGKPCAFPEEELIIGPHKLPKCTY

SEQ ID NO: 14260 - protein, 469 aa, Arabidopsis thaliana
  misc_feature: Useful for making plants with altered cell wall content and/or composition
MIRPTFGLLVFLAIFLFPAIESRSHRNSVTSKIEFSALNCRKHSAILTDFGAVGDGKTSNTKAFRNAISKLSQMATDGGAQLVVPPGKWLTGSFNLTSHFTLFIQRGATILASQDESEWPVIAPLPSYGKGRDGTGTGRFNSLISGTNLTDVVITGNNGTINGQGQYWWDKFKKKQFKITRPYLIEILFSKNIQISNITLIDSPSWNIHPVYCNSVIVKSVTVLAPVTVPNTDGINPDSCTNTLIEDCYIVSGDDCIAVKSGWDQYGIKFGMPTQQLSIRRLTCISPKSAGVALGSEMSGGIKDVRIEDVTLTNTESAIRIKTAVGRGAYVKDIYARRITMKTMKYVFWMSGNYGSHPDEGFDPKALPEITNINYRDMTAENVTMSASLDGIDKDPFTGICISNVTIALAAKAKKMQWNCTDVAGVTSRVTPEPCSLLPEKKAQAKNVDCAFPSDLIPIESVVLKKCFL

SEQ ID NO: 14261 - protein, 172 aa, Arabidopsis thaliana
  misc_feature: Useful for making plants with altered alkaloid content
  misc_feature: Useful for making plants with altered terpenoid content
  misc_feature: Useful for making plants with altered tocopherol content
MGRRKIKMEMVQDMNTRQVTFSKRRTGLFKKASELATLCNAELGIVVFSPGGKPFSYGKPNLDSVAERFMREYDDSDSGDEEKSGNYRPKLKRLSERLDLLNQEVEAEKERGEKSQEKLESAGDERFKESIETLTLDELNEYKDRLQTVHGRIEGQVNHLQASSCLMLLSRK

SEQ ID NO: 14262 - protein, 326 aa, Arabidopsis thaliana
  misc_feature: Useful for making plants with altered cell wall content and/or composition
MNCLIAIALSVSFFLVGIVGPIQAQLQMNFYANSCPNAEKIVQDFVSNHVSNAPSLAAALIRMHFHDCFVRGCDGSVLINSTSGNAERDATPNLTVRGFGFIDAIKSVLEAQCPGIVSCADIIALASRDAVVFTGGPNWSVPTGRRDGRISNAAEALANIPPPTSNITNLQTLFANQGLDLKDLVLLSGAHTIGVSHCSSFTNRLYNFTGRGGQDPALDSEYAANLKSRKCPSLNDNKTIVEMDPGSRKTFDLSYYQLVLKRRGLFQSDSALTTNPTTLSNINRILTGSVGSFFSEFAKSMEKMGRINVKTGSAGVVRRQCSVANS

SEQ ID NO: 14263 - protein, 1931 aa, Arabidopsis thaliana
  misc_feature: Useful for making plants with altered cell wall content and/or composition
MSRAESSWERLVNAALRRDRTGGVAGGNQSSIVGYVPSSLSNNRDIDAILRAADEIQDEDPNIARILCEHGYSLAQNLDPNSEGRGVLQFKTGLMSVIKQKLAKREVGTIDRSQDILRLQEFYRLYREKNNVDTLKEEEKQLRESGAFTDELERKTVKRKRVFATLKVLGSVLEQLAKEIPEELKHVIDSDAAMSEDTIAYNIIPLDAPVTTNATTTFPEVQAAVAALKYFPGLPKLPPDFPIPATRTADMLDFLHYIFGFQKDSVSNQREHIVLLLANEQSRLNIPEETEPKLDDAAVRKVFLKSLENYIKWCDYLCIQPAWSNLEAINGDKKLLFLSLYFLIWGEAANIRFLPECLCYIFHHMVREMDEILRQQVARPAESCMPVDSRGSDDGVSFLDHVIAPLYGVVSAEAFNNDNGRAPHSAWRNYDDFNEYFWSLHSFELGWPWRTSSSFFQKPIPRKKLKTGRAKHRGKTSFVEHRTFLHLYHSFHRLWIFLAMMFQALAIIAFNKDDLTSRKTLLQILSLGPTFVVMKFSESVLEVIMMYGAYSTTRRLAVSRIFLRFIWFGLASVFISFLYVKSLKAPNSDSPIVQLYLIVIAIYGGVQFFFSILMRIPTCHNIANKCDRWPVIRFFKWMRQERHYVGRGMYERTSDFINLLPINFNDYYTVVFLLVWEKQQTYLYLLFWLVVLSAKFSFAYFLQIKPLVGPTRMIVKQNNIPYSWHDFVSRKNYNALTVASLWAPVVAIYLLDIHIFYTIFSAFLGFLLGARDRLGEIRSLEAIHKLFEEFPGAFMRALHVPLTNRQGDWHVISSHYCCSYLHVIINSKTVDKKNKVDAAHFAPFWNQIIKSLREEDYITDFEMELLLMPKNSGRLELVQWPLFLLSSKILLAKEIAAESNSQEEILERIERDDYMKYAVEEVYHTLKLVLTETLEAEGRLWVERIYEDIQTSLKERNIHHDFQLNKLSLVITRVTALLGILKENETPEHAKGAIKALQDLYDVMRLDILTFNMRGHYETWNLLTQAWNEGRLFTKLKWPKDPELKALVKRLYSLFTIKDSAAHVPRNLEARRRLQFFTNSLFMDVPPPKSVRKMLSFSVFTPYYSEVVLYSMAELTKRNEDGISILFYLQKIYPDEWKNFLARIGRDENALEGDLDNERDILELRFWASYRGQTLARTVRGMMYYRKALMLQSYLERKAGNDATDAEGFELSPEARAQADLKFTYVVTCQIYGRQKEDQKPEAVDIALLMQRNEALRIAYIDVVDSPKEGKSHTEYYSKLVKADISGKDKEIYSIKLPGDPKLGEGKPENQNHAIVFTRGNAIQTIDMNQDNYFEEALKMRNLLEEFDRDHGIRPPTILGVREHVFTGSVSSLASFMSNQETSFVTLGQRVLAKPLKIRMHYGHPDVFDRVFHITRGGISKASRVINISEDIFAGFNTTLRQGNVTHHEYIQVGKGRDVGLNQIALFEGKVAGGNGEQVLSRDVYRLGQLLDFFRMMSFFFTTVGFYLCTMLTVLTVYIFLYGRAYLALSGVGATIRERAILLDDTALSAALNAQFLFQIGVFTAVPMVLGFILEQGFLQAIVSFITMQFQLCTVFFTFSLGTRTHYFGRTILHGGARYQATGRGFVVKHIKFSENYRLYSRSHFVKAMEVILLLVVYLAYGNDEAGAVSYILLTVSSWFLAVSWLFAPYLFNPAGFEWQKVVEDFKEWTNWLFYRGGIGVKGAESWEAWWEEELSHIRTLSGRIMETILSLRFFIFQYGIVYKLKLQGSDTSFAVYGWSWVAFAMIIVLFKVFTFSQKISVNFQLLLRFIQGLSLLMALAGIIVAVVLTPLSVTDIFACVLAFIPTGWGILSIACAWKPVLKRMGMWKSIRSLARLYDALMGMLIFLPVALCSWFPFVSTFQTRMMFNQAFSRGLEISLILAGDNPNSGL

SEQ ID NO: 14264 - protein, 294 aa, Arabidopsis thaliana [sequence omitted]

SEQ ID NO: 14265 - protein, 313 aa, Arabidopsis thaliana
  misc_feature: Useful for making plants with modulated nitrogen use efficiency
MDEGVIAVSAMDAFEKLEKVGEGTYGKVYRAREKATGKIVALKKTRLHEDEEGVPSTTLREISILRMLARDPHVVRLMDVKQGLSKEGKTVLYLVFEYMDTDVKKFIRSFRSTGKNIPTQTIKSLMYQLCKGMAFCHGHGILHRDLKPHNLLMDPKTMRLKIADLGLARAFTLPMKKYTHEILTLWYRAPEVLLGATHYSTAVDMWSVGCIFAELVTNQAIFQGDSELQQLLHIFKLFGTPNEEMWPGVSTLKNWHEYPQWKPSTLSSAVPNLDEAGVDLLSKMLQYEPAKRISAKMAMEHPYFDDLPEKSSL

SEQ ID NO: 14266 - protein, 414 aa, Arabidopsis thaliana
  misc_feature: Useful for making plants with modulated salt sensitivity
MVSVLFQSSCSCSLSSFRSVKFGARLVSPLYFAGNHVHVTSGSLPIGKGSLLNLKSERPQRFVISAVVDDKSVVAKEEKKDGSEEVVVDNQRMIKVCDKLIEVFMVDKPTPSDWRRLLAFSKEWDSIRPHFYKRCQERADSEDNPEMKHKVHRLARKLKEVDEDIQRHNELLNVIKRTPPAEIGELVARRRKDFTNEFFEHLHTVAESYYDNPDEQNALASLGKLSIAAVQAYDTSTESIDALNAAEMKLQDIINSPSLDAACRKIDSLAEKNQLDSALVLMITKAWSAAKESNMMKEEVKDILYHLYVTARGNLQRLMPKEVRILKYLLSIEDPQEQISALQDAFTPGDELEGTDVDYLYTTPEHLQSLMKTVLEAYHFSREGSLVKEAKDLMHPELIAKIEQLKKLVEKKYM

SEQ ID NO: 14267 - protein, 441 aa, Arabidopsis thaliana
  misc_feature: Useful for making plants with modulated biomass
  misc_feature: Useful for making plants with modulated flowering time
MYGGDEVSAIVVDLGSHTCKAGYAGEDAPKAVFPSVIGAVDGVEAMDVDVDSTKTNSNSEDSKTESEKEKGKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYADMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 14268 - protein, 361 aa, Arabidopsis thaliana
  misc_feature: Useful for making plants with altered cell wall content and/or composition
MKIYVYDLPASYNDDWVTASDRCASHLFAAEVAIHRALLSSDVRTLDPDEADYFFVPVYVSCNFSTSNGFPSLSHARSLLSSAVDFLSDHYPFWNRSQGSDHVFVASHDFGACFHAMEDMAIEEGIPKFMKRSIILQTFGVKYKHPCQEVEHVVIPPYIPPESVQKAIEKAPVNGRRDIWAFFRGKMEVNPKNISGRFYSKGVRTAILKKFGGRRRFYLNRHRFAGYRSEIVRSVFCLCPLGWAPWSPRLVESAVLGCVPVVIADGIQLPFSETVQWPEISLTVAEKDVRNLRKVLEHVAATNLSAIQRNLHEPVFKRALLYNVPMKEGDATWHILESLWRKLDDRSYRRSRVLSQREVDM

SEQ ID NO: 14269 - protein, 204 aa, Panicum virgatum
  misc_feature: Useful for making plants with altered carbohydrate content
MRGDPKPPPRRSPAAPTLAGRLRKHSTSLLLLLLWFALSLYLFISPTPPAAAPLRRSAFLRSKARALSATTAGAPPVRIYVYDLPARFNRDWVAADARCARHLFAAEVAVHEALLAYAGRAARPDDADLFFVPVYVSCNFSTPNGFPSLSHARGLLADAVHLLRTQMPYWNRSAGADHIFVASHDFGACFHPMVSHLFVACCAR

SEQ ID NO: 14270 - protein, 464 aa, Panicum virgatum
  misc_feature: Useful for making plants with altered carbohydrate content
MAPTGRLLAVAALSILCLQGLVRDSGAAFAQTHLPPHRIVHAGENDGGLMPELPPSGLMPMPELSPSGSPKPFVPFLAPAPLAPFFNNSTPKLSGKCTLNFTAVDNLMTTTAVDCFTSFAPFLANVICCPQLQATLTILIGQSSKQTGSLALDPTVANYCLSDVQELLLSQGASDNLHSPYSVHLSNVTEGSCPVSTVDSFESVIDSSKLLEACQKIDPVNECCSQTCQNAINEAAQKISSKDGGLTSYSGSPKIDSCRNVVLRWLSSRLDPPSAKQMLRQISNCNVNGVCPLSFPDTSKVAKECGGTIKNSTTCCKVMLSYVAHLQKQSFITNLQALNCASFLGAKLQKMNVSTNVYSSCQITLKDFSLQVGSQESGCLLPSMPSDASFDHISGISFTCDLNDNIAAPWPSSMQAPSSSCNKSVNIPERPAATSAQNGVNHKNLRLRQLVSLASLLLVLLVQG

SEQ ID NO: 14271 - protein, 480 aa, Panicum virgatum
  misc_feature: Useful for making plants with altered carbohydrate content
MVKICCIGAGYVGGPTMAVIALKCPAIEVVVVDISKPRIEAWNSDQLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKLAANAFLAQRISSVNAISALCEATGANVSEVAYAVGKDSRIGPKFLNASVGFGGSCFQKDILNLVYICECNGLPEVSNYWKQVIKINDYQKSRFVNRVVSSMFNTVAGKKIAVLGFAFKKDTGDTRETPAIDVCKGLLGDKAQISIYDPQVTEDQIQRDLAMNKFDWDHPMHLQPTSPSAVKQVSVVWDAYEATKGAHGLCILTEWDEFKTLDYQKIFDNMQKPAFVFDGRNIVDGEKLREIGFIVYSIGKPLDAWLKDMPAVA

SEQ ID NO: 14272 - protein, 481 aa, Arabidopsis thaliana
  misc_feature: Useful for making plants with altered cell wall content and/or composition
MVKICCIGAGYVGGPTMAVMALKCPEIEVVVVDISEPRINAWNSDRLPIYEPGLEDVVKQCRGKNLFFSTDVEKHVFESDIVFVSVNTPTKTQGLGAGKAADLTYWESAARMIADVSKSSKIVVEKSTVPVRTAEAIEKILTHNSKGIEFQILSNPEFLAEGTAIKDLYNPDRVLIGGRDTAAGQKAIKALRDVYAHWVPVEQIICTNLWSAELSKLAANAFLAQRISSVNAMSALCEATGADVTQVAHAVGTDTRIGPKFLNASVGFGGSCFQKDILNLIYICECNGLPEAANYWKQVVKVNDYQKIRFANRVVSSMFNTVSGKKIAILGFAFKKDTGDTRETPAIDVCNRLVADKAKLSIYDPQVLEEQIRRDLSMARFDWDHPVPLQQIKAEGISEQVNVVSDAYEATKDAHGLCVLTEWDEFKSLDFKKIFDNMQKPAFVFDGRNVVDAVKLREIGFIVYSIGKPLDSWLKDMPAVA

SEQ ID NO: 14273 - protein, 263 aa, Arabidopsis thaliana
  misc_feature: Useful for making plants with altered lignin content
  misc_feature: Useful for making plants with modulated nitrogen use efficiency
MAYSACFLHQSALASSAARSSSSSSSQRHVSLSKPVQIICKAQQSHEDDNSAVSRRLALTLLVGAAAVGSKVSPADAAYGEAANVFGKPKTNTDFLPYNGDGFKVQVPAKWNPSKEIEYPGQVLRFEDNFDATSNLNVMVTPTDKKSITDYGSPEEFLSQVNYLLGKQAYFGETASEGGFDNNAVATANILESSSQEVGGKPYYYLSVLTRTADGDEGGKHQLITATVNGGKLYICKAQAGDKRWFKGARKFVESAATSFSVA

SEQ ID NO: 14274 - protein, 425 aa, Panicum virgatum
  misc_feature: Useful for making plants with altered carbohydrate content
MLPTNRGRPQQRPPPPRSWSFLSEMVDFSDPKRRPRYLTKLVMAALLTAMCVLMLTQPPCHRRASPSVFSTRQPGVTHVLLTGGAGYIGSHAALRLLKDSFRVTIVDNLSRGNIGAIKVLQNLFPEPGRLQFIQADLGDPKAVNRIFAENAFDAVMHFAAVAYVGESTLEPLRYYHNITANTLVVLEAMATHNVKTLIYSSTCATYGEPDKMPITEETPQFPINPYGKAKKMAEDIILDFSKSKKADMAVMILRYFNVIGSDPEGRLGEAPRPELREHGRISGACFDAALGIIPGLKVKGTDYETPDGTCVRDYIDVTDLVDAHVKALNKAERGRVGIYNVGTGKGRSVKEFVEACKKATGVDIKVDYFPRRPGDYAEVYSDPAKINRELNWTAQHTDLHESLRVAWTWQKAHRSGYEPPQAMIL

SEQ ID NO: 14275 - protein, 615 aa, Phaseolus vulgaris
  misc_feature: Useful for making plants with modulated water use efficiency
MPSPASNTWINTTLPSSCSSPFKDLASTSSSPTTLLPFKKRSSSNTNTITCSLQTLHYPKQYQPTSTSTTTTPTPIKPTTTTTTTTPHRETKPLSDTKQPFPQKWNFLQKAAATGLDMVETALVSHESKHPLPKTADPKVQIAGNFAPVPEHAADQALPVVGKIPKCIDGVYVRNGANPLYEPVAGHHFFDGDGMVHAVKFTNGAASYACRFTETQRLAQEKSLGRPVFPKAIGELHGHSGIARLLLFYARSLFQLVDGSHGMGVANAGLVYFNNHLLAMSEDDLPYHVRITSNGDLTTVGRYDFNGQLNSTMIAHPKLDPVNGDLHALSYDVVQKPYLKYFRFSADGVKSPDVEIPLKEPTMMHDFAITENFVVVPDQQVVFKLTEMITGGSPVVYDKNKTSRFGILDKNAKDANAMRWIDAPECFCFHLWNAWEEPETDEIVVIGSCMTPADSIFNECDESLKSVLSEIRLNLRTGKSTRRPIISDAEQVNLEAGMVNRNKLGRKTQFAYLALAEPWPKVSGFAKVDLFSGEVQKYMYGEEKFGGEPLFLPNGEEEGDGYILAFVHDEKEWKSELQIVNAQNLKLEASIKLPSRVPYGFHGTFIHSKDLRKQA

SEQ ID NO: 14276 - protein, 482 aa, Arabidopsis thaliana
  misc_feature: Useful for making plants with modulated heat sensitivity
MDVSKVTTSDGGGDSMETKPSPQPQPAAILSSNAPPPFLSKTYDMVDDHNTDSIVSWSANNNSFIVWKPPEFARDLLPKNFKHNNFSSFVRQLNTYGFRKVDPDRWEFANEGFLRGQKHLLQSITRRKPAHGQGQGHQRSQHSNGQNSSVSACVEVGKFGLEEEVERLKRDKNVLMQELVRLRQQQQSTDNQLQTMVQRLQGMENRQQQLMSFLAKAVQSPHFLSQFLQQQNQQNESNRRISDTSKKRRFKRDGIVRNNDSATPDGQIVKYQPPMHEQAKAMFKQLMKMEPYKTGDDGFLLGNGTSTTEGTEMETSSNQVSGITLKEMPTASEIQSSSPIETTPENVSAASEATENCIPSPDDLTLPDFTHMLPENNSEKPPESFMEPNLGGSSPLLDPDLLIDDSLSFDIDDFPMDSDIDPVDYGLLERLLMSSPVPDNMDSTPVDNETEQEQNGWDKTKHMDNLTQQMGLLSPETLDLSR

SEQ ID NO: 14277 - protein, 219 aa, Arabidopsis thaliana
  misc_feature: Useful for making plants with modulated nitrogen use efficiency
MATSMIPIFVTFMLVAAHMALADTNMLQDFCVADLSNGLKVNGYPCKDPAKVTPEDFYFIGLATAAATANSSMGSAVTGANVEKVPGLNTLGVSISRIDYAPGGLNPPHLHPRASEAIFVLEGRLFVGFLTTTGKLISKHVNKGDVFVFPKALLHFQQNPNKAPASVLAAFDSQLPGTQVVGPSLFGSNPPIPDDLLAKAFGAAAPEIQKIKGKFPPKK

SEQ ID NO: 14278 - protein, 1388 aa, Arabidopsis thaliana
  misc_feature: Useful for making plants with altered cell wall content and/or composition
MSTVNHHCLLNFPHIPPSIPPNHRPKLLSSLSLYRKPERLFALSASLSLSPATIHECSSSSSSSSSSFDKEETEDIESVIDGFFYLLRLSAQYHDVEVTKAVHASFLKLREEKTRLGNALISTYLKLGFPREAILVFVSLSSPTVVSYTALISGFSRLNLEIEALKVFFRMRKAGLVQPNEYTFVAILTACVRVSRFSLGIQIHGLIVKSGFLNSVFVSNSLMSLYDKDSGSSCDDVLKLFDEIPQRDVASWNTVVSSLVKEGKSHKAFDLFYEMNRVEGFGVDSFTLSTLLSSCTDSSVLLRGRELHGRAIRIGLMQELSVNNALIGFYSKFWDMKKVESLYEMMMAQDAVTFTEMITAYMSFGMVDSAVEIFANVTEKNTITYNALMAGFCRNGHGLKALKLFTDMLQRGVELTDFSLTSAVDACGLVSEKKVSEQIHGFCIKFGTAFNPCIQTALLDMCTRCERMADAEEMFDQWPSNLDSSKATTSIIGGYARNGLPDKAVSLFHRTLCEQKLFLDEVSLTLILAVCGTLGFREMGYQIHCYALKAGYFSDISLGNSLISMYAKCCDSDDAIKIFNTMREHDVISWNSLISCYILQRNGDEALALWSRMNEKEIKPDIITLTLVISAFRYTESNKLSSCRDLFLSMKTIYDIEPTTEHYTAFVRVLGHWGLLEEAEDTINSMPVQPEVSVLRALLDSCRIHSNTSVAKRVAKLILSTKPETPSEYILKSNIYSASGFWHRSEMIREEMRERGYRKHPAKSWIIHENKIHSFHARDTSHPQEKDIYRGLEILIMECLKVGYEPNTEYVLQEVDEFMKKSFLFHHSAKLAVTYGILSSNTRGKPVRVMKNVMLCGDCHEFFKYISVVIMGDEDVDGKCKNMSACSSTTSYSTKLFLFMVPLVVISGFVFVNIGPKDSTSLLTSLSTTTSHLPPPFLSTAPAPAPSPLLPEILPSLPASSLSTKVESIQGDYNRTIQLNMINVTATSNNVSSTASLEPKKRRVLSNLEKIEFKLQKARASIKAASMDDPVDDPDYVPLGPMYWNAKVFHRSYLEMEKQFKIYVYKEGEPPLFHDGPCKSIYSMEGSFIYEIETDTRFRTNNPDKAHVFYLPFSVVKMVRYVYERNSRDFSPIRNTVKDYINLVGDKYPYWNRSIGADHFILSCHDWGPEASFSHPHLGHNSIRALCNANTSERFKPRKDVSIPEINLRTGSLTGLVGGPSPSSRPILAFFAGGVHGPVRPVLLQHWENKDNDIRVHKYLPRGTSYSDMMRNSKFCICPSGYEVASPRIVEALYSGCVPVLINSGYVPPFSDVLNWRSFSVIVSVEDIPNLKTILTSISPRQYLRMYRRVLKVRRHFEVNSPAKRFDVFHMILHSIWVRRLNVKIREV

SEQ ID NO: 14279 - protein, 520 aa, Arabidopsis thaliana
  misc_feature: Useful for making plants with modulated flowering time
MKTTKGGKVMNPTDAYRKQIRKREIKRNKKERQKVREVGILKKDPEQIKDQIRKLDMSKAEGALDKARKHKKRQLEDTLKMVVKKRKEYDEKKKEQGEATTSVMFSHLPPQRRLTGEEDLKPEDSVYYHPTLNPTGAPPPGKPPMYNSSIGLAISSDGASSSSAALSSITESEDSVLVNPPPLPPLPDGDNALSASLPLPPLPPLPPTTGLTLPHSPFPPPPPGPPPKEQDFVRPPLPPPPQLPQSSQPPPPGLSGSQGDGRFPESSDFTFDNRMNANITSVPLLPPPGIPSNESESRPAESNASSFQNANLSKMVAPPPPAPLHQQHQSTFAGAAASLTNFQPDVHPPPGMLRFPPPPPPLDMHPPHPGMFVGHLIPRPPYGPPPGPPPMMRPPLPPGPPPSSFQDGQAMIRPYVPNKPSFVKSAAPTVVRRPLAQHTPELTSMVPASVRVRRESATVTKPKPKTSIASSLSFTPRAMASAATVKVEPAKTSAASKPQSIDDSYTAFLEDMKALGALDG

SEQ ID NO: 14280 - protein, 203 aa, Glycine max
  misc_feature: Useful for making plants with modulated flowering time
  misc_feature (51)..(51): Xaa is any aa, unknown, or other
  misc_feature (57)..(57): Xaa is any aa, unknown, or other
  misc_feature (58)..(58): Xaa is any aa, unknown, or other
MDCSSVLHSSNSSFFPFNENDPEEMLLYGMITSYQEKVIIKEEEVNSEENXNKNKKXXNKSSFRGVRSRPWGKFAAEIRDSTRHGVRVWLGTFDSAEAAALAYDQAAFSMRGSAAVLNFPVEKVKESLRDMNCTLSQLDGSSPVVALKRRHSLGRKMAAKKKKVEETHGDVRLENVVVLEDLGAEYLEHLLMMSSHDTTSCSW

SEQ ID NO: 14281 - protein, 491 aa, Panicum virgatum
  misc_feature: Useful for making plants with altered carbohydrate content
MAGSKRDEASPLHVVVFPWLAFGHMIPFLELSEQLAKRGHFVTFVSAPRNLARLRPVVPEVRPRIRLAPLPLPRVEALPDGAESTADVPPEKVELLKVAFDGLAAPFAAFLAGACAGGKSGAGEGHGRKPDWIVHDFAHHWLPPIADEHGVPCAAFFIIPAAYVAFIGPKELNDAHPRSAAADFTVAPPWIPSSLSHVAYRGHEAEWVVGAWGPNASGVSDTARIWETMERCPLLVCRCSREVDGPLCDLLGEIYGKPVLPSGLLAPHDAATRASSAAGDDDHDDDEETAGLMRWLDAQPGRSVLYVAFGSEAPLAPEHVRALALGLELAGVRFLWALRRPLGEARPELPDGFEARARAAGRGVVRVGWVPQVRVLAHAAVGAFLTHAGWSSLMESFLFGHPLVMLPLFADQGLTARLMAARRVGLEVPWNGRAFAAEDVAATVRRVMVGEEGKELARNAGELREVLWDTARQGRYIDELVEHLQQRRRGA

SEQ ID NO: 14282 - protein, 449 aa, Arabidopsis thaliana
  misc_feature: Useful for making plants with altered cell wall content and/or composition
MAKAPPSISLLLLLCAAVFLTIPAVISAIGVNYGTLGNLPPPTQVANFIKTQTSIDSVKIFDVNPDILRAFAGTGISVVVTVPNGDIPALANGRQARRWVSVNILPFHPQTKIKYISVGNEILLTGDNNMINNLLPAMRNLNNALVRAGVRDVKVTTAHSLNIIAYDLTGAPSSGRFRPGWDKGILAPILAYHRRTKSPFMVNPYPYFGFDPKNVNFAIFRTPYKAVRDPFTRHVYTNMFDALMDSTYSAMKALGYGDVNIVVGETGWPSACDAPWCSPANAAWFNLNIIKRAQGQGTPLMPNRRFETYIFGLFNEEGKPGPTAERNWGLFRADFSPVYDVGLLRNGQGGGGRPALPAPSTAGGKWCVARSGATNTQLQDSINWVCGQGVDCKPIQAGGSCFNPSSLRTHASFVMNAYFQSHGRTDGACNFSGTGMIVGNNPSNGACKY

SEQ ID NO: 14283 - protein, 469 aa, Panicum virgatum
  misc_feature: Useful for making plants with altered carbohydrate content
MLPLLLFLLAAAAASGPAAAQGLPPLPIGVNYGANADNLPSPAAVATFLATKTTVNRVKLFDANPAFLDAFAANAPAISIAVSIPNSALPAFADRAAGLDAARGWVRDNLAAHVAAGANVTLLLAGNEILGPTVVPDLVVSLLPAMRRLHQALQLEGLPQVRVTTPHYLGILAPSDGIPSNARFRPGLDAKVLAPMLRFHNDTGSPLMVNAYPYFSYNAQNLNYAVFRPNAGVYDPATKLNYTSMFDAQMDAIYTAMKKLGFGDVQIAVGEAGWPTQAEPGQVGVGPEEARDFNAGMIRVCSGGKGTPLMPGRTFETYIFSLFDENQKPGPIAERNFGIFNPDFTPKYDLGLLRDGSSASASPNPSPNPSPKPSPNPSPSGGGKWCVAKAGADATTLQNNINYACGFVDCKPIQSGGGCFDPNNVQSHASFVMNTYYQANGRHDSDCDFKGTGMVISKDPSYGGCKYVS

SEQ ID NO: 14284 - protein, 182 aa, Panicum virgatum
  misc_feature: Useful for making plants with altered carbohydrate content
MAVPVHLAASSLVLLLLVLLLPPLLASACDRCVHRSRAAYYASSLTLAGGSCGYGAEAASMGAGFLAAAGPALYRAGVGCGACFQVRCKDRKLCAAAGARVVVTDRARTNRADLVLSGPAFAAMARPGMAARLAKLRTVDVEYKRWVKSKSTCVFSFTNRAMRLILSSSARRTKETAAGRLL

SEQ ID NO: 14285 - protein, 438 aa, Panicum virgatum
  misc_feature: Useful for making plants with altered carbohydrate content
MIRPQAGLLLRSLGAGGARPAAASMRSATSLLLGAALATAFFLLYTALCRDIGGSPGTPPPPRWEREAAEKAVDTGATAADREVRRDLNPKQRQHAAEEEGRKEEVTTRGDGGGGHGGGGEDEESGRDSKQEEQPQQIVMPATWTPTTKQQQEQQTQDDDLADLLRRAATADKTVLMTAINEAWAAPGSFLDLFLESFRHGEGTADLPRHLLIVAMDGKAFRRCVAVHAFCYWFRVAGLDFAGEQKYMKGDYLEMMWRRNGLQRRVLELGYSFLFTDVDILWFRSPFPRLPAGAQVVMSSDFFVGDPASPNNYPNGGLLYARSSPAAVAFYEHWQAARARFPGKHEQYVFDMIVKEGAPAAVGAAVRFLDTAVFGGFCQHGKDLGRVATMHANCCVGLENKLFDLKNVLDDWKAYRARVAAGDDARGFSWRVPGRCIH

SEQ ID NO: 14286 - protein, 258 aa, Arabidopsis thaliana
  misc_feature: Useful for making plants with modulated nitrogen use efficiency
MGRVIRAQRKGAGSVFKSHTHHRKGPAKFRSLDFGERNGYLKGVVTEIIHDPGRGAPLARVAFRHPFRFKKQKELFVAAEGMYTGQFLYCGKKATLVVGNVLPLRSIPEGAVICNVEHHVGDRGVFARASGDYAIVIAHNPDNDTSRIKLPSGSKKIVPSGCRAMIGQVAGGGRTEKPMLKAGNAYHKYRVKRNCWPKVRGVAMNPVEHPHGGGNHQHIGHASTVRRDAPPGKKVGLIAARRTGRLRGQAAALASKAD

SEQ ID NO: 14287 - protein, 285 aa, Arabidopsis thaliana
  misc_feature: Useful for making plants with modulated drought sensitivity
MAKDVEGPEGFQTRDYEDPPPTPFFDADELTKWSLYRAVIAEFVATLLFLYITVLTVIGYKIQSDTKVGGVDCGGVGILGIAWAFGGMIFILVYCTAGISGGHINPAVTFGLFLARKVSLIRAVLYMVAQCLGAICGVGFVKAFQSSYYDRYGGGANSLADGYNTGTGLAAEIIGTFVLVYTVFSATDPKRNARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 14288 - protein, 291 aa, Arabidopsis thaliana
  misc_feature: Useful for making plants with modulated cold sensitivity
MAKDLDVNESGPPAARDYKDPPPAPFFDMEELRKWPLYRAVIAEFVATLLFLYVSILTVIGYKAQTDATAGGVDCGGVGILGIAWAFGGMIFVLVYCTAGISGGHINPAVTVGLFLARKVSLVRTVLYIVAQCLGAICGCGFVKAFQSSYYTRYGGGANELADGYNKGTGLGAEIIGTFVLVYTVFSATDPKRNARDSHVPVLAPLPIGFAVFMVHLATIPITGTGINPARSFGAAVIYNNEKAWDDQWIFWVGPMIGAAAAAFYHQFILRAAAIKALGSFGSFGSFRSFA

SEQ ID NO: 14289 - protein, 286 aa, Vicia faba
  misc_feature: Useful for making plants with modulated water use efficiency
MEGKEEDVRVGANKFPERQPIGTSAQSDKDYKEPPPAPFFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPKQYQALGGGANTVAHGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVVVIRAIPFKSRS

SEQ ID NO: 14290 - protein, 501 aa, Panicum virgatum
  misc_feature: Useful for making plants with altered carbohydrate content
MDLVLLEKALLGLFAAAVLALAVAKLTGKRLRLPPGPAGAPVVGNWLQVGDDLNHRNLMDLAKRFGDIFLLRMGVRNLVVVSTPELAKEVLHTQGVEFGSRTRNVVFDIFTGKGQDMVFTVYGDHWRKMRRIMTVPFFTNKVVVQNRAGWEEEARLVVEDVRRDPRAAAEGVVIRKRLQLMMYNDMFRIMFDRRFESEQDSLFNKLKALNAERSRLSQSFEYNYGDFIPVLRPFLRGYLNRCHDLKTRRMKVFEDNFVQERKKVMAQTGEIRCAMDHILEAERKGEINHDNVLYIVENINVAAIETTLWSIEWGIAELVNHPTIQSKLREEITSVLGAGVAVTEPDLERLPYLQAVVKETLRLRMAIPLLVPHMNLNDGKLHGYDIPAESKILVNAWFLANDPKRWVKPEEFRPERFLEEEKAVEAHGNDFRFVPFGVGRRSCPGIILALPIIGITLGRLVQNFQLLPPPGQDKVDTTEKPGQFSNQIAKHATIVCKPLEA

SEQ ID NO: 14291 - protein, 505 aa, Arabidopsis thaliana
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
MDLLLLEKSLIAVFVAVILATVISKLRGKKLKLPPGPIPIPIFGNWLQVGDDLNHRNLVDYAKKFGDLFLLRMGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERSRLAQSFEYNYGDFIPILRPFLRGYLKICQDVKDRRIALFKKYFVDERKQIASSKPTGSEGLKCAIDHILEAEQKGEINEDNVLYIVENINVAAIETTLWSIEWGIAELVNHPEIQSKLRNELDTVLGPGVQVTEPDLHKLPYLQAVVKETLRLRMAIPLLVPHMNLHDAKLAGYDIPAESKILVNAWWLANNPNSWKKPEEFRPERFFEEESHVEANGNDFRYVPFGVGRRSCPGIILALPILGITIGRMVQNFELLPPPGQSKVDTSEKGGQFSLHILNHSIIVMKPRNC

SEQ ID NO: 14292 - protein, 220 aa, Arabidopsis thaliana
  misc_feature: Useful for making plants with altered lignin content
MDLLLLEKSLIAVFVAVILATVISKLRGKKLKLPPGPIPIPIFGNWLQVGDDLNHRNLVDYAKKFGDLFLLRMGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERILRHHQL

SEQ ID NO: 14293 - protein, 585 aa, Arabidopsis thaliana
  misc_feature: Useful for making plants with modulated biomass
  misc_feature: Useful for making plants with modulated light quality response
  misc_feature: Useful for making plants with modulated low light sensitivity
MDVMKLDHDSVLKELERITSKAAEVQDNILRGILERNKDTEYLSKYMNGSKDVLEFKRAVPIIIYKDIYPYIQRIANGEDSSLITGHSITEILCSSGTSAGEPKLMPTIPEDLDRRTFLYNLIIPIVNKYITGLDKGKAMYLNFVKAETSTPCGLPIRAVLTSYYKSKHFQCRPYDPFNDLTSPIQTILCEDSNQSMYCQLLAGLIHRHKVMRLGAVFASAFLRAISYLEKKWSQLCEDIRTGSLNPMITDPGCQMAMSCLLMSPNPELASEIEEICGRSSWKGILCQLWPKAKFIEAVVTGSMAQYIPALEFFSQGKIPLVCPMYASSETYFGVNVEPLSKPSDVVFTLLPNMCYFEFIPLGKNGTLSFDLDDDEQVPCDKVVDLVNVKLGRYYELVVTTFAGLYRYRIGDVLQVAGFYNGAPQFRFICRRNVVLSIDLDKTNEEDLHRSITLAKKKLGSNAFLAEYTSYADTSSVPGHYVLFWEIQGHLEPKLMEECCVAVEEELDYIYRQCRTKERSIGALEIRVVKPGTFEKLMDLIISQGGSFNQYKTPRCVKSNSATFKLLNGHVMASFFSPRDPTWVP

SEQ ID NO: 14294 - protein, 407 aa, Arabidopsis thaliana
  misc_feature: Useful for making plants with altered cell wall content and/or composition
MPIKPVLTTLIALLSIILALYTIQLPSSRSLSSIATTIGALAKYSTFFGHKHHHHHHHHHHHHHYHHHEPIKCCEKWTSRLRHQYKTSLVLTVDLHGCGNFSNVQSAIDVVPDLSSSKTLIIVNSGSYREKVTVNENKTNLVIQGRGYQNTSIEWNDTAKSAGNTADSFSFVVFAANFTAYNISFKNNAPEPDPGEADAQAVALRIEGDQAAFYGCGFYGAQDTLLDDKGRHFFKECFIQGSIDFIFGNGRSLYQDCTINSIAKGNTSGVTGSITAQGRQSEDEQSGFSFVNCKIDGSGEILLGRAWGAYATVVFSNTYMSGIITPEGWNNWGDSTKEKTVTFGEHKCYGPGADYKERVLFGKQLTDSEASSFIDVSFIDGDEWLRHTNIVSEHTSKDIGDDLIGFY

SEQ ID NO: 14295 - protein, 241 aa, Arabidopsis thaliana
  misc_feature: Useful for making plants with altered cell wall content and/or composition
  misc_feature: Useful for making plants with altered lignin content
  misc_feature: Useful for making plants with altered terpenoid content
  misc_feature: Useful for making plants with altered tocopherol content
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKSSPPEEEKAARVKVEEEESNTSETTEAEVEPVVPLTPSSWMGFWDVGAGDGIFSIPPLSPTSPNFSVISVT

SEQ ID NO: 14296 - protein, 196 aa, Brassica napus
  misc_feature: Useful for making plants with altered alkaloid content
  misc_feature (153)..(153): Xaa is any aa, unknown, or other
  misc_feature (158)..(158): Xaa is any aa, unknown, or other
  misc_feature (164)..(164): Xaa is any aa, unknown, or other
  misc_feature (170)..(170): Xaa is any aa, unknown, or other
  misc_feature (177)..(177): Xaa is any aa, unknown, or other
  misc_feature (179)..(179): Xaa is any aa, unknown, or other
  misc_feature (190)..(190): Xaa is any aa, unknown, or other
MLYRSISWKTFWLLMVSWEILTLMLLLSHGLWCIEPVMNQVPKQEPDSPVLDPDSFVREFLQVEAESSSEQNSSPHETDQSVSPRKEAKRLEEEEEPRHYRGVRRRPWGKFAAEIRDPAKKGSRIWLGTFESNVDAARAYDCAAFKLRGRKAXLNFPXDAGKYXAPVNLXRKRKRSXVXEELQRSQSNSXSSSSDL

SEQ ID NO: 14297 - protein, 343 aa, Panicum virgatum
  misc_feature: Useful for making plants with altered carbohydrate content
MPIETPMPALSGHGLTVCVTGAGGFIASWLVKRLLEKGYTVRGTVRNPVDPKNDHLRALEGAADRLTLVRADLLDPDSLLAAFSGCEGVFHTASPVTDDPEKMIEPAIRGTRHVMTVAADTGVKRVVFTSSIGTVYMNPYRDPNEPVDDTCWSDLEYCKKTENWYCYAKTVAEQGAWEVARKRGLDLVVVNPVLVLGPLLQPTVNASTDHVMKYLTGSAKTYVNAAQAYVHVKDVAEAHVRVYEAAHAHGRYICAESTLHRGELCRILAKLFPEYPIPTKCKDEVNPPVAGYKFSNQRLKDLGIEFVPVLQCLYETVKSLQEKGMLPVLPPNDDHHLDQLMTS

SEQ ID NO: 14298 - protein, 197 aa, Glycine max
  misc_feature: Useful for making plants with altered alkaloid content
MASVHSSFLLPYNLLSLTTPSSSSTQILFTARPSATHLRPLLLTTRRRSGRRPFAAVAEQAATATEAAARRLYVGNIPRTVTNDELAKIVQEHGAVEKAEVMYDKYSGRSRRFAFVTMKTVEDATAVIEKLNGTELGGREIKVNVTEKPLSTLDLPLLQAEESEFIDSPHKVYVGNLAKTVTTDTLKNFFSEKGKVS

SEQ ID NO: 14299 - protein, 139 aa, Arabidopsis thaliana
  misc_feature: Useful for making plants with modulated nitrogen use efficiency
MIPQQWTPPCGSKCTNKYSAFTQLPWRVFCKKGCDADSDSWEDCVGDCSEICYKDPVLKDRPWTAVIDRSPGDAKYSEECFHACVAGCGYKFDVEAEIVNKVKPKRPPPPPPKPQPPPPPPRSQKPMQPPTEDVLATSA

SEQ ID NO: 14300 - protein, 402 aa, Panicum virgatum
  misc_feature: Useful for making plants with altered carbohydrate content
MARSRPAVLLSLAVVALAATALAPAPAAATKYNITKLLAPYKQYSRFNEMLSRTRLAYDINRRQTITVLAVDNAAMSALDHYSLQTIRHILSLHVLVDYYGDKKLKKLAHGSTASSSMYQATGAASGMSGYVNITRKDGKVSFTTDDADATAKPTRYIRSIKEYPYDIAVLEVSSIISSADAEAPVPPPAPVDLVELLSKKYCKSFASLLSANADVLRTLNETKDNGLTLFCPVDSAVAAFAATYKNLTAKAKTAILLYHGVPDYFSLQLLKSNNGMVTTLATANENKKDYSYDVQNKGETVTLQTRVVTSSITATVGDMEPLAVYAVNKFLKPKEIFKVVEAPAPAPEPSKKKSKAADGGDDSSDNSGDVTADKGDAAPAAMLARWVAAATTAVAAFALMG

SEQ ID NO: 14301 - protein, 256 aa, Arabidopsis thaliana
  misc_feature: Useful for making plants with modulated nitrogen use efficiency
  misc_feature (245)..(245): Xaa is any aa, unknown, or other
MAVVLRGGITGGFLHHRRDASSVITRRISSVKAAGGGINPTVAVERATWLPGLNPPPYLDGNLAGDYGFDPLGLGEDPESLKWYVQAELVHSRFAMLGVAGILFTDLLRTTGIRNLPVWYEAGAVKFDFASTKTLIVVQFLLMGFAETKRYMDFVSPGSQAKEGSFFFGIEAALEGLEPGYPGGPLLNPLGLAKDVKNAHDWKLKEIKNGRLAMMAMLGFFVQASVTHTGPIDNLVEHLSNPWHXTIIQTLFTSTS

SEQ ID NO: 14302 - protein, 631 aa, Arabidopsis thaliana
  misc_feature: Useful for making plants with modulated flowering time
MPGIPLVSRETSSCSRSTEQMCHEDSRLRISEEEEIAAEESLAAYCKPVELYNIIQRRAIRNPLFLQRCLHYKIEAKHKRRIQMTVFLSGAIDAGVQTQKLFPLYILLARLVSPKPVAEYSAVYRFSRACILTGGLGVDGVSQAQANFLLPDMNRLALEAKSGSLAILFISFAGAQNSQFGIDSGKIHSGNIGGHCLWSKIPLQSLYASWQKSPNMDLGQRVDTVSLVEMQPCFIKLKSMSEEKCVSIQVPSNPLTSSSPQQVQVTISAEEVGSTEKSPYSSFSYNDISSSSLLQIIRLRTGNVVFNYRYYNNKLQKTEVTEDFSCPFCLVKCASFKGLRYHLPSTHDLLNFEFWVTEEFQAVNVSLKTETMISKVNEDDVDPKQQTFFFSSKKFRRRRQKSQVRSSRQGPHLGLGCEVLDKTDDAHSVRSEKSRIPPGKHYERIGGAESGQRVPPGTSPADVQSCGDPDYVQSIAGSTMLQFAKTRKISIERSDLRNRSLLQKRQFFHSHRAQPMALEQVLSDRDSEDEVDDDVADFEDRRMLDDFVDVTKDEKQMMHMWNSFVRKQRVLADGHIPWACEAFSRLHGPIMVRTPHLIWCWRVFMVKLWNHGLLDARTMNNCNTFLEQLQI

SEQ ID NO: 14303 - protein, 77 aa, Arabidopsis thaliana
  misc_feature: Useful for making plants with modulated cold sensitivity
  misc_feature: Useful for making plants with modulated flowering time
MIKVKTLTGKEIEIDIEPTDTIDRIKERVEEKEGIPPVQQRLIYAGKQLADDKTAKDYAIEGGSVLHLVLALRGGLL

SEQ ID NO: 14304 - protein, 280 aa, Arabidopsis thaliana
  misc_feature: Useful for making plants with modulated biomass
MAFGLIGRVVGTKPSRLSTAARLIPARWTSKGSEAQSKASTGGGGASLKTFQIYRWNPDNPGKPELQDYKIDLKDCGPMVLDALIKIKNEMDPSLTFRRSCREGICGSCAMNIDGCNGLACLTKIESGSKETTITPLPHMFVIKDLVVDMTNFYNQYKSIEPWLKRKNPASVPGKEILQSKKDRAKLDGMYECILCACCSTSCPSYWWNPESYLGPAALLHANRWISDSRDEYTKERLEAIDDEFKLYRCHTILNCARACPKGLNPGKQITHIKQLQKSG

SEQ ID NO: 14305 - protein, 500 aa, Arabidopsis thaliana
  misc_feature: Useful for making plants with modulated nitrogen use efficiency
MEGQTLIFTFLFISLSLTFIIGRIKRRPNLPPSPSWALPVIGHLRLLKPPLHRVFLSVSESLGDAPIISLRLGNRLVFVVSSHSLAEECFTKNDVVLANRFNSLASKHISYGCTTVVTASYGDHWRNLRRIGAVEIFSAHRLNSFSSIRRDEIHRLIACLSRNSSLEFTKVEMKSMFSNLTFNNIIRMLAGKCYYGDGAEDDPEAKRVRELIAEGMGCFGAGNTADYLPILTWITGSEKRIKKIASRLDEFLQGLVDERREGKEKRQNTMVDHLLCLQETQPEYYTDNIIKGIMLSLILAGTDTSAVTLEWTLSALLNHPQILSKARDEIDNKVGLNRLVEESDLSHLPYLQNIVSESLRLYPASPLLVPHVASEDCKVGGYHMPRGTMLLTNAWAIHRDPKIWDDPTSFKPERFEKEGEAQKLLGFGLGRRACPGSGLAQRLASLTIGSLIQCFEWERIGEEEVDMTEGGGGVIMPKAIPLVAMCKARPVVGKILNESA

SEQ ID NO: 14306 - protein, 204 aa, Arabidopsis thaliana
  misc_feature: Useful for making plants with altered alkaloid content
  misc_feature: Useful for making plants with altered terpenoid content
RRTTTTTTTTHEEEEEKLMAGGGTEAFPDLGEHCQDPDCKLLDFLPFTCDGCKLVFCLEHRSYKSHNCPKSDHGSRTVSICETCSIAIETTGFDERGIKSLLEKHERSGDCDPNKKKKPTCPVKRCKEILTFANNLTCKDCGVKFCLKHRFPTDHVCNKKTINTAGTRSRWNERFMEALSLRNQKGCGRGSSVSSKSPASVRSF

SEQ ID NO: 14307 - protein, 356 aa, Arabidopsis thaliana
  misc_feature: Useful for making plants with altered cell wall content and/or composition
PETEHPNKVFGWGARDKSGVLSPFHFSRRDNGENDVTVKILFCGVCHTDLHTIKNDWGYSYYPVVPGHEIVGIATKVGKNVTKFKEGDRVGVGVISGSCQSCESCDQDLENYCPQMSFTYNAIGSDGTKNYGGYSENIVVDQRFVLRFPENLPSDSGAPLLCAGITVYSPMKYYGMTEAGKHLGVAGLGGLGHVAVKIGKAFGLKVTVISSSSTKAEEAINHLGADSFLVTTDPQKMKAAIGTMDYIIDTISAVHALYPLLGLLKVNGKLIALGLPEKPLELPMFPLVLGRKMVGGSDVGGMKETQEMLDFCAKHNITADIELIKMDEINTAMERLAKSDVRYRFVIDVANSLSPP

SEQ ID NO: 14308 - protein, 357 aa, Arabidopsis thaliana
  misc_feature: Useful for making plants with altered cell wall content and/or composition
MGKVLEKEAFGLAAKDESGILSPFSFSRRATGEKDVRFKVLFCGICHTDLSMAKNEWGLTTYPLVPGHEIVGVVTEVGAKVKKFNAGDKVGVGYMAGSCRSCDSCNDGDENYCPKMILTSGAKNFDDTMTHGGYSDHMVCAEDFIIRIPDNLPLDGAAPLLCAGVTVYSPMKYHGLDKPGMHIGVVGLGGLGHVAVKFAKAMGTKVTVISTSERKRDEAVTRLGADAFLVSRDPKQMKDAMGTMDGIIDTVSATHPLLPLLGLLKNKGKLVMVGAPAEPLELPVFPLIFGRKMVVGSMVGGIKETQEMVDLAGKHNITADIELISADYVNTAMERLAKADVKYRFVIDVANTMKPTP

SEQ ID NO: 14309 - protein, 120 aa, Arabidopsis thaliana
  misc_feature: Useful for making plants with modulated nitrogen use efficiency
MVQRLVYRSRHSYATKSNQHRIVKTPGGKLVYQTTKKKASGPKCPVTGKRIQGIPHLRPSEYKRSRLSRNRRTVNRAYGGVLSGSAVRERIIRAFLVEEQKIVKKVLKLQKAKEKVAPKA

SEQ ID NO: 14310 - protein, 439 aa, Panicum virgatum
  misc_feature: Useful for making plants with altered carbohydrate content
MLKQAEVVVVDTALVPPSKETPGQPLWLSNLDLAVPRTHTPLVYYYPAPAQGAAAAGTGSFAPDRLTAALAGALVPFYPLAGRLGPGPDGRPQINCTGEGALFVVARADLTGDDIFEDFEPSPEIRRAFVPSPRPGDASCPLAVFQLTFLKCGGVVLGTGIHHAVLDGVGAFQFIQTWAGLARGLDAAEACGPVPFHDRTLLRARCPPCPTFDHFVYSPAFLSGRPRPFVTRFYAVSPKLLADLKSRCGAGVSTYCAVTAHLWRCVCVVHGMAPGADTRLGLPANIRHRLSPPLPRSFFGNAVVRDLVTARVGDLLGSPLGSVAETIKKAVDGVGDAFVRSVLDYLELEQAKKRGGDDDSAQGEQMVPATDLWAVSWLGMPMYSADFGSGAPRFVAPAQMFGVGTAYMTPCANKDDGITVIFSMEAEHIECFEKVFYGE

SEQ ID NO: 14311 - protein, 332 aa, Arabidopsis thaliana
  misc_feature: Useful for making plants with altered oil content
MDKTATLLSTLLFLFTFLTTCLSKDLCNQNDKNTLLKIKKSLNNPYHLASWDPQTDCCSWYCLECGDATVNHRVTALTIFSGQISGQIPAEVGDLPYLETLVFRKLSNLTGTIQPTIAKLKNLRMLRLSWTNLTGPIPDFISQLKNLEFLELSFNDLSGSIPSSLSTLPKILALELSRNKLTGSIPESFGSFPGTVPDLRLSHNQLSGPIPKSLGNIDFNRIDLSRNKLQGDASMLFGSNKTTWSIDLSRNMFQFDISKVDIPKTLGILDLNHNGITGNIPVQWTEAPLQFFNVSYNKLCGHIPTGGKLQTFDSYSYFHNKCLCGAPLEICK

SEQ ID NO: 14312 - protein, 614 aa, Arabidopsis thaliana
  misc_feature: Useful for making plants with altered cell wall content and/or composition
MAFQDFDKIQERVNANRKRKFRKRIIVGTVSLLVVVAAIVGGAFAYVAYEKRNEQQQQQQQAKNHNKSGSGNNVVKDSDKKSPSPPTPSQKAPVSAAQSVKPGQGDKIIQTLCSSTLYMQICEKTLKNRTDKGFALDNPTTFLKSAIEAVNEDLDLVLEKVLSLKTENQDDKDAIEQCKLLVEDAKEETVASLNKINVTEVNSFEKVVPDLESWLSAVMSYQETCLDGFEEGNLKSEVKTSVNSSQVLTSNSLALIKTFTENLSPVMKVVERHLLDDIPSWVSNDDRRMLRAVDVKALKPNATVAKDGSGDFTTINDALRAMPEKYEGRYIIYVKQGIYDEYVTVDKKKANLTMVGDGSQKTIVTGNKSHAKKIRTFLTATFVAQGEGFMAQSMGFRNTAGPEGHQAVAIRVQSDRSIFLNCRFEGYQDTLYAYTHRQYYRSCVIVGTIDFIFGDAAAIFQNCNIFIRKGLPGQKNTVTAQGRVDKFQTTGFVVHNCKIAANEDLKPVKEEYKSYLGRPWKNYSRTIIMESKIENVIDPVGWLRWQETDFAIDTLYYAEYNNKGSSGDTTSRVKWPGFKVINKEEALNYTVGPFLQGDWISASGSPVKLGLYDA

SEQ ID NO: 14313 - protein, 323 aa, Arabidopsis thaliana
  misc_feature: Useful for making plants with modulated nitrogen use efficiency
  misc_feature (309)..(309): Xaa is any aa, unknown, or other
  misc_feature (312)..(312): Xaa is any aa, unknown, or other
  misc_feature (316)..(316): Xaa is any aa, unknown, or other
  misc_feature (320)..(320): Xaa is any aa, unknown, or other
  misc_feature (322)..(322): Xaa is any aa, unknown, or other
  misc_feature (323)..(323): Xaa is any aa, unknown, or other
MGEHSPSQPSSHTLPPNQPESPNHETPNPIPPETNDDDSASSAGVSGSIVSSTTIEAPQVTELGNVSSPPSKIPLRPRKIRKLSPDDDASDGFNPEHNLSQMTTTKPATKSKLSQSRTVTVPRIQARSLTCEGELEAALHHLRSVDPLLASLIDIHPPPTFETFQTPFLALIRSILYQQLAAKAGNSIYTRFVALCGGENGVVPENVLPLTPQQLRQIGVSGRKASYLHDLARKYQNGILSDSGIVNMDEKSLFTMLTMVNGIGSWSVHMFMINSLHRPDVLPVNDLGVRKGVQMLNGMEDLPRPSKMXQLXEKWXPYRXVXX

SEQ ID NO: 14314 - protein, 202 aa, Arabidopsis thaliana
  misc_feature: Useful for making plants with modulated nitrogen use efficiency
MAMNGLSKMAVAAATALLLVLTIVPGAVAVTYTIEWTTGVDYSGWATGKTFRVGDILEFKYGSSHTVDVVDKAGYDGCDASSSTENHSDGDTKIDLKTVGINYFICSTPGHCSLNGGMKLAVNVVAGSAGPPATPTPPSSTPGTPTTPESPPSGGSPTPTTPTPGAGSTSPPPPPKASGASKGVMSYVLVGVSMVLGYGLWM

SEQ ID NO: 14315 - protein, 330 aa, Arabidopsis thaliana
  misc_feature: Useful for making plants with altered cell wall content and/or composition
MAKKMSSLIIIFNILLLLTTQTHAHNVTRLLANHPSFSSFSHFLTQTHLADEINRRRTITVCAVDNAAMSALTSKGYTLSTLKNILSLHVLLDYFGTKKLHQIRDGSALAATLFQATGAAPGTSGFVNITDLRGGKVGFGPDGGDLSSFFVKSIEEVPYNISIIQISRVLPSETAAAPTPAPAEMNLTGIMSAHGCKVFAETLLTNPGASKTYQESLEGGMTVFCPGDDAMKGFLPKYKNLTAPKKEAFLDFLAVPTYYSMAMLKSNNGPMNTLATDGANKFELTVQNDGEKVTLKTRINTVKIVDTLIDEQPLAIYATDKVLLPKELFK

SEQ ID NO: 14316 - protein, 160 aa, Arabidopsis thaliana
  misc_feature: Useful for making plants with modulated nitrogen use efficiency
MATSASALLSPTTFSTAISHKNPNSISFHGLRPLRLGGSSSALPKLSTTGRKSSSTVVRAELSPSIVISLSTGLSLFLGRFVFFNFQRENVAKQGLPEQNGKTHFEAGDDRAKEYVSLLKSNDPIGFNIVDVLAWGSIGHIVAYYILATSSNGYDPSFFG

SEQ ID NO: 14317 - protein, 160 aa, Arabidopsis thaliana
  misc_feature: Useful for biocontainment applications
MATSASALLSPTTFSTAISHKNPNSISFHGLRPLRLGGSSSALPKLSTTGRKSSSAVVRAELSPSIVISLSTGLSLFLGRFVFFNFQRENVAKQGLPEQNGKTHFEAGDDRAKEYVSLLKSNDPIGFNIVDVLAWGSIGHIVAYYILATSSNGYDPSFFG

SEQ ID NO: 14318 - protein, 168 aa, Arabidopsis thaliana
  misc_feature: Useful for making plants with altered cell wall content and/or composition
MELLSRALFFFLLLSVLSSFSSSSFISDGVFESQSLVLGRNLLQTKKTCPVNFEFMNYTIITSKCKGPKYPPKECCGAFKDFACPYTDQLNDLSSDCATTMFSYINLYGKYPPGLFANQCKEGKEGLECPAGSQLPPETSAEVNAATTSSSRLWLTVSAALLVFVKLF

SEQ ID NO: 14319 - protein, 166 aa, Panicum virgatum
  misc_feature: Useful for making plants with altered carbohydrate content
MAADRGLLLLLLSAAALAGVASAAGPFLSDGVFQASAGSTGRSLLQAKKNCAMNFEFQNYTIITSKCKGPKFPADQCCGAFKEFACPFRDYINDDSSDCSSAMFSYINLYGKYPPGLFANICREGKKGLECTDAQSAVTANGSQRTRSSSLVLVTLVCGLIALLFY

SEQ ID NO: 14320 - protein, 263 aa, Panicum virgatum
  misc_feature: Useful for making plants with altered carbohydrate content
MVSKAAIFATAVLAVHLAAPASAQTSSPPAPAPMSLAPTPAPAPAPHYVDLAELLSVAGPFHTFLNYLEKTNVIETLQSQANNTKVGITIFVPKDSAFAALKKSTFSNLTSDQLKTLLLYHAFPKFYSLAEFKNLSSLNPVNTFAGSPYTLNLTDDMGSIYVQSMWSRPKIASSVYATKPVAIYALNKVLLPMQLFSKDPPLAPAPAPAPESGASDAPSPADGKADGLTGGKGDSTSGAYNVGAVSVANSLLLAAAGCLMLLW

SEQ ID NO: 14321 - protein, 254 aa, Arabidopsis thaliana
  misc_feature: Useful for making plants with altered cell wall content and/or composition
  misc_feature: Useful for making plants with altered lignin content
MAKMQLSIFIAVVALIVCSASAKTASPPAPVLPPTPAPAPAPENVNLTELLSVAGPFHTFLDYLLSTGVIETFQNQANNTEEGITIFVPKDDAFKAQKNPPLSNLTKDQLKQLVLFHALPHYYSLSEFKNLSQSGPVSTFAGGQYSLKFTDVSGTVRIDSLWTRTKVSSSVFSTDPVAVYQLNRVLLPEAIFGTDVPPMPAPAPAPIVSAPSDSPSVADSEGASSPKSSHKNSGQKLLLAPISMVISGLVALFL

SEQ ID NO: 14322 - protein, 123 aa, Arabidopsis thaliana
  misc_feature: Useful for making plants with altered cell wall content and/or composition
MSKSIVFFSTVLVFLFSFSYATPGIATFYTSYTPCYRGTQEGVMIAAASDTLWDNGRVCGKMFTVKCSGPRNAVPHPCTGKSVKVKIVDHCPSGCASTLDLSREAFAQIANPVAGIINIDYFP

SEQ ID NO: 14323 - protein, 325 aa, Arabidopsis thaliana
  misc_feature: Useful for making plants with altered cell wall content and/or composition
MMGSILLLLLFFSLVQSRSDTSYSKIQLPGDSLTLSVTDFGATGDGINYDTSAIQSTIDACNRHYTSFSSICRVVFPSGNYLTAKLHLRSGVILDVTENAVLLGGPRIEDYYPAETSSDWYVVVANNATDVGITGGGAIDGQGSKFVVRFDEKKNVMVSWNQTGACLGDECRPRLVGFVDSINVEIWNITLREPAYWCLHIVRCENTSVHDVSILGDFNTPNNDGIDIEDSNNTVITRCHIDTGDDAICPKTYTGPLYNLTATDCWIRTKSSAIKLGSASWFDFKGLVFDNITIFESHRGLGMQIRDGGKQVSSFLWLHTTQKLM

SEQ ID NO: 14324 - protein, 498 aa, Panicum virgatum
  misc_feature: Useful for making plants with altered carbohydrate content
MARRVLSALLLAALACDVASAEFGRHSFPEGFVFGTGSAAYQYEGAYKEGGKGPSVWDIFSHLPGKIKNNDTGDVADDFYHRYKEDVKLLKDMNMDAFRFSIAWTRILPTGSLSGGINKEGVAFYNNLINEVIANGLKPFVTIFHWDTPQALESKYKGFLSENIIQDYVDFAEVCFREFGDRVKFWTTFNEPWTYASQGYGNGAHAPGRCSPSISPSCTPGDSGHEPYLVTHHILLAHARAVALYRARYQPAQRGQIGITVVSHWFVPNTDTPADRRAVQRSLDFMLGWFLSPIVHGAYPGTMTSFLGGRLPRFTPEQAEMVRGSYDFIGLNYYTSYFTSARPAPNGLAQSYEGDIRANTSGFRDGVPVGQPEFVPIFFNSPAGLRELLLYTKRRYNNPVIYVTENGIAEENSARIPLREALKDGHRIEFHSRHLQFVNHAIRNGVKVKGYFTWTFMDCFEWGDGYLDRFGLIFIDRLNGLKRYRKQSSYWIEKFLKR

SEQ ID NO: 14325 - protein, 507 aa, Arabidopsis thaliana
  misc_feature: Useful for making plants with altered cell wall content and/or composition
MRTIYLSLLVFIIVLALNEVMAKKHSSTPKLRRSDFPEDFIFGAATSAYQVEGAAHEDGRGPSIWDTFSEKYPEKIKDGSNGSIASDSYHLYKEDVGLLHQIGFDAYRFSISWSRILPRENLKGGINQAGIDYYNNLINELLSKGIKPFATIFHWDTPQSLEDAYGGFLGAEIVNDFRDYADICFKNFGDRVKHWMTLNEPLTVVQQGYVAGVMAPGRCSKFTNPNCTAGNGATEPYIVGHNLILAHGEAVKVYREKYKASQKGQVGIALNAGWNLPYSESAEDRLAAARAMAFTFDYFMEPLVTGKYPIDMVNYVKGGRLPTFTAKQSKMLKGSYDFIGRNYYSSSYAKDVPCSSENVTLFSDPCASVTGEREGVPIGPKAASDWLLIYPKGIRDLLLYAKYKFKDPVMYITENGRDEASTGKIDLKDSERIDYYAQHLKMVQDAISIGANVKGFFAWSLLDNFEWATGYAVRFGLVYVDFNGGRKRYPKKSAKWFKKLLNEKKKN

SEQ ID NO: 14326 - protein, 345 aa, Arabidopsis thaliana
  misc_feature: Useful for making plants with modulated biomass
  misc_feature: Useful for making plants with modulated flowering time
MVRFEKVHLVLGLALVLTLVGAPTKAQGPVCGAGLPDKFSRLNFPEGFIWGTATAAFQVEGAVNEGCRGPSMWDTFTKKFPHRCENHNADVAVDFYHRYKEDIQLMKDLNTDAFRLSIAWPRIFPHGRMSKGISKVGVQFYHDLIDELLKNNIIPLVTVFHWDTPQDLEDEYGGFLSGRIVQDFTEYANFTFHEYGHKVKHWITFNEPWVFSRAGYDNGKKAPGRCSPYIPGYGQHCQDGRSGYEAYQVSHNLLLSHAYAVDAFRKCKQCAGGKIGIAHSPAWFEPQDLEHVGGSIERVLDFILGWHLAPTTYGDYPQSMKDRVGHRLPKFTEAEKKLLKGSTDY

SEQ ID NO: 14327 - protein, 321 aa, Arabidopsis thaliana
  misc_feature: Useful for making plants with modulated water use efficiency
MVTIRSGSIVILVLLAVSFLALVANGEDKTIKVKKVRGNKVCTQGWECSWWSKYCCNQTISDYFQVYQFEQLFSKRNTPIAHAVGFWDYQSFITAAALFEPLGFGTTGGKLMGQKEMAAFLGHVASKTSCGYGVATGGPLAWGLCYNREMSPMQSYCDESWKFKYPCSPGAEYYGRGALPIYWNFNYGAAGEALKADLLNHPEYIEQNATLAFQAAIWRWMTPIKRAQPSAHDIFVGNWKPTKNDTLSKRGPTFGSTMNVLYGEYTCGQGSIDPMNNIISHYLYFLDLMGIGREDAGPNDELSCAEQKPFNPSTVPSSSSS

SEQ ID NO: 14328 - protein, 321 aa, Arabidopsis thaliana; identical to SEQ ID NO: 14327
  misc_feature: Useful for making plants with altered cell wall content and/or composition

SEQ ID NO: 14329 - protein, 560 aa, Panicum virgatum
  misc_feature: Useful for making plants with altered carbohydrate content
MAASAASPRTAAPPPRRLLALSLLLPLLVLPAATNAHPVTTTPAPAAKAKAREAGVSAGLVSTLRETLDAIRSVAGIISAFPVGGILGGGDIRLSSAVADCLDLLDLSSDELSWSMSATSAATTGAGGGAGGRLGTGDASSDLRSWLSGALGNQDTCKEGLDATGSVLGSLVATGLQAVTSLLADGLGQVAAAGEDAAALYPPSSRRGLLGGARPPRWLRARERRLLQMPVGPGGLPVDAVVAQDGSGNFTTVSAAVEAAPEESAARFVIYVKKGVYREAVEVRKKKWNLMLVGDGMGVTVISGDRNYVDGYTTYRSATVAVNGRGFIARDLTFENTAGPAKHQAVALRCDSDLSVFYRCTFEGYQDTLYAHSLRHFYRDCRVTGTVDFVFGNAAAVFQGCLLLARLPLPAQKNSVTAQGRLDANMTTGFAFQFCNVSAHDELLAASSGAGNRTAAAAQTYLGRPWKEYSRVVFMQSYIGAAVRPEGWLAWDGEFALYTLYYGEYMNTGPGAGVGARVRWPGFHVLTSPAEAGNFTVAQFIGGNMWLPPTGVKYTAGLTS

SEQ ID NO: 14330 - protein, 404 aa, Arabidopsis thaliana
  misc_feature: Useful for making plants with altered cell wall content and/or composition
MEGFDGTSGLVKSLVAGSLDQLYSMLRELLPLVQPEQKPKAVSKPGPIAKGPKAPPGRKLRDTDEDESLQFPDWVRPDDRKLLESNGRTYDVSVALDGTGNFTKIMDAIKKAPDYSSTRFVIYIKKGLYLENVEIKKKKWNIVMLGDGIDVTVISGNRSFIDGWTTFRSATFAVSGRGFLARDITFQNTAGPEKHQAVALRSDSDLSVFFRCAMRGYQDTLYTHTMRQFYRECTITGTVDFIFGDGTVVFQNCQILAKRGLPNQKNTITAQGRKDVNQPSGFSIQFSNISADADLVPYLNTTRTYLGRPWKLYSRTVFIRNNMSDVVRPEGWLEWNADFALDTLFYGEFMNYGPGSGLSSRVKWPGYHVFNNSDQANNFTVSQFIKGNLWLPSTGVTFSDGLYI

SEQ ID NO: 14331 - protein, 257 aa, Zea mays
  misc_feature: Useful for making plants with altered terpenoid content
MEWRDSFLDLALIPLSLLLPMAYHAWLWREVRLRPLRTAVGINAATRRLWAIGMMKDNAKNAVTVVQSVRNVIMGSTLMATTAILFCTGVAAVLSSTYTIKKPLSDTVFGAHGEYMMALKYVALMLLFLLAFLCHSLAICFLNQASFLINTSACLFSSSADSDAAVLGLPLPPTRDYIGDVLERGFTLNLVGNRLFYAGVPLLLWIFGPLLAFLSSMVMVPILYSLDVVNLMGHSGCVVVSGKSAEMNGGSECARAV

SEQ ID NO: 14332 - protein, 460 aa, Arabidopsis thaliana
  misc_feature: Useful for making plants with altered cell wall content and/or composition
MSLLLHLFALSLLISVSGAKFSGRPGINYGQLGNNLPSPSDSVNLIKSLNAKRVKLYDANPKILAALNGTDITVSVMVPNELLVNISKSASLSDDWIRSNILPFYPTTKIRYLLVGNEILSLPDSELKSSLVPAMRKIQRSLKSLGVKKVKVGTTLATDVLQSSFPPSSGEFREDISGLIMKPMLQFLNRTKSFLFVDVYPYFAWAQDPTHVDLDYAIFESTNVTVTDPVSNLTYHNLFDQMIDAFVFAMKRVGYPDIRIWVAETGWPNNGDYDQIGANIYNAATYNRNVVKKLAADPPVGTPARPGKVLPAFVFALYNENQKTGPGTERHFGLLHPNGTQVYGIDLSGKTEYKESLPAPENNDLYKGKIWCVVAKGANWTQLGDALSYACSQGNNTCDPIQRGGPCQKPDLTVLHASYAFSSYWAQFRKIGGTCSFNGLATQTIKDPSYGRCEFPSVTL

SEQ ID NO: 14333 - protein, 489 aa, Panicum virgatum
  misc_feature: Useful for making plants with altered carbohydrate content
MPPSGITAVDAAAKGMKLERYASGGALLLRRATSAKLVSASSHLLFRATVLATLALVFLFTLHYPSLLSRSFHLSAGGDAAHPSSASHRSLLMSSSSSSSSAAASYGDAAWEKEMRRSARPSRDGGISVLVTGAAGFVGTHCSLALKARGDGVVGLDNFNSYYDPSLKRARQALLASRGVVVLDADINDGLLLEKLFDVAAFTHVLHLAAQAGVRYAMEAPQTYVASNVAGLVSVFEVAAKHADPQPAIVWASSSSVYGLNTDAPFSEDHRTDRPASLYAATKKAGEAIAHTYNHIYGLSITGLRFFTVYGPWGRPDMAYFFFARSIVAGEPITLFRAADGSDARRDFTYIDDVVKGCLGALDTAGKSTGSKSGKKSGPAPLRVYNLGNTSPVPVTRMVAILEKLLGKKANKRIVTMPSNDDVPFTHANVSHAAHDFGYRPTTSLEAGLRHFVDWFVEYYKLDTKIAKSARSSAAAKPAKKKKAAAASS

SEQ ID NO: 14334 - protein, 460 aa, Arabidopsis thaliana
  misc_feature: Useful for making plants with altered cell wall content and/or composition
MPLSATADTSKTVKLERYNSYLRKIHSTKVLNASSKVLFRATLLVALVLVLIFAINYPPLSDSRAAAAHHLHRRSFLSTGLFSSSSSSSSIGGAAWEKRVRQSSTAKRPHGLSVLVTGAAGFVGSHCSLALRKRGDGVLGFDNFNDYYDPSLKRARQELLEKQQVFIVEGDLNDGPLLRKLFDVVPFTHILHLAAQAGVRYAMKNPQSYIASNIAGFVNLLEVAKAANPQPAIVWASSSSVYGLNTENPFSEEHRTDQPASLYAATKKAGEEIAHTYNHIYGLSLTGLRFFTVYGPWGRPDMAYFFFTKDILHGKSIDIYRTQDNQEVARDFTYIDDIVKGCVGALDTAEKSTGSGGKKRGQAQLRVYNLGNTSPVPVGRLVSILEGLLGTKAKKHLIKMPRNGDVPYTHANVSLAYKDFGYKPTTDLAAGLRKFVKWYVGYYGIQPRVKKETSHAEDSA

SEQ ID NO: 14335 - protein, 330 aa, Arabidopsis thaliana
  misc_feature: Useful for making plants with altered cell wall content and/or composition
MDIRSDDAKKPMMMWFLGMLLFSMVAESNAQLSENYYASTCPSVELIVKQAVTTKFKQTVTTAPATLRMFFHDCFVEGCDASVFIASENEDAEKDADDNKSLAGDGFDTVIKAKTAVESQCPGVVSCADILALAARDVVVLVGGPEFKVELGRRDGLVSKASRVTGKLPEPGLDVRGLVQIFASNGLSLTDMIALSGAHTIGSSHCNRFANRLHNFSTFMPVDPTMDPVYAQQLIQACSDPNPDAVVDIDLTSRDTFDNSYYQNLVARKGLFTSDQALFNDLSSQATVVRFANNAEEFYSAFSSAMRNLGRVGVKVGNQGEIRRDCSAFN

SEQ ID NO: 14336 - protein, 283 aa, Arabidopsis thaliana
  misc_feature: Useful for making plants with altered cell wall content and/or composition
MEQFFALFTIFLSFAFPGRCSDVFSRSDFPEGFLFGAGTSAYQWEGAAAEDGRKPSVWDTLCYSRNIGNGDVTCDGYHKYKEDVKLMVDTNLDAFRFSISWSRLIPNGRGSVNQKGLQFYKNLISELITHGIEPHVTLYHYDHPQYLEDEYGGWVNNMMIKDFTAYVDVCFREFGNYVKFWTTINEANVFTIGGYNDGDTPPGRCSLPGKNCLLGNSSTETYIVGHNLLLAHASASRLYKQKYKDKQGGSIGFGLYLMGLTPSTSSKDDAIATQRAKDFYFGW

SEQ ID NO: 14337 - protein, 470 aa, Arabidopsis thaliana
  misc_feature: Useful for making plants with altered cell wall content and/or composition
MKLLSNSLMFLPLLALALTAVSSLKYSRNDFPPGFVFGSGTSAYQVEGAADEDGRTPSIWDVFAHAGHSGVAAGNVACDQYHKYKEDVKLMADMGLEAYRFSISWSRLLPSGRGPINPKGLQYYNNLIDELITHGIQPHVTLHHFDLPQALEDEYGGWLSQEIVRDFTAYADTCFKEFGDRVSHWTTINEVNVFALGGYDQGITPPARCSPPFGLNCTKGNSSIEPYIAVHNMLLAHASATILYKQQYKATARVNDFYIGWILHPLVFGDYPETMKTNVGSRLPAFTEEESEQVKGAFDFVGVINYMALYVKDNSSSLKPNLQDFNTDIAVEMTLVGNTSIENEYANTPWSLQQILLYVKETYGNPPVYILENGQMTPHSSSLVDTTRVKYLSSYIKAVLHSLRKGSDVKGYFQWSLMDVFELFGGYERSFGLLYVDFKDPSLKRSPKLSAHWYSSFLKGTLHHPSYASS

SEQ ID NO: 14338 - protein, 483 aa, Panicum virgatum
  misc_feature: Useful for making plants with altered carbohydrate content
MGSLPPAEQPPPHAVMIPYPAQGHVTPMLQLAKLLHARGFHVTFVNNEFNHRRHLRARGPAALDGAPGFRFAAIDDGLPRCDADATQDVPALCYSTMTTCLPRFKDLVARLDAEADRPRVTCVVADSTMTFALRAARELGLRAATLWTASACGFITYYHYRHLVDRGLVPLRDEAQLADGYLDTVVDWVPGAPADLRLRDFPSFVRTTDPDDVMLNFFIHETAGMSQASAVVINTFDELDATLLDAMANILPPLYTVGPLPLTVRNNVPAGSPVAAIASNLWKEQDAPLRWLDGRPPRSVVYVNFGSITVMSSEQLAEFAWGLANTGYAFLWNVRPDLVKGDSAGLPPEFAAATEGRSMLSTWCPQAAVLEHEAVGVFLTHSGWNSTLESICGGVPMVCWPFFAEQQTNCRYKCTEWGIGMEIGGDVERAEVEALIREAMEGDKGREMRRRAAELRESAVAAASPGGRSMRNVDRLIDEVLLA

SEQ ID NO: 14339 - protein, 369 aa, Panicum virgatum
  misc_feature: Useful for making plants with altered carbohydrate content
MAIGAEAGNGGGGGSAAGARARSVLMTGGAGFIGTHTALRLLERGYGVTVVDNFHNSVPEALDRVRLIAGPALSARLNFVLGDLRSIDDLEKVFAVKRYDAVIHFAGLKAVGESVAHPELYYDNNLVGTINLYKTMKKHGCMKMVFSSSATVYGWPEEIPCVEDAKLQAANPYGRTKLILEDMARDYHRADPEWSIVLLRYFNPIGAHSSGEIGEDPKGIPNNLLPYIQQVAVGRLSELNVYGHDYPTRDGTAIRDYIHVVDLADGHIAALNKLFDTPDIGCVAYNLGTGRGTSVLEMVAAFKKASGKEIPTKFCPRRPGDATEVYASTEKAERELGWRAQYGIDEMCRDQWNWAKKNPYGYCGSAEKK

SEQ ID NO: 14340 - protein, 351 aa, Arabidopsis thaliana
  misc_feature: Useful for making plants with altered cell wall content and/or composition
MGSSVEQNILVTGGAGFIGTHTVVQLLKDGFKVSIIDNFDNSVIEAVDRVRELVGPDLSKKLDFNLGDLRNKGDIEKLFSKQRFDAVIHFAGLKAVGESVENPRRYFDNNLVGTINLYETMAKYNCKMMVFSSSATVYGQPEKIPCMEDFELKAMNPYGRTKLFLEEIARDIQKAEPEWRIILLRYFNPVGAHESGSIGEDPKGIPNNLMPYIQQVAVGRLPELNVYGHDYPTEDGSAVRDYIHVMDLADGHIAALRKLFADPKIGCTAYNLGTGQGTSVLEMVAAFEKASGKKIPIKLCPRRSGDATAVYASTEKAEKELGWKAKYGVDEMCRDQWKWANNNPWGYQNKL

SEQ ID NO: 14341 - protein, 307 aa, Arabidopsis thaliana
  misc_feature: Useful for making plants with altered cell wall content and/or composition
MRSRDMERGRKHRGDTQWTAWLTPTIVVANVSIFIVVMYTNDCPKTTTGANGDCVAKLLRRFSFQPLRENPFLGPSSSTLEKLGALDWKKVVQGNEKWRLITAMWLHAGIIHLVMNMFDVIIFGIRLEQQFGFIRIGLIYLISGFGGSILSALFLQKSISVGASGALLGLMGAMLSELLTNWTIYKSKLCALLSFLFIIAINLAIGLLPWVDNFAHIGGLLTGFCLGFILLMQPQSGWEEFRNSSQYGARARSKYNPCQYVLFFVAAVLVVAGLTVGLVMLFDGENGNKHCKWCHRLDCYPTSKWSC

SEQ ID NO: 14342 - protein, 306 aa, Oryza sativa
  misc_feature: Useful for making plants with modulated light quality sensitivity
MSSIAPSMRTRVRIPGYLSFMYHMFCCSHVVNSCFFSSIFFPDGVAMEEKEDSLRASVTEQDTEALLLRDVLINGILAIGTLGHNVNSLCPESCIEQDEPIIMCDEKVEQEKCEEEKAEAKQDTPVTAPSEPASALEPAKMHSSSMKEDNFMCFVKEEILMHGMEVEDVPNIQERPLLMLEKVEKVRTTLADLFAAEAFSSSDAEDKCYPKIVIVAGASTSKPTSCMEKMHHKKPTKPTSKPLKATRKLSRVWFSSSLLYLLSLVTLYFTSLEFITLCSMVSAPHLTHMFYHIATTGVSIMHLASL

SEQ ID NO: 14343 - protein, 315 aa, Arabidopsis thaliana
  misc_feature: Useful for making plants with modulated biomass
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 14344 - protein, 268 aa, Arabidopsis thaliana
  misc_feature: Useful for making plants with modulated time to senescence
MCSLSAIMLLPTKLKPAYSDKRSNSSSSSSLFFNNRRSKKKNQSIVPVARLFGPAIFESSKLKVLFLGVDEKKHPSTLPRTYTLTHSDITAKLTLAISQSINNSQLQGWANRLYRDEVVAEWKKVKGKMSLHVHCHISGGHFLLDLFAKFRYFIFCKELPVVLKAFVHGDGNLLNNYPELQEALVWVYFHSNVNEFNKVECWGPLWEAVSPDGHKTETLPEARCADECSCCFPTVSSIPWSHSLSNEGVNGYSGTQTEGIATPNPEKL

SEQ ID NO: 14345 - protein, 268 aa, Arabidopsis thaliana
  misc_feature: Useful for making plants with modulated abscission
  misc_feature (123)..(123): Xaa is any aa, unknown, or other
MCSLSAIMLLPTKLKPAYSDKRSNSSSSSSLFFNNRRSKKKNQSIVPVARLFGPAIFESSKLKVLFLGVDEKKHPSTLPRTYTLTHSDITAKLTLAISQSINNSQLQGWANRLYRDEVVAEWXKVKGKMSLHVHCHISGGHFLLDLFAKFRYFIFCKELPVVLKAFVHGDGNLLNNYPELQEALVWVYFHSNVNEFNKVECWGPLWEAVSPDGHKTETLPEARCADECSCCFPTVSSIPWSHSLSNEGVNGYSGTQTEGIATPNPEKL

SEQ ID NO: 14346 - protein, 845 aa, Arabidopsis thaliana
  misc_feature: Useful for making plants with altered cell wall content and/or composition
MRKHSLDRWLLTAVLVVLLSSSSSFAAKKDAKKKKKSNKEVTYDGTSLIIDGKRELLYSGSIHYPRSTPEMWPSIIKRAKQGGLNTIQTYVFWNVHEPQQGKFNFSGRADLVKFIKLIQKNGMYVTLRLGPFIQAEWTHGGLPYWLREVPGIFFRTDNKQFKEHTERYVRMILDKMKEERLFASQGGPIILGQIENEYSAVQRAYKQDGLNYIKWASNLVDSMKLGIPWVMCKQNDAPDPMINACNGRHCGDTFPGPNRENKPSLWTENWTTQFRVFGDPPTQRSVEDIAYSVARFFSKNGTHVNYYMYHGGTNFGRTSAHYVTTRYYDDAPLDEYGLEKEPKYGHLKHLHNALNLCKKPLLWGQPKTEKPGKDTEIRYYEQPGTKTCAAFLANNNTEAAETIKFKGREYVIAPRSISILPDCKTVVYNTAQIVSQHTSRNFMKSKKANKKFDFKVFTETLPSKLEGNSYIPVELYGLTKDKTDYGWYTTSFKVHKNHLPTKKGVKTFVRIASLGHALHAWLNGEYLGSGHGSHEEKSFVFQKQVTLKAGENHLVMLGVLTGFPDSGSYMEHRYTGPRGISILGLTSGTLDLTESSKWGNKIGMEGEKLGIHTEEGLKKVEWKKFTGKAPGLTWYQTYFDAPESVSAATIRMHGMGKGLIWVNGEGVGRYWQSFLSPLGQPTQIEYHIPRSFLKPKKNLLVIFEEEPNVKPELMDFAIVNRDTVCSYVGENYTPSVRHWTRKKDQVQAITDNVSLTATLKCSGTKKIAAVEFASFGNPIGVCGNFTLGTCNAPVSKQVIEKHCLGKAECVIPVNKSTFQQDKKDSCKNVVKMLAVQVKCGRGKKN

SEQ ID NO: 14347 - protein, 500 aa, Zea mays
  misc_feature: Useful for making plants with modulated nitrogen use efficiency
MGRKPDAVAKSYHSGGGGAAASSPRAARKASPSPVFLGTALFVLGFVSLFTGHVVTDADWARIRSRWRPKQHRNYEPIDIWESKYSSMYYGCSERSASFRSAVPENSSTGYLLIATSGGLNQQRIGITDAVVVAWILNATLVVPELDHHSFWKDDSDFSDIFDVEWFISHLSKDVTIVKRIPYEVMLSMDKLPWTMRAPRKSVPEFYIDEVLPILMRRRALQLTKFDYRLTSDLDEDLQKLRCRVNFHALKFTSSIHAMGQKLVQKLRLMNTRYVAIHLRFEPDMLAFSGCYYGGGEKERKELGEIRKRWDTLPELSAEDERSRGKCPLTPHEVGLMLRALGFGNDTLLYVASGEIYGGDSTLQPLRGLFPNFYTKEKLAGDDLNPFLPFSSRLAAIDFIVCDESDVFVTNNNGNMAKVLAGRRRYMGHKRTIRPNAKKLNVLFQTRNQLSWDTFSRKVQRVQRGLMGEPDDIRPKQDDFHEFPSSCICSRKPGNISATT

SEQ ID NO: 14348 - protein, 78 aa, Arabidopsis thaliana
  misc_feature: Useful for making plants with modulated nitrogen use efficiency
MEIKVKTLTEKQIDIEIELTDTIERIKERIEEKEGIPPVHQRIVYTGKQLADDLTAKHYNLERGSVLHLVLALRGGCC

SEQ ID NO: 14349 - protein, 485 aa, Panicum virgatum
  misc_feature: Useful for making plants with altered carbohydrate content
MAEAHVLVFPCPAQGHINSMLPFAAALLDAGVFVTFLHTDHNLRRASSVAGSPRLRFLSVPDGLPDDHPRSLGDMMELERSLREVGAVRYRALLASLSSAGAGRPSQDGSDGVDGDRSFPPVTCVVADGLLTWAMDAAEELGVPALAFRTSSACSFLAYQTVPELVELGELPFPEGGDLDEPVRGVPGMESFLRRRDLPRVCRRRGGTGGVGLDPILHVFSKATAHSREVRALVFNTTASLEGAALAHIAPRMRNVFAVGPLHAMSAPAPASSLWTEDDGCLAWLDGQADRSVVYVSLGSLAVITHDQFTEFLSGLAAAGYPFLWVLRPDMVAASKDQHATPQEAIGAVGEDKARVVAWAPQRDVLRLRAVGCFLTHAGWNSTLEAAVEDVPMVCWPFFGDQLINSRNVGAVWGTGLDMKDVCDRAVVERMVREAMESAAIRSSAQELARVVRRDVSDGGSSAREFERLVRFIKEITMGRAKSDH

SEQ ID NO: 14350 - protein, 94 aa, Zea mays
  misc_feature: Useful for making plants with modulated nitrogen use efficiency
MFAWILRGCRDECSASDQLKQAHDVFKAKEVVLQKKISQEVERAKEFTKSGNKQAAMQCLKRKRYYESQMNQVGSVQLRINTKERMIADHTGNK

SEQ ID NO: 14351 - protein, 490 aa, Panicum virgatum
  misc_feature: Useful for making plants with altered carbohydrate content
MAAPALVLLPEWGSGHLMSMLESCKRVLLSSGKAFSITLFVMRPPTAEATSEVEAHARREAASGLDIRFHRLPAVEPPADAVGVEEFIARYIGLHAPHVRDALAGMAGPVAALVLDMFAAPLVDVARDLGVPSYVFMSSTGAMLAFMLHLPVLHEAVAAELDEVEGGVEVPGLPPLPPASVPCPVVDKKSPNYTWFVRLGDRFMDATGIIANTAEGLEPGPLAAVAAGRSVPGRPAPPVYPIGPVLSLGDRSPSHECVAWLDAQPPASVVFLCFGSMGWFEPAQVAEITAALERCGHRFLWVLRGPPSSATGAGAPDGSEHPTDANLDELLPDGFVERTKGKGLVWPTWAPQKDILAHAAVGGFVTHGGWNSVLESLWHGVPMAPWPLYAEQHLNAFELVADMGVAVPLRVDRKRDNFVEAAELERAVRSLMGGEGEEGRRAREKAAEMKAVCRDAVAEGGSSHAALQRLAEALHDGASIPKHSEAQQRA

SEQ ID NO: 14352 - protein, 499 aa, Panicum virgatum
  misc_feature: Useful for making plants with altered carbohydrate content
MTSADPTVVLVPVWGIGHFLPMIEAGKRLLARSSRPLTLTVLIMPAPTEKRGSEIAQHIREVETESAGLGLAIRFHHLPAAERPAVATYTGPEEFISLNVQPYVPHVRAAVSGLACPVAAVVVDIFCTPLLDAAHGLGVPAYVYLICSAAMCALLLRSPALDDEAAGAGEFEDMDGGAVHLPGLPPVPASCLPSGLVDRKVPTYRWFLYNGRRYTEAAGIIVNTVAELEPHVLAAIADGRCTRGSRAPTVYAVGPVLAATITATTPPEQQQEQPEHECVRWLHSQPPASVLFLCFGSARFFTAQQAHEAAHALDHSGHRFLWILRGPPEHGTKLSSDGDLAELLPPGFSERTKGRGLVWPRWAPQKEILAHAAVGGFVTHCGWNSVLESLWFGVPMLPWPWAAEQHYNAFTLVAAMGVAVAMEVRRKEDNFVEAVELERAVRALMGGAEGRTAREKATEMKAACRMAVEEGGSSYQSLQKLCDALHQGAVLPRMFPQDT

SEQ ID NO: 14353 - protein, 538 aa, Panicum virgatum
  misc_feature: Useful for making plants with altered carbohydrate content
MGSWSRGGSGSSLLTPLLFFLLSLHCSPVVVSAAGSGEPYVGVTIGTAVTNLLSPSDLADFLRAQHITRVRLYDADPRLLSALASAGARAIVGVPNDELLALGSSPATAAAWVARRVLPFAGVNSSTPAVISAIAVGDEVPTALPSALPVLLPAIRSLASALAAANLSSPIPVSTPLPFSVVEDPFPPSQAFFNQTLAKTFVAPLLAHLANTSAPLMLNLYPYYSLMQSDGVIPLDNALFRPLPPSLEMVDPNTLLHYTNVFDAMLDAVRVAVRNLNVSGSGGVPILVTETGWPSYGDRRAEPYASKDNADTYNSNLIKHVLQDKPGTPMAPGAAAQSSAYIYELFNEDLRPGPVSEANWGLFYGNGTPVYLLHVSGAGGLLGNDTTDRSFCVAADDAEEKAVQAAMDWACGPGRADCTAIQPGQGCYLPNDVRSHASYAFDAYYQSQGRAAGSCYFQGAGMVTTTDPSHDNCLFPGSKQLGNHTKSGSASNTTTPTSDAEGSAIWRLRTGREKGFSLFLRLLLSITVVIVTDSNFWT

SEQ ID NO: 14354 - protein, 511 aa, Arabidopsis thaliana
  misc_feature: Useful for making plants with altered cell wall content and/or composition
MAFTSMVSTVPVLFFFFTLLLISANSSSLSHNIKVQEQDKDPFVGFNIGTDVSNLLSPTELVKFLQAQKVNHVRLYDADPELLKALAKTKVRVIISVPNNQLLAIGSSNSTAASWIGRNVVAYYPETLITAISVGDEVLTTVPSSAPLLLPAIESLYNALVASNLHTQIKVSTPHAASIMLDTFPPSQAYFNQTWHSIMVPLLQFLSKTGSPLMMNLYPYYVYMQNKGVVPLDNCLFEPLTPSKEMVDPNTLLHYTNVLDAMVDAAYVSMKNLNVSDVAVLVTESGWPSKGDSKEPYATIDNADTYNSNLIKHVFDRTGTPLHPEMTSSVYIYELFNEDLRAPPVSEASWGLFYGNSTPVYLLHVSGSGTFLANDTTNQTYCIAMDGVDAKTLQAALDWACGPGRSNCSEIQPGESCYQPNNVKGHASFAFNSYYQKEGRASGSCDFKGVAMITTTDPSHGSCIFPGSKKVGNRTQTVVNSTEVAAGEATSRSLSRGFCVTIMILVTFSIL

SEQ ID NO: 14355 - protein, 466 aa, Glycine max
  misc_feature: Useful for making plants with modulated nitrogen use efficiency
MALAFTSSISAPTSTFPSSEPKLPQIGSIRISERPIGGAVNFNLSQRRSLVKPVNAEPPRKDSIVPLAATTIVASASETKEEDFEQIASDLDNASPLEIMDRALDKFGNDIAIAFSGAEDVALIEYAKLTGRPFRVFSLDTGRLNPETYQLFDAVEKHYGIRIEYMFPDAVEVQALVRSKGLFSFYEDGHQECCRVRKVRPLRRALKGLRAWITGQRKDQSPGTRSEIPVVQVDPAFEGMDGGIGSLVKWNPVANVKGHDIWNFLRTMNVPVNSLHAKGYVSIGCEPCTRPVLPGQHEREGRWWWEDAKAKECGLHKGNVKQQKEEDVNGNGLSQSHANGDATTVPDIFNSPNVVNLSRTGIENLAKLEDRKEPWLVVLYAPWCPYCQAMEESYVDLADKLAGSTGMKVGKFRADGEQKEFAKSELQLGSFPTILFFPKHSSRPTIKYPSEKRDVDSLMAFVNALR

SEQ ID NO: 14356 - protein, 672 aa, Arabidopsis thaliana
  misc_feature: Useful for making plants with altered cell wall content and/or composition
MRAIDVKTGMKIPWDVRYSLSLFIFLSSILFLSNGQDYGMPGEDGGGGAEPPPEMAHCNGIFMSYNFGSREREYPHVKNVTAQSWAFKSTAMIVNAGREELKGWQMFIGFRHKELIVSATGATPMDGDYPLDASNGTTFVGSPNMDLKTSIETAGDFTQISANIEITGTLFGVSKAVTPMPRTIKLTNDGWECPAAKRKGGSMHVCCKRNPKIKNKIGLKTKFAPRRYGDLNIVYDVLQSFDSNYLAQVTIDNDNPLGRLDRWNLTFEWMRGEFINTMRGAYTHKKDPSECLYSKAGQYYKDLDFSQVMNCQRKPAISDLPPEKKEDNMTGKLPFCCKNGTLLPPIMDPSKSRSMFQLQVFKLPPDLNRTALYPPQHWKIDGVLNPQYKCGPPVRVDPSQFPDPSGLLAVTYAISSWQVVCNITKPKAQASRCCVSFSAFYNNSAVPCNTCACGCNDIDTDTCNANSNPLLLPPDALLVPFDNRTLKAKAWAKQNHMPVPKKLPCPDNCGVSINWHVSTDYKNGWTARLTVFNWRDFAFEDWFVAIDMGKAGPGYENVYSFNGTRVPPSNRTVIFQGLPGMNYLVGQVNGTNPLRDPPVPGKQQSVISFTKKNIKGLNIPEGDGFPTKLFFNGEECALPKHFPKKSSGHRRGISVSMSFVFATIAAFALMMD

SEQ ID NO: 14357 - protein, 305 aa, Arabidopsis thaliana
  misc_feature: Useful for making plants with altered cell wall content and/or composition
METERRIITSCSAMTALFLFMTALMASSSIAATPTQSFEDNFNIMWSENHFTTSDDGEIWNLSLDNDTGCGFQTKHMYRFGWFSMKLKLVGGDSAGVVTAYYMCSENGAGPERDEIDFEFLGNRTGQPYIIQTNVYKNGTGNREMRHSLWFDPTKDYHTYSILWNNHQLVFFVDRVPIRVYKNSDKVPNNDFFPNQKPMYLFSSIWNADDWATRGGLEKTDWKKAPFVSSYKDFAVEGCRWKDPFPACVSTTTENWWDQYDAWHLSKTQKMDYAWVQRNLVVYDYCKDSERFPTLPWECSISPWA

SEQ ID NO: 14358 - protein, 510 aa, Panicum virgatum
  misc_feature: Useful for making plants with altered carbohydrate content
MSCSVRSSPLQGRMALNRLFVLFLGTALPLLFFFSLADAGKVGVSYGRLGNNLPSTASVVKLLKQSGITTVRLYDANPRVLKALANTGITVMVMLPNDHLAAAAADPASARRWVLRNVAAHYPATRIHGVAVGNEVFEEASNLTRQLVPAMANVHAALVRLGLDEAVKVSTPLAFTALQESWPPSAGRFRDDIARPVMKPMLDFLERTGSYLTVNAYPFFAYVEQPDKISLDYALGSAKAGVQDPVTGLVYHSLLDAQLDATFFAMEKLGSSGAWQGNSLGRGTPRARAYVSESGWPSGGSRRSGRSLDLEAGGGAGAPAATIANAKAYNNYLINRVLSCDTGTPYRPDADMDVYIFALFNENDKGCGADDIEQHFGLFYPNRTKVYEFDFRGAAPPAPAPAPSASSWCVANASAGEARLQATLDWACGHGADCSDIQPGAPCFEPDTVVAHASHAFNSYYQRSGRASGTCDFAGAAYVVYHAPKIGNCVLPSQVWIQEAAAKSEGYAAI

SEQ ID NO: 14359 - protein, 676 aa, Arabidopsis thaliana
  misc_feature: Useful for making plants with altered cell wall content and/or composition
MSFFWLFPFLLHLSFADSLSPLSAPVQNFIHLNHSCPSSILTYSRNSTYFTNLKTLLSSLSSRNASYSTGFQTATAGQAPDRVTGLFLCRGDVSQEVCRNCVAFSVKETLYWCPYNKEVVLYYDECMLRYSHRNILSTVTYDGSAILLNGANISSSNQNQVDEFRDLVSSTLNLAAVEAANSSKKFYTRKVITPQPLYLLVQCTPDLTRQDCLRCLQKSIKGMSLYRIGGRFFYPSCNSRYENYSFYNETATRSSSPPSLPPRSTPQQQLKLAPPPLISERGKGRNSSVIIVVVVPIIALLLLFVAFFSLRAKKTRTNYEREPLTEESDDITTAGSLQFDFKAIEAATNKFCETNKLGQGGFGEVYKGIFPSGVQVAVKRLSKTSGQGEREFANEVIVVAKLQHRNLVRLLGFCLERDERILVYEFVPNKSLDYFIFDSTMQSLLDWTRRYKIIGGIARGILYLHQDSRLTIIHRDLKAGNILLGDDMNAKIADFGMARIFGMDQTEANTRRIVGTYGYMSPEYAMYGQFSMKSDVYSFGVLVLEIISGKKNSNVYQMDGTSAGNLVTYTWRLWSNGSPLELVDPSFRDNYRINEVSRCIHIALLCVQEEAEDRPTMSAIVQMLTTSSIALAVPQRPGFFFRSSKHEQVGLVDRLSINTSALCSVDDASITNVTPR

SEQ ID NO: 14360 - protein, 672 aa, Panicum virgatum
  misc_feature: Useful for making plants with altered carbohydrate content
MRIRGHAVALVVPAGLLMALTQLVAGIPWEACNSTITGNYTADSTYGGNLRLVAAALPGNVSMSPTLFARAVIGTAPDIVYALGQCSGDQSAAACHDCISASFSAAQKLCPFNKGAAVFYDTCFVGFSGRDFLASTTNSDDQEVQLYNGQNITSDGADRFNATAYELLNAMAEHMATMNSEEKFLTGTIGFDATYPNIYGMASCTSDLTPGQCRGCLDAAIAEMPRVFIPNTKGARIAGLRCVVRYEVYRFYNGSTMLQLPGTQAGRFGSKKSNDTGKILAIVLPIVAAIVVSLAMCVFCRRRTKSKSKRSLSFTSHMEDIESIESLVIDLPTLRMATNNFVEDNKLGEGGFGAVYKGSLPNGQEIAVKRLSQNSRQGIGELRNELLLIAKLQHKNLVRLVGVCLEEEEKLLVYEYMPNTSLDTFLFDSEKRKELDWGKRFTIINGITRGLQYLHEDSQLKIVHRDLKASNILLDADMNPKISDFGLARLFGEDQSQDTTRRVVGTYGYMAPEYALRGQYSIKSDIYSFGVLILEIITGRRNSDSYNSDQSIDLPSLVWEHWTTKSITDMVDPYLRSDSSWDEILRCIHIGLSCVQEDPVDRPTISAISIMLDSSTVPTQPPSRPAFYVEMSGNVDSGMYSSQSYPGFVNESTAKSTVVSPNELSVTDPEPR

SEQ ID NO: 14361 - protein, 234 aa, Oryza sativa
  misc_feature: Useful for biocontainment applications
MPRRARARGGGGGGGEEVKVEDDFIDSVLNFGGGGGGEEDGDDGEEEQQQQQAAAAAMGKEFKSKNLEAERRRRGRLNGNIFALRAVVPKITKMSKEATLSDAIEHIKNLQNEVLELQRQLGDSPGEAWEKQCSASCSESFVPTENAHYQGQVELISLGSCKYNLKIFWTKRAGLFTKVLEALCSYKVQVLSLNTISFYGYAESFFTIEVKGEQDVVMVELRSLLSSIVEVPSI

SEQ ID NO: 14362 - protein, 476 aa, Panicum virgatum
  misc_feature: Useful for making plants with altered carbohydrate content
MKKTVVLYPGLSVSHFVPMLQLADALLNEGYAVKVAHIDPALKGDIAMAAVIGRAAASRPSVTFYELPRIQDPPTVLHDAKFLATYSDLLGRHNERFHDFLRSLPPGSVHALVLDVLAAEALGVAQELGIPAYSFVPTNASAFAIFSQLPSIRTEGQPTMKELGDTPLDFHGVPPMTASHIHTESLEDPESEKVLLDMLVATQQRANGILVNTFLPLEARAVGALRDRRCFPTMPPVYCVGPFIAEAGLAGEKHECLAWLDKQPERSVVYLCFGSVGAGNHSEEQLKEIAAGLEKSGHRFLWVVRAPPHDDPKRPFDPRADPDLDAILPAGFLERTRGRGLVVKLWAPQVAVLQHRATGAFVTHCGWNSVLEGITAGVPMLCWPLYAEQKMNKVFMVEEYGVGVEVLGWQQGVVKAGELEAKVRLVMEGEEGELLRARVAEHREAAAMAMKDGGSSRAAFRQFLSDVGKLRLRSTR

SEQ ID NO: 14363 - protein, 279 aa, Arabidopsis thaliana
  misc_feature: Useful for making plants with modulated heat sensitivity
MVSFRFPFSFSQPPRATTSFSGFSISAVAVSVTVGAAAAGAAIAASRNPSHPILEWAFSSHRSSLSPWGSITLADESVVEPKTGFSFPASIGDSRRLLGVGLRKKSLLGLKNIDVYVFGVYADCDDVKKLVGDKYANLPASEIRGNKSFMDDLMEADIKMTIRLQIVYGKLNIGSVRNAFQESVGNRLKKFGGSDNDELLQSFTSLFKDEYKIPRNSTIDLTKDPGHVLSVAIEGNHVGSVKSHLLCRSILDLYIGEEPFDKNAREDFLDNAASLAFDN

SEQ ID NO: 14364 - protein, 492 aa, Panicum virgatum
  misc_feature: Useful for making plants with altered carbohydrate content
MLPKRPHGVVMLLMLMVFDVSGAFVGITIGNEMSNLPSATDIVAILKEKKIQHVRLIDSNHQMLTALANTGIEVMVGVPNDQLLCVGQSRSTAADWINKNVAAYVQATNITYIAVGDEVLTNIPNAALVLVPALQFLQSALLAANLNTQVKISSPHSMDMISKAFPPSTATFNSTWNTVMSQYLRFLKDTGSSFMLNAQPYYGYVGGQGVFPLEYALFRSLNPNSQISDPNTNLFYTNMFDAIIDATYNSIQAMNFTEIPVLVTASGWPWRGGPNEKAATVDNALAYNTNLIRHVLNNSGTPSQPTNQSSTYIFELFNEDLRSGPESEKSWGIMFPNATTVYSLSFEDVATTIPESPALRGMFCVANSSAPHSALKHSLDWACGPGSANCSAIQPGQPCYESDNIVAVASYALNDYYHRTQASGGTCSFNGTAMMTSTDPSHDSCIFAGSTGANGSNGGTASGPVSPDSFASKSQSCWLTHLAAALLLILVM

SEQ ID NO: 14365 - protein, 348 aa, Arabidopsis thaliana
  misc_feature: Useful for making plants with modulated low light sensitivity
MMTPGGSGRLRPLPTAMYAGYSGTASSWVAKTSVSASGKRIQREMAELNIDPPPDCSAGPKGDNLYHWIATIIGPSGTPYEGGIFFLDIIFPSDYPFKPPKLVFKTRIYHCNVDTAGDLSVNILRDSWSPALTITKVLQAIRSIFLKPEPYSPALPVIARLYLTDREKHDEVAKEWTLRFAKMYAGYSGTASSWVAKTSVSASGKRIQREMAELNIDPPPDCSAGPKGDNLYHWIATIIGPSGTPYEGGIFFLDIIFPSDYPFKPPKLVFKTRIYHCNVDTAGDLSVNILRDSWSPALTITKVLQAIRSIFLKPEPYSPALPVIARLYLTDREKHDEVAKEWTLRFAK

SEQ ID NO: 14366 - protein, 182 aa, Arabidopsis thaliana
  misc_feature: Useful for making plants with modulated light quality sensitivity
MMTPGGSGRLRPLPTAMYAGYSGTASSWVAKTSVSASGKRIQREMAELNIDPPPDCSAGPKGDNLYHWIATIIGPSGTPYEGGIFFLDIIFPSDYPFKPPKLVFKTRIYHCNVDTAGDLSVNILRDSWSPALTITKVLQAIRSIFLKPEPYSPALPVIARLYLTDREKHDEVAKEWTLRFAK

SEQ ID NO: 14367 - protein, 360 aa, Arabidopsis thaliana
  misc_feature: Useful for making plants with altered protein content
  misc_feature: Useful for making plants with altered terpenoid content
  misc_feature: Useful for making plants with modulated nitrogen use efficiency
MATTVHLSSSSLFSQSRGRRDNSISSVKSLRKRTVLSLSSALTSQDAGHMIQPEGKSNDNNSAFDFKLYMIRKAESVNAALDVSVPLLKPLTIQEAVRYSLLAGGKRVRPLLCIAACELVGGDEATAMSAACAVEMIHTSSLIHDDLPCMDNADLRRGKPTNHKVYGEDMAVLAGDALLALAFEHMTVVSSGLVAPEKMIRAVVELARAIGTTGLVAGQMIDLASERLNPDKVGLEHLEFIHLHKTAALLEAAAVLGVIMGGGTEEEIEKLRKYARCIGLLFQVVDDILDVTKSTEELGKTAGKDVMAGKLTYPRLIGLEGSREVAEKLRREAEEQLLGFDPSKAAPLVALASYIACRHN

SEQ ID NO: 14368 - protein, 360 aa, Arabidopsis thaliana
  misc_feature: Useful for making plants with modulated water use efficiency
MATTVHLSSFSLFIQSRGRRDNSISSVKSLKKRTGLSPSSALTSQGGRDMIPPERKCNDHNSAFDFKLYMIRKAESVNAALDVSVPLREPLTVQEAVRYSLLAGGKRVRPLLCIAVCELVGGDEATAMSAACAVEMIHTSSLIHDDLPCMDNADLRRGKPTNHKVYGEDMAVLAGDALLALAFEHMTVVSSGLVAPERMIRAVVELARAIGTTGLVAGQMIDLASERLNPDKVGLEHLEFIHLHKTAALLEAAAVLGVIMGGGTEEEIEKLRKYARCIGLLFQVVDDIPDVTKSTEELGKTAGKDVMAGKLTYPRLIGLERSKEVAEELRREAEEQLLGFDPSKAAPLVALASYIACRHN

SEQ ID NO: 14369 - protein, 196 aa, Panicum virgatum
  misc_feature: Useful for making plants with altered carbohydrate content
MKALVVAVLLLLSSTLAASQWCVCRQDAPQAALQKTIDYACGAGADCNSIHENGPCYNPNNVPAHCSWAANSYYQNNKAKGATCDFTGTATLTTSDPSSSGCSFPTSASAVGTMTPTTGGTMGGTPGTGTFTPGAGTTGTTGTGMGTGSTTGTTGTGFGLGPAGTGAGMDTAAAGLLPRAGLVAVLTMLFPAIAFA

SEQ ID NO: 14370 - protein, 493 aa, Panicum virgatum
  misc_feature: Useful for making plants with altered carbohydrate content
MASNDEQQPLHVLLFPFVAPGHLIPVADMAALFASHGVKCTILTTPANADVIRSAVDGANNAVCSTGAPEIDISTVPFPDVGLAPGVESVVGISSEADRSRLLEAVRLLREPFDRFLADHRPDAVVADSFYPWTTDTAAEHGVPRLCFLGTSMFARACNASLLCSNTLELEGLPPDDPDAIVSLPGLPHRVTLRRGQVMDPRKNELEWNYGKLVNAADQRSYGEVFNSFAELEPGYAEHYRTALGRRVWLVGPVGHASDVLAARGGAGELSLEAERCLRWLDQKPDGSVVFISFGTLTRFTAVEQREVARGLQLSGRNFVWVMSESEAEPSQWMPEGFAELIDPREHGIIFWGWAPQRLILGHSAVGGFVTHCGWNSVLEAVSAGVPLVTWPRHGDQFYNEKLILEVLKIGVSVGSRFSATKVEVRSEVINGEKIAEGIDRVMGDDEEAEAVRKKAVDLRGKARSAIEKGGSSYDDLDQLITELMARRNSVSV

SEQ ID NO: 14371 - protein, 528 aa, Glycine max
  misc_feature: Useful for biocontainment applications
MSSSELSSFFLLRLSDILSFDVLLGVMFLVAVFGYWLVPGGFAWAFSKFKPAIPGPSGYPVVGLVWAFIGPLTHRVLAKLAETFDAKPLMAFSVGFTRFIISSHPDTAKEILNSSAFADRPVKESAYELLFHRAMGFAPYGEYWRNLRRISATHMFSPRRIAAQGVFRARIGAQMVRDIVGLMGRDGVVEVRKVLHFGSLNNVMKSVFGRSYVFGEGGDGCELEGLVSEGYHLLGVFNWSDHFPLLGWLDLQGVRKSCRSLVDRVNVYVGKIILEHRVKRVAQGEDNKAIDTDSSGDFVDVLLDLEKENRLNHSDMVAVLWEMIFRGTDTVAILLEWILARMVLHPEIQAKAQSEIDSVVGSGRSVSDDDLPNLPYVRAIVKETLRMHPPGPLLSWARLSIHDTQIGNHFVPAGTTAMVNMWAITHDQEVWYEPKQFKPERFLKDEDVPIMGSDLRLAPFGSGRRVCPGKAMGLATVELWLAMFLQKFKWMPCDDSGVDLSECLKLSMEMKHSLKTKVVARPVVSLAM

SEQ ID NO: 14372 - protein, 537 aa, Arabidopsis thaliana
  misc_feature: Useful for biocontainment applications
  misc_feature: Useful for making plants with modulated time to senescence
MTIDMYLSFASRSGSSPFPSLELCLSIFLFISLFVFWLTPGGFAWALYKARFHTRPESKTGPAIPGPSGLPIFGLLLAFVNNALTHRILANIADTCKAKALMAFSVGSTRFVITSEPETAKELLNSSAFADRPVKESAYELLFDRAMGFAPFGDYWRELRRISSTHLFSPKRIFSSGESRRKIGQNMVGEIKNAMECYGEVHIKKILHFGSLNNVMSSVFGKTYNFNEGIVYSKESNELEHLVSEGYELLGIFNWSDHFPGMRWLDLQGVRRRCRSLVGRVNVFVGKIINDHKSKRSLRDNPEESTYDDDFVDVLLGMHGNSKLSDSDMIAVLWEMIFRGTDTVAILLEWILARMVLHPDIQAKAQAEIDCIVGDSGRQVTDSDLPKLPYVRAIVKETLRMHPPGPLLSWARLSIHDTQIGTHFIPAGTTAMVNMWAITHDEKVWPEAHEYKPERFLGAQESNNFPIMGSDLRLAPFGAGRRVCPGKSMGLATVELWLAQLLGSYKWVSCGEVDLSETLKLSLEMKNTLVCKAIPRG

SEQ ID NO: 14373 - protein, 570 aa, Zea mays
  misc_feature: Useful for making plants with modulated nitrogen use efficiency
MEEGGEHTSLLVKDDASCHGEETQSLLEANLGPQLKSKCSDWRAPALILGLECLESMAFNGIATNLVVYLRSVLHGGIASSAATVSLWYGTSFFVPILGAAIADTCLGNYKTILISLIMYLFGIVLITVATFMPSTSVLCDVSSCLSSNGTQTMIFFAGLYLTAVGCGGVRSALLPFGANQFNNENSLDIKKRRNFFSLFYICVIFGVITSGTIIVWVQENVSWAIGYGVATTCIGLALIGFLVGTPIFQEDEPCGSPVKSIFQVIVASFRNMSLEVPADSCLLYEVGSNHIQRTKLAHSDDFRFLDKAAVISDPSLVYGGCRSSWSICTVTEVEELKILIRLLPIWVTGIFFGAAISQMHTTFIQQGTVMDTKIGSLSIPPASLYSFEVICVTLWVLAVNKVLVPAIRTYFANGVELTQLQRIGIGRFLMIFAMAMAALLETKRLHIVQEGELLSIVWQLPQYFVIAGAECFGIITQLEFFHGQAPDSMKSILTAFALLTTALGNYLSSAIITLIAGVTRVWHSPGWIPDDLNKGHLDYYYWCLTTLSLVNFVVYLYFASKYKLKKVVC

SEQ ID NO: 14374 - protein, 475 aa, Panicum virgatum
  misc_feature: Useful for making plants with altered carbohydrate content
  misc_feature (259)..(259): Xaa is any aa, unknown, or other
MAPAVSSPTPHVAVVAFPFGSHAPALLAFARALAAAAAPAGATLSFLSTAGSIAQLRGAASAEIPGNLRFVEVPDGAGLPAAKGPVPVPVPRQMELFMAAAEAGGLKAGLEAARAMAGGARVSCVVGDAFVWPAAEAAAAAGSPWVPVWMGAPCALLAHLRTDALRAEVGDQAASRADELLASHPGLGSYCVGDLPDGVVSGDFNHVISRLVHRMGQLLPRAAAAAVALNTFPGLDPPDFTAVLAETLPNCLPLGLGLXHLLLPKDITDAAAPTAGDPHGCLAWVDAHPARSVVYVGFGRVASPRSDELRELAAGLESSGAPFLWSLREDSWPLLPEGFLARAAAAGAGLVVPWAPQVAVLRHASVGTFVTHAGWGSVLEALSSGVPMACRPFFGDHRMIARSVASVWGVGVAFEGAAMTRAGVAAAVGELLRGEEGARMRARAQELQAAAAAAFAPGGACRRNFDEFVEIVCRV

SEQ ID NO: 14375 - protein, 475 aa, Panicum virgatum
  misc_feature: Useful for making plants with modulated flowering time
MALAVSSPAPHVAVVAFPFSSHAAALFTIARALAAAAAPVGATLSFLSTAGSIARLRGAAGAELPGNLRFVEVPDGAGTPAAKGPVPVPMPRKMELFMAAAEAGGVKAGLEAARAAAGGARVSCVVGDAFVWPAAEAAAAVGAPWVPVWIALSSALLAHLRTDALWADVGDQAASRADELLVSHPGLGSYRVSDIPDGVVSGDFDYVISRLLHRMGQLLPRAAAPAVALNTFLGLDPPDVTAALDETLPNCLPLGPYHLLLPEDTTAAASPAAGDPHGCLAWLDAHPARSVAYVSFGTVASPHPDELRELAAGLESSGAPFLLSLREDSWPLLPAGFLARAAAGGAGSGLVVPWAPQVAVLRHESVGAFVTHAGWGSVLEAMSSGVPMACRPFVGDNRMIARSVASVWGIGAAFEGATMTRAGVAAAVGELLRGEEGARMRARAQELQAAMAAAFAPGGACRRNFDKFVEIVCRV

SEQ ID NO: 14376 - protein, 380 aa, Arabidopsis thaliana
  misc_feature: Useful for making plants with altered cell wall content and/or composition
MKVEAFIPAVLLLCFGVMLCLKSSCALQIGNNNELKNYISWEDLRVVEDGRIERSFSIKENSNWVTTNANANANATNVRRVIVVDKNGGGDSVTVQGAVDMVPDSNSQRVKIFILPGIYREKVIVPKSKPYISFIGNESYAGDTVISWSDKASDLGCDGKELGTYRTASVSIESDFFCATAITFENTVVAEAGEQGRQAVALRIIGDKAVFYRVRVLGSQDTLFDDNGSHYFYQCYIQGNVDFIFGNAKSLYQDCDIHSTAKRYGAIAAHHRDSETEDTGFSFVNCDISGTGQIYLGRAWGNYSRTVYSNCFIADIITPVGWSDWKHPERQRKVMFGEYNCRGRGAERGGRVPWSKTLTRDEVKPFLGREFIYGDQWLRL

SEQ ID NO: 14377 - protein, 190 aa, Arabidopsis thaliana
  misc_feature: Useful for making plants with altered oil content
MLFSNKVNSLTEQVSRLDIDDNDMGLGGSETMECKCGMPLCICVAPPKSTDKPNPPATIAPVVLPQLKSEASAKSKGSTSSSNARSALNAGLDTPQRDYEASGEGLREAIKNGDSAGAKKLLKEGVDANYRDRQGMSVLHLAVLFNQTDIALMLMDHGASLEYKNAQGETPLDCAPATLQYKMREKMKST

SEQ ID NO: 14378 - protein, 322 aa, Arabidopsis thaliana
  misc_feature: Useful for making plants with altered cell wall content and/or composition
MAFSKGLIFAMIFAVLAIVKPSEAALDAHYYDQSCPAAEKIILETVRNATLYDPKVPARLLRMFFHDCFIRGCDASILLDSTRSNQAEKDGPPNISVRSFYVIEDAKRKLEKACPRTVSCADVIAIAARDVVTLSGGPYWSVLKGRKDGTISRANETRNLPPPTFNVSQLIQSFAARGLSVKDMVTLSGGHTIGFSHCSSFESRLQNFSKFHDIDPSMNYAFAQTLKKKCPRTSNRGKNAGTVLDSTSSVFDNVYYKQILSGKGVFGSDQALLGDSRTKWIVETFAQDQKAFFREFAASMVKLGNFGVKETGQVRVNTRFVN

SEQ ID NO: 14379 - protein, 216 aa, Panicum virgatum
  misc_feature: Useful for making plants with altered carbohydrate content
MARMALAAALVAVAVAGVLAGGAGAQLVEGFYASCCPQAEKIIKNYVAEHVPRVPTIAATLLRTHFHDCFVRGCDASLLLNATGGKEAEKDAAPNKTLRGFAFIDRIKAIIEKECPGVVSCADILALAARDSVVVTGGPSWSVPTGRRDGTVSLKQEALDNIPGPTMNFTQLLQSFQNKSLSLADLVWLSGAHTIGIGHCNTFSERLYNFTGRGGP

SEQ ID NO: 14380 - protein, 538 aa, Panicum virgatum
  misc_feature: Useful for making plants with altered carbohydrate content
  misc_feature (424)..(424): Xaa is any aa, unknown, or other
  misc_feature (449)..(449): Xaa is any aa, unknown, or other
  misc_feature (452)..(452): Xaa is any aa, unknown, or other
  misc_feature (458)..(458): Xaa is any aa, unknown, or other
  misc_feature (486)..(486): Xaa is any aa, unknown, or other
  misc_feature (490)..(490): Xaa is any aa, unknown, or other
  misc_feature (492)..(492): Xaa is any aa, unknown, or other
  misc_feature (496)..(496): Xaa is any aa, unknown, or other
  misc_feature (498)..(498): Xaa is any aa, unknown, or other
  misc_feature (500)..(500): Xaa is any aa, unknown, or other
  misc_feature (503)..(503): Xaa is any aa, unknown, or other
  misc_feature (508)..(508): Xaa is any aa, unknown, or other
  misc_feature (511)..(511): Xaa is any aa, unknown, or other
  misc_feature (512)..(512): Xaa is any aa, unknown, or other
  misc_feature (513)..(513): Xaa is any aa, unknown, or other
  misc_feature (517)..(517): Xaa is any aa, unknown, or other
  misc_feature (519)..(519): Xaa is any aa, unknown, or other
  misc_feature (521)..(521): Xaa is any aa, unknown, or other
  misc_feature (523)..(523): Xaa is any aa, unknown, or other
  misc_feature (525)..(525): Xaa is any aa, unknown, or other
  misc_feature (526)..(526): Xaa is any aa, unknown, or other
  misc_feature (531)..(531): Xaa is any aa, unknown, or other
  misc_feature (533)..(533): Xaa is any aa, unknown, or other
MVQQQQQQQHRIYILQFRKGEPEQEVACKVSQAKGAGRRVMYYYQDYGGGGGGGGKSGKTVQSKALSLRRILAMLLLSLLCVGTLFVAPVSFLSFVHTDDGGAEAAAATAARRGVSGPCLAVGNDSLCCDRSSERADICFARGDLRMHSASASFQLVSGNSTAEEERIRPYTRKWEANVMATIDEVRLRRVSPGEAARCDVRHDVPAVLFSTGGYTGNVYHEFNDGILPLFVTANHLRRRVVFVILEYHDWWITKYGDVVSQLSAFPPIDFTADRRVHCFPEVIAGLRIHGELTVDPAKTPEGKSIGDFRRLLDDAYRGRIEFLERLERRAARKRHRRRTVPRAQLAPPRHTSLQDRPRLVIVSRTGSRVIENEADVAALAADVGFDVRVIRPDRTTELCKIYRELNASDAMVGVHGAAMTHFXFMRPGKVFIQVVPLGTDWAAGAYYXEPXARLGLXYVGYKILPEESSFSREYPPGDPVLTDPXGDRXEXLGCXQXGXPGXPKSPXGPXXXQGGXGXGXPXPXXRQGAXAXSIRVM

SEQ ID NO: 14381 - protein, 573 aa, Panicum virgatum
  misc_feature: Useful for making plants with altered carbohydrate content
MPPLPKRPGPLLVLLVVAFAAATAAAAASDAAGATVPFYPSAEAAAAAHCDGTLYPDVCLSTLADIPDLHKKPLPDVICAAVNRTEDVVAATASNCSSYLRERSLTARDHLALSDCLELLSTSMDELQATVADLESPAATGGGGSASSSSAVGARRVTMDHVMTVLSAAITNQYTCLDGFAYQNGGRVRRYIEPTLHHVSRMVSNSLAMAKKLPGATPSPPSPAAARHPFMGYGQMVKGFPRWVRPGDRRLLQAPASGIAADAVVAQDGSGNYTTVSAAVAAAPTNSKRRYVIYIKAGAYMENVEVGKKHVNLMFVGDGIGKTVIKASRNVVDGSTTFRSATVAVVGNNFLGRDLTIENSAGPSKHQAVALRVGADLSAFYRCSFVGYQDTLYVHSLRQFFRDCDVYGTIDFVFGNAAVVLQGCNLYARRPLPNQSNIFTAQGREDPNQNTGISVHRCKVAAAADLAGREASTRTYLGRPWKQYSRTVFMQSELDSLIDPAGWLEWSGDFALDTLYYGEYMNTGAGAGTSGRVKWKGYRVITSAAEASAFTVGSFIDGDVWLAGTSIPFTTGL

SEQ ID NO: 14382 - protein, 592 aa, Arabidopsis thaliana
  misc_feature: Useful for making plants with altered cell wall content and/or composition
MAPSMKEIFSKDNFKKNKKLVLLSAAVALLFVAAVAGISAGASKANEKRTLSPSSHAVLRSSCSSTRYPELCISAVVTAGGVELTSQKDVIEASVNLTITAVEHNYFTVKKLIKKRKGLTPREKTALHDCLETIDETLDELHETVEDLHLYPTKKTLREHAGDLKTLISSAITNQETCLDGFSHDDADKQVRKALLKGQIHVEHMCSNALAMIKNMTDTDIANFEQKAKITSNNRKLKEENQETTVAVDIAGAGELDSEGWPTWLSAGDRRLLQGSGVKADATVAADGSGTFKTVAAAVAAAPENSNKRYVIHIKAGVYRENVEVAKKKKNIMFMGDGRTRTIITGSRNVVDGSTTFHSATVAAVGERFLARDITFQNTAGPSKHQAVALRVGSDFSAFYNCDMLAYQDTLYVHSNRQFFVKCLIAGTVDFIFGNAAVVLQDCDIHARRPNSGQKNMVTAQGRTDPNQNTGIVIQKCRIGATSDLQSVKGSFPTYLGRPWKEYSQTVIMQSAISDVIRPEGWSEWTGTFALNTLTYREYSNTGAGAGTANRVKWRGFKVITAAAEAQKYTAGQFIGGGGWLSSTGFPFSLGL

SEQ ID NO: 14383 - protein, 305 aa, Arabidopsis thaliana
  misc_feature: Useful for making plants with altered cell wall content and/or composition
MSSSNGGVPPGFRFHPTDEELLHYYLKKKISYEKFEMEVIKEVDLNKIEPWDLQDRCKIGSTPQNEWYFFSHKDRKYPTGSRTNRATHSGFWKATGRDKCIRNSYKKIGMRKTLVFYKGRAPHGQKTDWIMHEYRIEDTEDDPCEDGWVVCRVFKKKNLFKVGNDVGSNISNNRLEARSFIRRESPYQGISMFELNKPEEISVHQYPQPPMFQPHHKPLSIGYDYSLALLPRESEYQQACQPSGVEVGTCKAVSEWGIVNCNMVSHEDSSRAMRFEDDGNNTSSTVQPPSNLLSLRGENGFLGLF

SEQ ID NO: 14384 - protein, 289 aa, Panicum virgatum
  misc_feature: Useful for making plants with altered carbohydrate content
MAAPVVDAEYLRQVDRARRQLRALISNKGCAPIMLRLAWHDAGTYDVKTKTGGANGSIRFEEEYTHGSNAGLKIAIDLLEPIKAKNPKITYADLYQLAGVVAVEVTGGPTVEFVPGRRDSSVCPREGRLPDAKKGAPHLRDIFYRMGLTDKDIVALSGGHTLGKAHPERSGFEGAWTQEPLKFDNSYFVELLKGESEGLLQLPTDKALLSDPEFRHYVELYAKDEDAFFKDYAESHKKLSELGFTPRGAASAKSDLPTGAVLAQGAFGVAVAAAVVVAGYLYEAARKAK

SEQ ID NO: 14385 - protein, 464 aa, Panicum virgatum
  misc_feature: Useful for making plants with altered carbohydrate content
MLPLLLLLATAALAAAQGLPPLPIGVNYGANADNLPSPAAVATFLAAKTTVNRVKLFDANPAFLDAFAANAPGISIAVSIPNAALTGFADRAAGLDAARGWVRDNLAAHVARGANVTLLLAGNEIPGPTVVPDLVVALLPAMRRLSQALQLEGLPQVRVTTPHYLGILAPSDGIPSNARFRPGLDTKVLAPMLRFHNDTGSPLMVNAYPYFSYNAQNLNYAIFRPNAGVYDPATKLNYTSMFDAQMDAIYTAMKKLGYGDVQIAVGEAGWPTQADAGQVGVGPEEARDFNAGMIRVCSGGKGTPLMPGRTFETYVFSLFDENQKPDPIAERNFGIFNPDFTPKYDLGLLRDGSSSASPNPSPNPSPKPSPNPSPSGGGKWCVAKAGADATTLQNNINYACGFVDCKPIQSGGGCFDPNNVQSHASFVMNAYYQANGRHDYDCDFKDTGMVTSSDPSYGGCKYVS

SEQ ID NO: 14386 - protein, 587 aa, Arabidopsis thaliana
  misc_feature: Useful for making plants with altered cell wall content and/or composition
MGYDRLGPSGPSNPNQKDPATSLPELQKKTKTKLILFTLAVLVVGVVCFGIFAGIRAVDSGKTEPKLTRKPTQAISRTCSKSLYPNLCIDTLLDFPGSLTADENELIHISFNATLQKFSKALYTSSTITYTQMPPRVRSAYDSCLELLDDSVDALTRALSSVVVVSGDESHSDVMTWLSSAMTNHDTCTDGFDEIEGQGGEVKDQVIGAVKDLSEMVSNCLAIFAGKVKDLSGVPVVNNRKLLGTEETEELPNWLKREDRELLGTPTSAIQADITVSKDGSGTFKTIAEAIKKAPEHSSRRFVIYVKAGRYEEENLKVGRKKTNLMFIGDGKGKTVITGGKSIADDLTTFHTATFAATGAGFIVRDMTFENYAGPAKHQAVALRVGGDHAVVYRCNIIGYQDALYVHSNRQFFRECEIYGTVDFIFGNAAVILQSCNIYARKPMAQQKITITAQNRKDPNQNTGISIHACKLLATPDLEASKGSYPTYLGRPWKLYSRVVYMMSDMGDHIDPRGWLEWNGPFALDSLYYGEYMNKGLGSGIGQRVKWPGYHVITSTVEASKFTVAQFISGSSWLPSTGVSFFSGLSQ

SEQ ID NO: 14387 - protein, 542 aa, Arabidopsis thaliana
  misc_feature: Useful for making plants with altered cell wall content and/or composition
MESQKQEDNEYIFRSLYPSVPIPDKLTLPEFVLQGVEEYTENVAFVEAVTGKAVTYGDVVRDTKRLAKALTSLGLRKGQVMVVVLPNVAEYGIIALGIMSAGGVFSGANPTALVSEIKKQVEASGARGIITDATNYEKVKSLGLPVIVLGEEKIEGAVNWKDLLEAGDKCGDTDNEEILQTDLCALPFSSGTTGLQKGVMLTHRNLIANLCSTLFGVRSEMIGQIVTLGLIPFFHIYGIVGICCATMKNKGKVVAMSRYDLRIFLNALIAHEVSFAPIVPPIILNLVKNPIVDEFDLSKLKLQSVMTAAAPLAPELLTAFEAKFPNVQVQEAYGLTEHSCITLTHGDPEKGQGIAKRNSVGFILPNLEVKFIDPDTGRSLPKNTSGELCVRSQCVMQGYFMNKEETDKTIDEQGWLHTGDIGYIDDDGDIFIVDRIKELIKYKGFQVAPAELEAILLTHPSVEDVAVVPLPDEEAGEIPAACVVINPKATEKEEDILNFVAANVAHYKKVRAVHFVDSIPKSLSGKIMRRLLRDKILSINKK

SEQ ID NO: 14388 - protein, 139 aa, Arabidopsis thaliana
  misc_feature: Useful for making plants with modulated biomass
  misc_feature: Useful for making plants with modulated flowering time
MPLYDCMLLFKPIIRKEGLIDLVARIGKHVYSRNGVLTEIKSFGKVELGYGIRKLDGRHYQGQLMQITMMTTPNMNKELHYLNKEDKLLRWLLVKHRDIKIGQSEKEDSLTVPNRLTSGSLYDGSSSDEDDNNILGLSR

SEQ ID NO: 14389 - protein, 359 aa, Arabidopsis thaliana
  misc_feature: Useful for making plants with modulated water use efficiency
MKNGQCAQELQSSTQASHDSQGDQKTNLSIDAPIQDSGSVSASSNDSRKVSRQDIELVQNLIERCLQLYMNRDEVVKTLLTRARIDPGFTTLVWQKLEEENADFFRAYYIRLKLKKQIILFNHLLEHQYHLMKYPPGPPKVPLAPIQNGMHPMAPVNMPMGYPVLQHPQMHVPGHPHHLDAMGVSSCHVVNGVPAPANFHPLRMNTANDMVIDTTANDATPQVIPPNSGAMPEMVASPASVASSGHFPFAASDMSGMVMDTSVLDSAFTSDVGPDGEGAGNSRDSLRSFDQIPWNFSLSDLTADLSNLGDLGALGNYPGSPFLPSDSEIFLDSPEQEDIEEFFVDSVPGPRSNSDEEKP

SEQ ID NO: 14390 - protein, 626 aa, Arabidopsis thaliana
  misc_feature: Useful for making plants with altered cell wall content and/or composition
MGSRTTISILVVLLLGLVQLAISGHDYKQALSKSILFFEAQRSGHLPPNQRVSWRSHSGLYDGKSSGVDLVGGYYDAGDNVKFGLPMAFTVTTMCWSIIEYGGQLESNGELGHAIDAVKWGTDYFIKAHPEPNVLYGEVGDGKSDHYCWQRPEEMTTDRRAYKIDRNNPGSDLAGETAAAMAAASIVFRRSDPSYSAELLRHAHQLFEFADKYRGKYDSSITVAQKYYRSVSGYNDELLWAAAWLYQATNDKYYLDYLGKNGDSMGGTGWSMTEFGWDVKYAGVQTLVAKVLMQGKGGEHTAVFERYQQKAEQFMCSLLGKSTKNIKKTPGGLIFRQSWNNMQFVTSASFLATVYSDYLSYSKRDLLCSQGNISPSQLLEFSKSQVDYILGDNPRATSYMVGYGENYPRQVHHRGSSIVSFNVDQKFVTCRGGYATWFSRKGSDPNVLTGALVGGPDAYDNFADQRDNYEQTEPATYNNAPLLGVLARLISGSTGFDQLLPGVSPTPSPVIIKPAPVPQRKPTKPPAASSPSPITISQKMTNSWKNEGKVYYRYSTILTNRSTKTLKILKISITKLYGPIWGVTKTGNSFSFPSWMQSLPSGKSMEFVYIHSASPADVLVSNYSLE

SEQ ID NO: 14391 - protein, 706 aa, Arabidopsis thaliana
  misc_feature: Useful for making plants with modulated biomass
  misc_feature: Useful for making plants with modulated flowering time
MILMITAPVCPPHLLLRHSSLLRHESSIGNFHRKKNPRFRTVSCSSLLPQPSVRPDKASELKTLWKKFYKVASPYWFSEDKDQARLRLAAVFALTLATTGISVGFNFLGRDFYNSLANKDQEQFTKQLFYYLCAFAGGIPFFVLRDYTKETLSLRWRSWMTKYYLQRYLKDQTFYKIQSQSIIDNPDQRLVDDLSSFTGTALSFSLTLVNATIDLISFSNILFTIYPPLFLVLLLYSFGGTAISVFLGKGLVNLNFLQEKKEADFRYSLVRVRENAESIAFYGGEQNEMQLLLQRFRSAFDNLTELLIASRNLEFFTDGYRYLIQILPVAVVAPMYFSGKIEFGVINQSVSAFNHILGDFSLVVYQFQAISSFSAVIDRLGEFDDLLDNNIFRDPSDTVDEIELTYQSEMNSSLLDTNGSIKSQPNQKRLEIEELTLQTPTNGTTLVHNLSADVYDKDHLLIMGPSGSGKTSLLRAMAGLWRSGKGKITFYLDPEVDFTQEKSDTQENSGKRGDVLFLPQRPYMVLGSLRQQLLYPTWSATVEETTPGGSNIDGSPPLLIREDGNEKPTTDDLMRTLEKVCLGHIADRFGGLDSIHEWSSVLSLGEQQRLAFARLLLSQPKLALLDESTSALDEANEAFLYQQIQSAGITYISIGHRRTLTKFHNKILQISTADPKSNERNWRIEDVDAQDSLYGRLNQKEVPSES

SEQ ID NO: 14392 - protein, 495 aa, Arabidopsis thaliana
  misc_feature: Useful for making plants with altered sterol content
MVFSVSIFASLAPYLISAFLLFLLVEQLSYLFKKRNIPGPFFVPPIIGNAVALVRDPTSFWDKQSSTANISGLSANYLIGKFIVYIRDTELSHQIFSNVRPDAFHLIGHPFGKKLFGDHNLIYMFGEDHKSVRRQLAPNFTPKALSTYSALQQLVILRHLRQWEGSTSGGSRPVSLRQLVRELNLETSQTVFVGPYLDKEAKNRFRTDYNLFNLGSMALPIDLPGFAFGEARRAVKRLGETLGICAGKSKARMAAGEEPACLIDFWMQAIVAENPQPPHSGDEEIGGLLFDFLFAAQDASTSSLLWAVTLLDSEPEVLNRVREEVAKIWSPESNALITVDQLAEMKYTRSVAREVIRYRPPATMVPHVAAIDFPLTETYTIPKGTIVFPSVFDSSFQGFTEPDRFDPDRFSETRQEDQVFKRNFLAFGWGPHQCVGQRYALNHLVLFIAMFSSLLDFKRLRSDGCDEIVYCPTISPKDGCTVFLSRRVAKYPNFS

SEQ ID NO: 14393 - protein, 54 aa, Arabidopsis thaliana
  misc_feature: Useful for making plants with modulated nitrogen use efficiency
MSSNCGSCDCADKTQCVKKGTSYTFDIVETQESYKEAMIMDVGAEENNANCKCK

SEQ ID NO: 14394 - protein, 320 aa, Panicum virgatum
  misc_feature: Useful for making plants with altered carbohydrate content
MTWCNSLNDVRAVENNLATAAAVAAAKKQQQASSHVNLIRTCPSCGHRAQYEQLQAAATIQDLPGLPAGVKFDPTDQELLEHLEGKARPDARKLHPLIDEFIPTIEGENGICYTHPERLPGVGKDGLIRHFFHRPSKAYTTGTRKRRKVHTDEQGGETRWHKTGKTRPVFTNGKLKGYKKILVLYTNYGKQRKPEKTNWVMHQYHLGSDEEEKDGELVVSKVFYQTQPRQCGSGSATAKDVVPLAASAATTMDHHHHHHHDGGSGGSNSMLKEAAGIVDFYSPAALIGYNQAAPNNRAAFSAHLMPNFEVHTAGAAGFGP

SEQ ID NO: 14395 - protein, 155 aa, Arabidopsis thaliana
  misc_feature: Useful for making plants with modulated heat sensitivity
MDLGRFPIISILEDMLEVPEDHNNEKTRNNPSRVYMRDAKAMAATPADVIEHPNAYAFVVDMPGIKGDEIKVQVENDNVLVVSGERQRENKENEGVKYVRMERRMGKFMRKFQLPENADLDKISAVCHDGVLKVTVQKLPPPEPKKPKTIQVQVA

SEQ ID NO: 14396 - protein, 156 aa, Arabidopsis thaliana
  misc_feature: Useful for making plants with modulated drought sensitivity
  misc_feature: Useful for making plants with modulated water use efficiency
MDLEFGRFPIFSILEDMLEAPEEQTEKTRNNPSRAYMRDAKAMAATPADVIEHPDAYVFAVDMPGIKGDEIQVQIENENVLVVSGKRQRDNKENEGVKFVRMERRMGKFMRKFQLPDNADLEKISAACNDGVLKVTIPKLPPPEPKKPKTIQVQVA

SEQ ID NO: 14397 - protein, 495 aa, Panicum virgatum
  misc_feature: Useful for making plants with altered carbohydrate content
MPAMVEEVRAAAEAGAAGPHFLVVTYPAQGHINPARHLARRLLRATGARVTISTAASAFRKMFPGDEEGAAAGECHRDAAEVWYVPYSDGYDAGFDRAVHDHTHYMSQVRVVGSRTLGAVLERLRAAGRPVTLVVYTLLLSWVADVARGHGVPAALYWIQPATVLAAYLHFFRGTDGVDRAIAAAGGDPMATVRVPGLPPLRIRDLPSFIANTSEDDPYAFVADMFRELVDMLGREDSPSVLTNTFDAMEPEAVASLREHGVDIVPVGPVLSFLDEAPGAGCVSVAKNGGNDLFKQDGTGCLEWLDAQAPASVVYISFGSLSMMSKRQIEEVARGMAASGRPFLWVLREDNRSSEGAGDAASLGGERGMVVEWCDQVRVLSHPAVGCFVTHCGWNSTLESVACGVPTVGVPQWTDQGTNAWLVERLGAGVRAAVSDKDGVLEADELRRCLDFATSEMVRAKAAVWREKAHAAAAEGGSSERNLRAFVGKQLGGGN

SEQ ID NO: 14398 - protein, 394 aa, Arabidopsis thaliana
  misc_feature: Useful for making plants with modulated nitrogen use efficiency
MGSFGMLSRRTLGTDMPVMAQIRSLMAELTNPMSLAQGVVHWQPPQKALEKVKELVWDPIISSYGPDEGLPELRQALLKKLREENKLTNSQVMVTAGANQAFVNLVITLCDAGDSVVMFEPYYFNSYMAFQMTGVTNIIVGPGQSDTLYPDADWLERTLSESKPTPKVVTVVNPGNPSGTYVPEPLLKRIAQICKDAGCWLIVDNTYEYFMYDGLKHCCVEGDHIVNVFSFSKTYGMMGWRLGYIAYSERLDGFATELVKIQDNIPICAAIISQRLAVYALEEGSGWITERVKSLVKNRDIVKEALEPLGKENVKGGEGAIYLWAKLPEGHRDDFKVVRWLAHRHGVVVIPGCASGSPGYLRVSFGGLQEVEMRAAAARLRKGIEELLHHGMVE

SEQ ID NO: 14399 - protein, 512 aa, Panicum virgatum
  misc_feature: Useful for making plants with altered carbohydrate content
MAAELHFVLVPLLAQGHVLPMLDLARLLAGHGARATVVLTPVNVARNRPALEQAARAGLAVDFAELAFPGPALGLPEGLENLDMVTDVSLAVPFHDALWLLAEPLEAYLRSLPRRPDCLVADSCSPWAAGVARRLGIPPLLFHGPSAFFVLAAHNLERHGAYDSAPGDFEPLEVPDFPVRAVVSKATSPGLFHWPGLERQRRDLLEAEAAADGLLVNTCAALEGAFVERYAAALGRKVWAVGPLCLLNTGADTMAGRGNRAAMDAERIASWLDARPAASVLYVNFGSIARLFPAQVAELAAGLEASGRPFIWAGKDAAGLDAEFEARVKDRGLVVRGWAPQMTILSHGSVGGFLTHCGWNSTLEAVSHGVPLLTWPNFADQFLNEALAVDVLGVGVRAGVKVPATHVGHVKPGELLEVQVGRDDVGRVVAELMDDAARRARAQELADKARAAMAEGGSSDTDVRNMVLHIAELARKEAGVAPAPGVSEAASKSEEKKMGDADGTLPVASKVA

SEQ ID NO: 14400 - protein, 461 aa, Arabidopsis thaliana
  misc_feature: Useful for making plants with altered cell wall content and/or composition
MIERCLGAYRCRRIQRALRQLKVTILCLLLTVVVLRSTIGAGKFGTPEQDLDEIRQHFHARKRGEPHRVLEEIQTGGDSSSGDGGGNSGGSNNYETFDINKIFVDEGEEEKPDPNKPYTLGPKISDWDEQRSDWLAKNPSFPNFIGPNKPRVLLVTGSAPKPCENPVGDHYLLKSIKNKIDYCRLHGIEIFYNMALLDAEMAGFWAKLPLIRKLLLSHPEIEFLWWMDSDAMFTDMAFELPWERYKDYNLVMHGWNEMVYDQKNWIGLNTGSFLLRNNQWALDLLDTWAPMGPKGKIREEAGKVLTRELKDRPVFEADDQSAMVYLLATQRDAWGNKVYLESGYYLHGYWGILVDRYEEMIENYHPGLGDHRWPLVTHFVGCKPCGKFGDYPVERCLKQMDRAFNFGDNQILQIYGFTHKSLASRKVKRVRNETSNPLEMKDELGLLHPAFKAVKVQTNQV

SEQ ID NO: 14401 - protein, 492 aa, Panicum virgatum
  misc_feature: Useful for making plants with altered carbohydrate content
MGEEAAAVPPAVAAAAAPPHLLLICFPGQGHVNPMLRLAKRVAAKGLLVTFSSLASVGARLAAAAGVSAGGDGVPVGRGRVRFEFLEDGDPGSHLDDLMRHLETAGPPAFAALLRRQAEEGRPVACVVVNPFMPWASDVAAGEGIPTAVLWVQSCAVFSLYYHHVHGLVEFPPEDDPEARFQLPGLPEMSAADVPSFLLPSNPFKLLADAIITQFRTIERASWVLVNSFAELEPDVVAALPGVTPRPPELIPVGPLIELQQGQEDDEVRGDLIKAADDCVEWLDAQPPRSVVYASVGSVVVLSPGEVAEMAHGLASTGRPFLWVVRPDTQPHLPEGFLDSVSGRGAVVAWSPQERVLAHPSTACFLTHCGWNSTLETVAAGVPVVAFPQWGDQCTDARFLVEELGMGVRLRGARREAVREAVEAAVAGPCAGDMLASARRWSAAARAAVAPGGSSDAHVQAFVDEVARRARGGGAAKARAQAQPPPAVVTEA

SEQ ID NO: 14402 - protein, 236 aa, Oryza sativa
  misc_feature: Useful for biocontainment applications
MGRGKIEIKRIENTTNRQVTFCKRRNGLLKKAYELSVLCDAEVALIVFSSRGRLYEYANNSVKSTVERYKKANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGQQPAFN

SEQ ID NO: 14403 - protein, 1013 aa, Panicum virgatum
  misc_feature: Useful for making plants with altered carbohydrate content
MQSCSSQLPLLTPRHYSYSLPRTAAAALTFLSLLLSRHLVFTTVSHFTLQPSAHTQSSCTKGAREGGRRKAGGVRTEQLEMLSFSHSPIVSYLLWCLVLLALASSNGVGATAKPKVVGSGYKLVSLVQLPNGGGLVGYLQVKQRTSTYGPDIPRLRLFVKHETRERVRVQITDADKPRWEVPYNLLPREPAPPVTGGRVTGAPFTAAEYPGEELVFTYGRDPFWFAVHRRSTRQPLFNTSAGALLFKDQYLEVSTALPKDAALYGLGENTQPGGIRLRPNDPYTIYTTDISAINLNTDLYGSHPVYMDLRSLAGRGVAHAVLLLNSNGMDVFYRGTSLTYKVIGGLLDFYFFAGATPLAVVDQYTSMIGRSAPMPYWAFGFHQCRWGYKNLSVVEGVVEGYRNAQIPLDVIWNDDDHMDAAKDFTLDPVNYPRPKLLAFLDKIHAQGMKYIVLIDPGIAVNNSYGVYQRGMARDIFIKLDGQPYLAQVWPGPVYFPDFLNPNGVSWWIDEVRRFHDLVPVDGLWIDMNEASNFCTGKCTIPKKHQCPIPDSKTPWVCCLDCKNLTNTRWDEPPYKINASGQTARLGFNTIATSATHYNGILEYNAHSLYGFSQAIATHKALQGLQGKRPFILTRSTFVGSGAYAAHWTGDNKGTWENLRYSISTMLNFGIFGMPMVGSDICGFYPSPTEELCNRWIELGAFYPFSRDHANFASPRQELYVWESVAKSARNALGMRYKLLPYLYTLNYEAHLTGAPVARPVFFSFPDFTPCYGLSTQFLLGAGVMVSPVLEEGATSVRALFPPGTWYNLFDTTKVVVSKAGEAPVRLDAPLNEINVHVYQGTVLPMQRGGVISRDARATPFTLVVAFPLGAAQADAEGAVYVDDDERPEMALAEGQATYVRFHASVRGRAVTVRSEALMGSYSLRAGLVIEKLTVLGLEGTGKDISIVVDGADADAAAVATSSPYFAAGGGAKLQGEEGEGVEDSQRSVEVDVGGLALPLGKSFTVTWNMQIEA

SEQ ID NO: 14404 - protein, 679 aa, Panicum virgatum
  misc_feature: Useful for making plants with altered carbohydrate content
MGMDGGGGGGGGKLPYSYAGVGHQDGKLVKSFSRVEPRKFGMGLVAGFLLVTCAYFSTAKFDAIHIAMVSPISTDAAGIGSLATAAADTSKQQLDLGVQDRNALSKEGSRAEVLEKDDGNASSSGPDSGRNAPLEDTRRDETFVGGSGDAGAGVDASSAAATNPAGEGEVPAKDDDATAAVLPPVSLEEAANGTQESGVLEDAELQFQEAVAELPSKKSNDSAAAAAASGNGSNSPTVVHSDPAILPAPVQQIPPAIQEVKALADQQIPAVPEVKQADSETPAREWKPLCDLTSNRRIDWCELDGDVRVLGANASVTLVAPPAADARTFREESWRIKPYPRKADPNAMRNVRVVTVRSVSAGAPACTDRHDDVPALVFSDRGYTGNYFHAYTDVILPLFLTARRYAGEVLLLVTDLQMWWVGKFLPVFKSISNYEPVDLDHDPRVHCFRHVQVGLTNHDDFSIDPRRAPNGYSMLDFTKFMRTTYGLPRDVAWPAAANATAGRSRPRLLLIARARTRRFVNTDEIVRGAEKVGFEVAVSEGEHEVAPFAELANSCDAIMGVHGAGLTNMVFVPTGGVVIQVVPLGGLEFVAGYFRGPSRDMGLRYLEYRITPEESTLIDQYPRDHVIFTDPEGVKNKGWESLKDAYLDKQDVRLDMRRFRPTLKKAMAHLRKAKADDAN

SEQ ID NO: 14405 - protein, 635 aa, Panicum virgatum
  misc_feature: Useful for making plants with altered carbohydrate content
MKGGGAGDKAGRGGGKLQQPLRLESQRFRLLSIVVGCFVICLVFLLSSRPDATAFDTVSPRASLEGARRRPAAVKTLQTSSTAGVGGDVHVDIRPQQQQGGSLRQSVEQSAGDKTATEWVRDTVIVEERSDAEASEAAAEPEEAERNVDGNAAAAASNPDDQPAPGAETEEVRDAAATATAQPAAETTATAPDRPEGKPRAAGGGQSKLQEQPARQPQEERHEPARRGNGTAKATPDQTLSTGSNGGDHQQPLCDFSDFRSDICDMAGDIRMDANASAFVVVDPAASGADGGQWHRVRPYPRKGDETCMGRITEVTVRSAGGAAPRCTREHAAPAVVFSIGGYTGNIFHDFSDVLVPLYNTARRYGGDVQLVMADVSSWWLVKYDKLLRALSRHAPQDLARAGAAGEVHCFRRAVVSLRAHKELIIERARSADGLATPDFTRFVRRALSLPRDAPTRLGDGTGRKPRLLVISRHHTRLLLNLDAVVRAAEEVGFEAVVNESDVGNDIAQVGALVNSCDALVGVHGAGLTNMMFLPPGATLVQIVPWGGLQWMARADYGDPAEAMGLRYIQYEVAVGESTLKDKFPPGHKIFTDPTSLHKKGFMFIRQTLMDGQDIAVDVGRFREVLLQVLNNLSQ

SEQ ID NO: 14406 - protein, 362 aa, Arabidopsis thaliana
  misc_feature: Useful for making plants with modulated phosphate use efficiency
MARMSLMIMMIMVAVTMINIAKSDPIAPCYFIFGDSLVDNGNNNQLQSLARANYFPYGIDFAAGPTGRFSNGLTTVDVIAQLLGFEDYITPYASARGQDILRGVNYASAAAGIRDETGRQLRGRIAFAGQVANHVNTVSQVVNILGDQNEASNYLSKCIYSIGLGSNDYLNNYFMPTFYSTGNQFSPESYADDLVARYTEQLRVLYTNGARKFALIGVGAIGCSPNELAQNSRDGRTCDERINSANRIFNSKLISIVDAFNQNTPDAKFTYINAYGIFQDIITNPARYGFRVTNAGCCGVGRNNGQITCLPGQAPCLNRNEYVFWDAFHPGEAANIVIGRRSFKREAASDAHPYDIQQLASL

SEQ ID NO: 14407 - protein, 543 aa, Arabidopsis thaliana
  misc_feature: Useful for making plants with altered cell wall content and/or composition
MGITTALLLVMLMSVHTSSYETTILKPYKEDNFRSLVAKACQFIDAHELCVSNIWTHVKESGHGLNPHSVLRAAVKEAHDKAKLAMERIPTVMMLSIRSREQVAIEDCKELVGFSVTELAWSMLEMNKLHGGGGIDLDDGSHDAAAAGGNLKTWLSAAMSNQDTCLEGFEGTERKYEELIKGSLRQVTQLVSNVLDMYTQLNALPFKASRNESVIASPEWLTETDESLMMRHDPSVMHPNTVVAIDGKGKYRTINEAINEAPNHSTKRYVIYVKKGVYKENIDLKKKKTNIMLVGDGIGQTIITGDRNFMQGLTTFRTATVAVSGRGFIAKDITFRNTAGPQNRQAVALRVDSDQSAFYRCSVEGYQDTLYAHSLRQFYRDCEIYGTIDFIFGNGAAVLQNCKIYTRVPLPLQKVTITAQGRKSPNQNTGFVIQNSYVLATQPTYLGRPWKLYSRTVYMNTYMSQLVQPRGWLEWFGNFALDTLWYGEYNNIGPGWRSSGRVKWPGYHIMDKRTALSFTVGSFIDGRRWLPATGVTFTAGLAN

SEQ ID NO: 14408 - protein, 255 aa, Arabidopsis thaliana [sequence omitted]

SEQ ID NO: 14409 - protein, 454 aa, Arabidopsis thaliana
  misc_feature: Useful for making plants with modulated nitrogen use efficiency
MEAGERRNGDSMSHNHRAPKKPRLAGLLTESDIDSEFAHHQTGVARINNGSFGCCPGSVLEAQREWQLRYLRQPDEFYFNGLRRGLLASRTVISDLINADDVDEVSLVDNATTAAAIVLQKVGRCFSEGKYKKEDTVVMFHCAFQSVKKSIQAYVSRVGGSTVEVRLPFPVNSNEEIISKFREGLEKGRANGRTVRLAIIDHITSMPCVLMPVRELVKICREEGVEQVFVDAAHAIGSVKVDVKEIGADYYVSNLHKWFFCPPSIAFFYCKKRGSESDVHHPVVSHEFGNGLPIESAWIGTRDYSSQLVVPSVMEFVNRFEGGMEGIMMKNHDEAVRMGLMLADAWGTNLGSPPEMCVGMVMIGLPSKLCVGSDEDAIKLRSYLRVHYSVEVPVFYLGLRDGEEGVKDKDSGLITAYVRISHQVYNKTEDYERLRDAITELVKDQMTCQNLPAL

SEQ ID NO: 14410 - protein, 368 aa, Arabidopsis thaliana
  misc_feature: Useful for making plants with modulated biomass
  misc_feature (294)..(294): Xaa is any aa, unknown, or other
MQSLMPALSKTLIAKLLVRHAPRPTWSWFSVRSPPRLRLTTRRLSVTLAVPLDSSLTMLVLMHKCKVLVNIEQQSPDIAQGVHGHFTKRPEDIGAGDQGHMFGYATDETPELMPLSHVLATKIGARLTEVRKNGTCRWLRPDGKTQVTVEYYNDNGAMVPVRVHTVLISTQHDETVTNDEIARDLKEHVIKPIIPEKYLDDKTIFHLNPSGRFVIGGPHGDAGLTGRKIIIDTYGGWGAHGGGAFSGKDPTKVDRSGAYIVRQAAKSVVANGMARRALVQVSYAIGVPEPLSVXVDTYGTGLIPDKEILKIVKETFDFRPGMMTINLDLKRGGNGRFQKTAAYGHFGRDDPDFTWEVVKPLKWDKPQA

SEQ ID NO: 14411 - protein, 491 aa, Arabidopsis thaliana
  misc_feature: Useful for making plants with altered cell wall content and/or composition
MLTSTYNRNQVLGFMTLILTLMSLSEARNHHHKEKHKHNNHNHHSSKPKPPSSSISQPPTPPPGPPDSPAPSLPPSPSDDPADDNNGIYNVRKYGAVGDGETDDTEAFKTAWDSSCNNENNTDSVLLVPYGYTFMIQSTIFTGPCRSYQFFQVDGTIVTPDGPESWPSNISKRQWLVFYRVNGMALKGEGVIDGRGQKWWDLPCKPHRSVNKSAIVTGPCDSPIALRFFMSSNLRVEGLQIKNSPQFHFRFDGCQGVHVESLHITAPPLSPNTDGIHIENSNSVTIYNSIISNGDDCVSIGSGSYDVDIRNLTCGPGGHGISIGSLGNHNSRACVSNITVRDSVIKYSDNGVRIKTWQGGSGSVSGVTFNNIHVDSVRNPIIIDQYYCMTKDCANKTSAVFVSDIAYQGIKGTYDIRSPPMHFGCSDAVPCTNLTLSDIELLPAKGEIVLDPFCWNAYGIAEELSIPPVWCLMSDPPKGLQGSLVDKCGSS

SEQ ID NO: 14412 - protein, 573 aa, Arabidopsis thaliana
  misc_feature: Useful for making plants with altered cell wall content and/or composition
MLSLKLFLVTLFLSLQTLFIASQTLLPSNSSSTICKTTPDPKFCKSVFPQTSQGDVREYGRFSLRKSLTQSRKFTRTIDRYLKRNNALLSQSAVGALQDCRYLASLTTDYLITSFETVNITTSSKTLSFSKADEIQTLLSAALTNEQTCLDGINTAASSSWTIRNGVALPLINDTKLFSVSLALFTKGWVPKKKKQVASYSWAHPKNTHSHTKPFRHFRNGALPLKMTEHTRAVYESLSRRKLADDDNDVNTVLVSDIVTVNQNGTGNFTTITEAVNSAPNKTDGTAGYFVIYVTSGVYEENVVIAKNKRYLMMIGDGINRTVVTGNRNVVDGWTTFNSATFAVTSPNFVAVNMTFRNTAGPEKHQAVAMRSSADLSIFYSCSFEAYQDTLYTHSLRQFYRECDIYGTVDFIFGNAAVVFQDCNLYPRQPMQNQFNAITAQGRTDPNQNTGISIHNCTIKPADDLVSSNYTVKTYLGRPWKEYSRTVFMQSYIDEVVEPVGWREWNGDFALSTLYYAEYNNTGSGSSTTDRVVWPGYHVINSTDANNFTVENFLLGDGWMVQSGVPYISGLLS

SEQ ID NO: 14413 - protein, 598 aa, Arabidopsis thaliana
  misc_feature: Useful for making plants with modulated time to senescence
MGYERLGPSGATGSVTTSTTTAPILNQVSTSEQPENNNRRSKKKLVVSSIVLAISLILAAAIFAGVRSRLKLNQSVPGLARKPSQAISKACELTRFPELCVDSLMDFPGSLAASSSKDLIHVTVNMTLHHFSHALYSSASLSFVDMPPRARSAYDSCVELLDDSVDALSRALSSVVSSSAKPQDVTTWLSAALTNHDTCTEGFDGVDDGGVKDHMTAALQNLSELVSNCLAIFSASHDGDDFAGVPIQNRRLLGVEEREEKFPRWMRPKEREILEMPVSQIQADIIVSKDGNGTCKTISEAIKKAPQNSTRRIIIYVKAGRYEENNLKVGRKKINLMFVGDGKGKTVISGGKSIFDNITTFHTASFAATGAGFIARDITFENWAGPAKHQAVALRIGADHAVIYRCNIIGYQDTLYVHSNRQFFRECDIYGTVDFIFGNAAVVLQNCSIYARKPMDFQKNTITAQNRKDPNQNTGISIHASRVLAASDLQATNGSTQTYLGRPWKLFSRTVYMMSYIGGHVHTRGWLEWNTTFALDTLYYGEYLNSGPGSGLGQRVSWPGYRVINSTAEANRFTVAEFIYGSSWLPSTGVSFLAGLSI

SEQ ID NO: 14414 - protein, 102 aa, Zea mays subsp. mays
  misc_feature: Useful for making plants with modulated nitrogen use efficiency
MERVASSCCVSLLAQSRRAYTMAAAMAKKGAAARRVDEKKAAAALTKRVMGKKEVNTAAAAAAEEKAWVPDPVTGYYRPAGSAKEVDAAELRSKLLTEAAAN

SEQ ID NO: 14415 - protein, 546 aa, Panicum virgatum
  misc_feature: Useful for making plants with altered carbohydrate content
MVHHHRASLLAPQQRKVEAAAEDPEQGGGGRMKELRRRLADYACHHHRKHGHDALLRMLAGFALASCLLLLLPGSPIVSGAMDELLQLGRRVRRDQEAAPPFAADDVADGTVCCDRSSHRTDVCVMRGDVRTQAASNSLFLLVPPNASSRAAAAADERIRPYTRKWESGIMSTVDELRLRSAPEGDAAAPARCDVRHGVPAVVFSTGGYTGNVYHEFNDGIIPLYITARRYNKKVVFVMLEYHDWWMTKYGHIVEQLSDYPPVDFANDRRTHCFPEAVVGLRIHDELAIDAARTPANQTIQDFRQMLDDAHRGRIQTIIEEEEKEAVAAAAAAAAAAAAARKQQHRGSQRIRRTRTAEDDDSPRLVIVSRNGSRAIENEAELVRAAAGAGFRVSVLQPRPDTELAKMYRALNASDVMVGVHGAAMTHFLFMRPGSVFIQVVPLGTDWAAETYYGEPARRLGLRYMPYKILPSESSLRGQYAKDDPVLTDPDTVNAKGWQVTKQVYLDGQNVRLDIARFRRHLHRARDHWATRRRATARTGSGAEQR

SEQ ID NO: 14416 - protein, 344 aa, Arabidopsis thaliana
  misc_feature: Useful for making plants with altered cell wall content and/or composition
MGHRTRMILVLTLVVMSIWGSDASAMQKTKFDAPLLTEKIATNRSIIVDIEGKGDYTSVQKAIDAVPVGNSNWIIVHVRKGIYKERVHIPENKPFIFMRGNGKGKTVIESSQSSVDNVASATFKVEANHFVAFGISIRNDAPVGMAFTSENQSVAAFVAADKVAFYHCAFYSLHNTLFDNKGRHYYHECYIQGSIDFIFGRATSIFNNCEIFVISDKRVKPYGSITAHHRESAEEKTGYVFIRGKVYGIDEVYLGRAKGPYSRVIFAKTYLSKTVVPDGWTNWSYHGSTQNLYHGEYKCHGPGAERQKRSDWAKDLTKQEVESFLSIDFIDGTSWLPVWLQEKF

SEQ ID NO: 14417 - protein, 1808 aa, Arabidopsis thaliana
  misc_feature: Useful for making plants with altered cell wall content and/or composition
MEASSSGTAELPRSLSRRAPSRATTMMIDRPNEDASAMDSELVPSSLASIAPILRVANEIEKDNPRVAYLCRFHAFEKAHRMDATSSGRGVRQFKTYLLHRLEKEEEETKPQLAKNDPREIQAYYQNFYEKYIKEGETSRKPEEMARLYQIASVLYDVLKTVVPSPKVDYETRRYAEEVERKRDRYEHYNILPLYAVGTKPAIVELPEVKAAFSAVRNVRNLPRRRIHLPSNTPNEMRKARTKLNDILEWLASEFGFQRGNVANQREHIILLLANADIRKRNDEEYDELKPSTVTELMDKTFKSYYSWCKYLHSTSNLKSDVGCFNFILKRFPDDCDKQQLQLIYISLYLLIWGEASNMANDVYGILFSNVEAVSGETYETEEVIDEESFLRTVITPIYQVIRNEAKRNKGGTASHSQWRNYDDLNEYFWSKKCFKIGWPLDLKADFFLNSDEITPQDERLNQVTYGKSKPKTNFVEVRTFWNLFRDFDRMWIFLVMAFQAMVIVGWHGSGSLGDIFDKDVFKTVLTIFITSAYLTLLQVAFMWAVLLPIAYSKSVQRPTGVVKFFSTWTGDWKDQSFYTYAVSFYVLPNILAALLFLVPPFRRAMECSDMRPIKVIMWWAQATTNNIGVVIAIWAPIVLVYLMDTQIWYAIFSTLFGGIHGAFSHLGEIRTLGMLRSRFESIPIAFSRTLMPSEDAKRKHADDYVDQKNITNFSQVWNEFIYSMRSEDKISDRDRDLLLVPSSSGDVSVIQWPPFLLASKIPIAVDMAKDFKGKEDAELFRKIKSDSYMYYAVIESYETLKKIIYALLEDEADRRVMNQVFLEVDMSMQQQRFIYEFRMSGLPLLSDKLENDYEDQGTYKSQLINVFQDVIEIITQDLLVNGHEILERARVHSPDIKNEKKEQRFEKINIHLVRDRCWREKVIRLHLLLSVKESAINVPQNLEARRRITFFANSLFMNMPSAPRIRDMLSFSVLTPYYKEDVLYSEEDLNKENEDGISILFYLQKIYPDEWTNYLDRLKDPKLPEKDKSEFLREWVSYRGQTLARTVRGMMYYRQALELQCYQEVAGEQAEFSVFRAMASNDENQKAFLERARALADLKFTYVVSCQVYGNQKKSGDIHNRSCYTNILQLMLKEETADAKSPKVFYSVLLKGGDKFDEEIYRIKLPGPPAEIGEGKPENQNHAIIFTRGEALQTIDMNQDNYFEEAFKLRNVLEEFNKERVGRRKPTILGLREHIFTGSVSSLAWFMSNQESSFVTIGQRILANPLRVRFHYGHPDIFDRIFHITRGGVSKASKVINLSEDIFGGFNSTLRGGYVTHHEYIQVGKGRDVGLNPISIFEAKVANGNGEQTLSRDVYRLGHRFDFYRMLSFYFTTIGFYFSSMLTVLTVYAFLYGRMYMVMSGLEKEILRLASPNQLEALEQALATQSIFQLGFLMVLPMVMEIGLEHGFRSAIVDFFIMQLQLASVFFTFQLGTKSHYYGRTILHGGSKYRPTGRGFVVFHAKFAENYRLYSRSHFVKGLELLLLLVVYQIYGHSYRSSNLYLYITVSMWFMVGSWLFAPFIFNPSGFEWQKTVDDWTDWKRWLGDRGGIGIPVEKSWESWWNVEQEHLKHTSIRGRILEITLALRFFIYQYGIVYQLNISQRSKSFLVYGLSWVVLLTSLLVLKMVSMGRRRFGTDFQLMFRILKALLFLGFLSVMTILFVVFKLTLTDLSASVLAFLPTGWAILLIGQVLRSPIKALGVWDSVKELGRAYENIMGLVIFAPIAVLSWFPIVSEFQARLLFNQAFSRGLQISMILAGRKDKATSSHK

SEQ ID NO: 14418 - protein, 786 aa, Arabidopsis thaliana
  misc_feature: Useful for making plants with altered cell wall content and/or composition
MSIYTIVLLFLFHSRKRKFYITTMVSLSFILCCVLVSSCAYATIVSHDGRAITIDGHRRVLLSGSIHYPRSTTEMWPDLIKKGKEGSLDAIETYVFWNAHEPTRRQYDFSGNLDLIRFLKTIQNEGMYGVLRIGPYVCAEWNYGGFPVWLHNMPGMEFRTTNTAFMNEMQNFTTMIVEMVKKEKLFASQGGPIILAQIENEYGNVIGSYGEAGKAYIQWCANMANSLDVGVPWIMCQQDDAPQPMLNTCNGYYCDNFSPNNPNTPKMWTENWTGWYKNWGGKDPHRTTEDVAFAVARFFQKEGTFQNYYMYHGGTNFDRTAGGPYITTTYDYDAPLDEFGNLNQPKYGHLKQLHDVLHAMEKTLTYGNISTVDFGNLVTATVYQTEEGSSCFIGNVNETSDAKINFQGTSYDVPAWSVSILPDCKTETYNTAKINTQTSVMVKKANEAENEPSTLKWSWRPENIDSVLLKGKGESTMRQLFDQKVVSNDESDYLWYMTTVNLKEQDPVLGKNMSLRINSTAHVLHAFVNGQHIGNYRVENGKFHYVFEQDAKFNPGANVITLLSITVGLPNYGAFFENFSAGITGPVFIIGRNGDETIVKDLSTHKWSYKTGLSGFENQLFSSESPSTWSAPLGSEPVVVDLLGLGKGTAWINGNNIGRYWPAFLSDIDGDNTLVLFEEIGGNPSLVNFQTIGVGSVCANVYEKNVLELSCNGKPISAIKFASFGNPGGDCGSFEKGTCEASNNAAAILTQECVGKEKCSIDVSEDKFGAAECGALAKRLAVEAIC

SEQ ID NO: 14419 - protein, 206 aa, Arabidopsis thaliana
  misc_feature: Useful for making plants with modulated carbon-nitrogen partitioning
MFAIKSAKVVNLVGVLETVLISCIQGTGALAVATKLPELRPPTCHHGEACIPATAFQMTILYVSLYLIALGTGGLKSSISGFGSDQFDDKDPKEKAHMAFFFNRFFFFISMGTLLAVTVLVYMQDEVGRSWAYGICTVSMAIAIVIFLCGTKRYRYKKSQGSPVVQIFQVIAAAFRKRKMELPQSIVYLYEDNPEGIRIEHTDQFQ

SEQ ID NO: 14420 - protein, 427 aa, Arabidopsis thaliana
  misc_feature: Useful for biocontainment applications
  misc_feature: Useful for making plants with modulated biomass
  misc_feature: Useful for making plants with modulated cold sensitivity
MGDARDNEAYEEELLDYEEEDEKVPDSGNKVNGEAVKKGYVGIHSSGFRDFLLKPELLRAIVDSGFEHPSEVQHECIPQAILGMDVICQAKSGMGKTAVFVLSTLQQIEPSPGQVSALVLCHTRELAYQICNEFVRFSTYLPDTKVSVFYGGVNIKIHKDLLKNECPHIVVGTPGRVLALAREKDLSLKNVRHFILDECDKMLESLDMRRDVQEIFKMTPHDKQVMMFSATLSKEIRPVCKKFMQDPMEIYVDDEAKLTLHGLVQHYIKLSEMEKNRKLNDLLDALDFNQVVIFVKSVSRAAELNKLLVECNFPSICIHSGMSQEERLTRYKSFKEGHKRILVATDLVGRGIDIERVNIVINYDMPDSADTYLHRVGRAGRFGTKGLAITFVASASDSEVLNQVQERFEVDIKELPEQIDTSTYMPS

SEQ ID NO: 14421 - protein, 470 aa, Arabidopsis thaliana
  misc_feature: Useful for making plants with altered cell wall content and/or composition
MKTVKSLPILAMLLGVIIVAAAISTVSVEGRKHHVKKIKPKHRRHSKNTPTGSPAPAPYPSTNEGVFNIFSYGAKGDGVSDDSKALVGAWKAACKVVGGKVEIPAGTQFLVKAVTLQGPCKEETVVQIEGILVAPEKIGSWPNSSLFQWLNFKWVSHLTIQGSGTLNGRGYNWWNLDTYQTQTRNKYIPPMKPTALRFYSSNNVTVRDISIVNSPLCHLKFDDSDGVKVNNITISSPENSPNTDGIHLQNTRNVEIQHSNIACGDDCVSIQTGSSNVHIHHINCGPGHGISIGGLGKDKSVACVSDIIVEDISIQNTLAGVRIKTWQGGLGVVKNLTFSNIQVKDVKVPIVIDQYYCDKSKCKNQTRAVSISGVKYNNIVGSFTVQPVRIACSNNVPCMDVDLMDIRLRPSGGIRGLQTHQQQQALCWNSYGKTQGPLVPSSIGYCLRKSNIGGYYSQKVSRSYDKICPS

SEQ ID NO: 14422 - protein, 505 aa, Arabidopsis thaliana [sequence omitted]

SEQ ID NO: 14423 - protein, 122 aa, Zea mays
  misc_feature: Useful for making plants with altered alkaloid content
MDDMTIEPGNTKRQLTQSGDEKSENKAKSKADELASGTDCKSVQKQKIKWKKIITKTLKANADGVMKLKKLQKIVSKELQECGVSKDKEELRATLMDKIASSSRFSVDGKNVRLVAKNEEES

SEQ ID NO: 14424 - protein, 261 aa, Arabidopsis thaliana
  misc_feature: Useful for making plants with modulated nitrogen use efficiency
MAGLFDKQADLYLDARPNYPSEWFSKLADLTDHHGLAWDAATGNGQAALAVAEHYESVVATDVSESQLKLATPHPKINYRLTPTSMTDDELVELIGGENSVDLITVAQGVHWFDLPRFYSVATRLLRKPGGIIAVWGYNDVIVSPEFDAVQYRLHATTLPFWKYPYIQHIFDSYEALPFPFENVGMGSEGEPLKLEMPKTTSFEGIIRMFKSWSAIVTAREKGVELLPESLVRELETAWGGSDLVRSVVYKAFMIAGKVRV

SEQ ID NO: 14425 - protein, 524 aa, Arabidopsis thaliana
  misc_feature: Useful for making plants with modulated flowering time
MAHRQLYSYALQPSYAAAASTVSPAPPPPQQPLPPKTGLSSLYGSSADHYFPDTTYRFLARDGSEALSNYSGTLASSSSMYHHLPNTTASHLAYPQLLQHQEVAWPPGVEVPGAASAVEPLPPGVKRTSEALYYPTLLGAHNTIGQTEAWYTTDYFTKRPKLESTSHLPIYPQRAGEKDCTHYMQTRTCKFGESCRFDHPIWVPEGGIPDWKEAPVVPNEEYPERPGEPDCPYYIKTQRCKYGSKCKFNHPREEAAVSVETQDSLPERPSEPMCTFYMKTGKCKFGLSCKFHHPKDIQLPSSSQDIGSSVGLTSEPDATNNPHVTFTPALYHNSKGLPVRSGEVDCPFYLKTGSCKYGATCRYNHPERTAFIPQAAGVNYSLVSSNTANLNLGLVTPATSFYQTLTQPTLGVISATYPQRPGQSECDYYMKTGECKFGERCKFHHPADRLSAMTKQAPQQPNVKLSLAGYPRREGALNCPYYMKTGTCKYGATCKFDHPPPGEVMAKTTSEADAAGATNTDTTQ

SEQ ID NO: 14426 - protein, 997 aa, Arabidopsis thaliana
  misc_feature: Useful for making plants with modulated heat sensitivity
MSSSTLQASLFLRPPLHTSSFKLYPCLFSSSSLSFCPQSLSSFYRLSSVLHNSRFRPLPCSLRQDNVASDSDFIPKDSAFEVTDSAESNRLVSDTEVSELETNDRFVGGEETKSGGEEAEVSNGVTEGKEEDQKKSKFRIVVLMMALWAAIKRAIEKVMEWEWLSWWPFSRQEKRLEKLIAEADANPKDAALQGALLAELNKHIPEAVVQRFEQREHTVDSRGVAEYIRALVITNAISEYLPDEQTGKPSSLPALLQELKHRASGNMDESFVNPGISEKQPLHVTMVNPKVSNKSRFAQELVSTILFTVAVGLVWIMGAAALQKYIGSLGGIGTSGVGSSSSYSPKELNKEITPEKNVKTFKDVKGCDDAKQELEEVVEYLKNPSKFTRLGGKLPKGILLTGAPGTGKTLLAKAIAGEAGVPFFYRAGSEFEEMFVGVGARRVRSLFQAAKKKAPCIIFIDEIDAVGSTRKQWEGHTKKTLHQLLVEMDGFEQNEGIIVMAATNLPDILDPALTRPGRFDRHIVVPSPDVRGREEILELYLQGKPMSEDVDVKAIARGTPGFNGADLANLVNIAAIKAAVEGAEKLSSEQLEFAKDRIVMGTERKTMFVSEDSKKLTAYHESGHAIVALNTKGAHPIHKATIMPRGSALGMVTQLPSNDETSVSKRQLLARLDVCMGGRVAEELIFGLDHITTGASSDLSQATELAQYMVSSCGMSEAIGPVHIKERPSSDMQSRIDAEVVKLLREAYERVKSLLKRHEKQLHTLANALLEYETLTAEDIKRILLPKQEGEKFEEQQQEEGDLVLALTAYHESGHAIVALNTKGAHPIHKATIMPRGSALGMVTQLPSNDETSVSKRQLLARLDVCMGGRVAEELIFGLDHITTGASSDLSQATELAQYMVSSCGMSEAIGPVHIKERPSSDMQSRIDAEVVKLLREAYERVKSLLKRHEKQLHTLANALLEYETLTAEDIKRILLPKQEGEKFEEQQQEEGDLVLA

SEQ ID NO: 14427 - protein, 447 aa, Panicum virgatum
  misc_feature: Useful for making plants with altered carbohydrate content
MAAPPLLLLVLVGALALLALEQVARCDAAATCVGVAPAKRRPEVVSIADFGGVGDGRTLNTWAFRKAVYRIQHRRRRGGTELRVPAGTWLTGSFNLTSHMTLFLARGAVLKATRDAAGWPLVEPLPSYGRGRELPGPRYASFINGNGLRDVVITGDKGVIDGQGEVWWNMWRQRTLQHTRPNLVEFMHSTGIHISNIVLKNSPFWNIHPVYCDNVVVTNMMILAPHDSPNTDGVDPDSSTNVCIEDSYISTGDDLVAIKSGWDEYGIAYGRPSSGITIRRVRGSSPFSGIAIGSEASGGVRDVLVEDCSIFNSGYGIHIKTNVGRGGYIRNVTVDNVRMSGVRSGVRIAGDVGDHPDGRFSQLAVPTVDAVRIRNVWGVGVQQPGSLEGIRNSPFTRICLSNVKLFGWRSGAAWRCRDVRGAALGVHPSPCAELATSFASAAGSCSY

SEQ ID NO: 14428 - protein, 449 aa, Arabidopsis thaliana
  misc_feature: Useful for making plants with altered cell wall content and/or composition
MKISQAPISVFVLFLLSTVLPHHLSLGAPITCSGIVPMKHRNEMLSISDFGAVGDGKTLNTKAFNSAIDRIRNSNNSNEGTLLYVPRGVYLTQSFNLTSHMTLYLADGAVIKAVQDTEKWPLTDPLPSYGRGREHPGRRYISFIHGDGLNDVVITGRNGTIDGQGEPWWNMWRHGTLKFTRPGLIEFNNSTNILVSHVVLQNSPFWTLHPVYCSNVVVHHVTILAPTDSYNTDGIDPDSSSNVCIEDSYISTGDDLVAVKSGWDEYGIAYNRPSRDITIRRITGSSPFAGIAIGSETSGGIQNVTVENITLYNSGIGIHIKTNIGRGGSIQGITISGVYLEKVRTGIKISGDTGDHPDDKFNTSALPIVRGITIKNVWGIKVERAGMVQGLKDSPFTNLCFSNVTLTGTKRSPIWKCSDVVGAADKVNPTPCPELSATTQQGGSCENQS

SEQ ID NO: 14429 - protein, 247 aa, Panicum virgatum
  misc_feature: Useful for making plants with altered carbohydrate content
MQRDPTAFVGNPSFAYGYEADGCAVNGPLSGQCNYRVPVSPALGVPSGMTSPKMRSQLDAFEFQPSKVCPRNFIIFDHNDDKGRIVYHPALVNKLNPTNINAFPCRGEVICRSSDQDDGNLEQHASSFKEDTEEINALLNSESDEDSDEDDIMSTGRSLDPLELGPCESSSPPRFKKMRHFSGNGSNFDESLENITHEEIRKMVTVLRGIIPGGDQLDAPDVLEEAVRYLKFLKVEAEKLGVVGFNA

SEQ ID NO: 14430 - protein, 606 aa, Arabidopsis thaliana
  misc_feature: Useful for making plants with altered cell wall content and/or composition
MQQDNRKKNNLEMEFFSDYGDANRFKVQEVIGKGSYGVVCSAIDTLTGEKVAIKKIHDIFEHISDAARILREIKLLRLLRHPDIVEIKHIMLPPSRREFKDIYVVFELMESDLHQVIKANDDLTREHYQFFLYQLLRALKYIHTANVYHRDLKPKNILANANCKLKICDFGLARVAFNDTPTTIFWTDYVATRWYRAPELCGSFYSKYTPAIDIWSIGCIFAEVLMGKPLFPGKNVVHQLDLMTDLLGTPSLDTISRVRNEKARRYLTSMRKKPPIPFAQKFPNADPLSLKLLERLLAFDPKDRPTAEEALADPYFKGLAKVEREPSCQPITKMEFEFERRKVTKEDIRELISREILEYHPQLLKDHMNGADKASFLYPSAVDQFRRQFAHLEENSGKTGPVAPLERKHASLPRSTVIHSTAVARGGQPKLMNNTNTLNPETTQNIPFNHATIQAQQRNLSAAKPSTFMGPVAPFDNGRISRDAYDPRSFIRSTNLPFSQQSAATVAMGKQQERRTTMEPEKQARQISQYNRYAPDVAINIDNNPFIMARTGMNKAENISDRIIIDTNLLQATAGIGVAAAAAAAAPGGSAHRKVGAVRYGMSKMY

SEQ ID NO: 14431 - protein, 352 aa, Arabidopsis thaliana
  misc_feature: Useful for making plants with altered cell wall content and/or composition
MGLYKTKSKRSIANYHHIIIINIFILSSITSSSMASSSSPSSIDFSTAILIRVDQSGKGDFSKIQEAIESIPPNLNNSQLYFIWVKPGIYREKVVIPAEKPYITLSGTQASNTFLIWSDGEDILESPTLTIFASDFVCRFLTIQNKFGTAGRAVALRVAADKAAFYGCVITSYQDTLLDDNGNHYFKNCYIEGATDFICGSASSLYERCHLHSLSPNNGSITAQMRTSATEKSGFTFLGCKLTGSGSTFLGRPWGAYSRVVFAYSFFSNVVAPQGWNQWGDSTKENTVYYGEYKCYGPGADREQRVEWSKQLSDEEATVFLSKDFIGGKDWLRPAPSHFKNAPKQTQNKEIN

SEQ ID NO: 14432 - protein, 542 aa, Arabidopsis thaliana
  misc_feature: Useful for making plants with altered cell wall content and/or composition
MVNIKSPLRLFIEESIKELIRGFRRQRIKWRNAFLLGSIMTTIVVLLHTPTFSVFSDEEETESSSSSPIYLNGSLHLNIHIVSSEAKVENFHTLRTRTPIVQLNASEASEAVLSRKRRKRKKRKKTKDDLILTDPPPAPRHVLSSSERRALSLPPKKALTYAKLEIQRAPEVINDTDLFAPLFRNLSVFKRSYELMELILKVYIYPDGDKPIFHEPHLNGIYASEGWFMKLMESNKQFVTKNPERAHLFYMPYSVKQLQKSIFVPGSHNIKPLSIFLRDYVNMLSIKYPFWNRTHGSDHFLVACHDWGPYTVNEHPELKRNAIKALCNADLSDGIFVPGKDVSLPETSIRNAGRPLRNIGNGNRVSQRPILAFFAGNLHGRVRPKLLKHWRNKDEDMKIYGPLPHNVARKMTYVQHMKSSKYCLCPMGYEVNSPRIVEAIYYECVPVVIADNFMLPFSDVLDWSAFSVVVPEKEIPRLKEILLEIPMRRYLKMQSNVKMVQRHFLWSPKPRKYDVFHMILHSIWFNLLNQNQTSFDDHIPDS

SEQ ID NO: 14433 - protein, 217 aa, Arabidopsis thaliana
  misc_feature: Useful for making plants with altered alkaloid content
  misc_feature: Useful for making plants with altered terpenoid content
MANSMATLSRRLYRSLLSNPRISQASMSFCTNNITSPEDSDFDELESPIEPKASDPVSRFSGEERVMEERPLENGLDSGIFKAILVGQVGQLPLQKKLKSGRTVTLFSVGTGGIRNNRRPLINEDPREYASRSAVQWHRVSVYPERLADLVLKNVEPGTVIYLEGNLETKIFTDPVTGLVRRIREVAIRRNGRVVFLGKAGDMQQPSSAELRGVGYY

SEQ ID NO: 14434 - protein, 272 aa, Glycine max
  misc_feature: Useful for biocontainment applications
MKTLVMDTTSSTPQDSSSSKRHFHWTNKVGNEDPQLATSETMSKIIEEEDTNTKEKEQEEDDKAVPLPGPATKRKIQAVAISRLRSVLTVFSKNHRSNLPFGLGSRVVGTLFGYRRGHVHFAFQRDPTSQPAFLIELATPISGLVREMASGLVRIALECDKDKDSEEKKTTKKNKTLRLLQESVWRTYCNGKKCGFATRRECGAKDWDILKAVEPISMGAGVLPNSDGSDGEVMYMRARFERIVGSRDSEAFYMMNPDSNGAPELSIYLLRV

SEQ ID NO: 14435 - protein, 523 aa, Arabidopsis thaliana
  misc_feature: Useful for making plants with altered cell wall content and/or composition
MESLMRLVLVLFPFFVVFFVPLDHVSSESISRANFPDGFVFGTASSAYQFEGAVKEGNKGESIWDTFTKEKPGKILDFSNADTTVDQYHRFHNDIDLMKDLRMDAYRFSISWSRIFPNGTGEVNPDGVKYYNSLIDALLAKGIKPYVTLYHWDLPQALEDRYEGWLSREVVDDFEHYAFTCFKAFGDRVKYWITFNEPHGVSIQGYDTGIQAPGRCSLLGHWFCKKGKSSVEPYIVAHNILLSHAAAYHTYQRNFKEKQRGQIGISLDAKWYEPMSDCDEDKDAARRAMDFGLGWFMDPLINGDYPASMKSLVEERLPKITPEMYKTIKGAFDYVGINHYTTLYARNDRTRIRKLILQDASSDSAVITSWSSWLHIVPWGIRKLAVYVKDIYGNPPVFITENGMDEKNSPFIDMEKALKDDKRIGFHRDYLSNLSAAIRNDECDVRGYFVWSLLDNWEWNSGYTVRFGIYYVDYKNNLTRIPKASARWFQTILSGSSSTSDSSKLILLEEATEQQQEYKFQEK

SEQ ID NO: 14436 - protein, 72 aa, Panicum virgatum
  misc_feature: Useful for making plants with altered carbohydrate content
MARTTPFGLAVAAALVFAVAMPALAAAQAPAPAPTSDGTSIDQGIAYLLMIVALVLTYLIHPLDASSPYKLF

SEQ ID NO: 14437 - protein, 74 aa, Arabidopsis thaliana
  misc_feature: Useful for making plants with altered cell wall content and/or composition
  misc_feature: Useful for making plants with modulated nitrogen use efficiency
  misc_feature: Useful for making plants with modulated salt sensitivity
MASRNSVAVIALFAFVFAVISPFAGAQSLAPAPSPTSDGTSIDQGIAYLLMVVALVLTYLIHPLDASSSSYTFF

SEQ ID NO: 14438 - protein, 555 aa, Oryza sativa subsp. japonica
  misc_feature: Useful for making plants with modulated phosphate use efficiency
MADADGGSNLAVLDALDSARTQMYHMKAIVIAGMGFFTDAYDLFCISTVSKLLGRLYYQPDGSTDSKPGALSKTANNMVIGVALVGTLMGQLVFGYFGDKLGRKRVYGVTLILMAACAIGSGLSFGSSRKAVIGTLCFFRFWLGFGIGGDYPLSATIMSEYSNKKTRGAFIAAVFAMQGVGIIFAGLVSMIVSSIFLTYNKAPSYKGNHDLSRQMPAADYVWRIVLMIGAFPALATFYWRMKMPETARYTAIIDGNAKQAANDMQKVLSIEIEAEQEKLAKFNAANNYPLLSMEFARRHGLHLIGTTTTWFLLDIAFYSQNLTQKDIFPAMGLISGAAEVNALTEMFQISKASFLVALLGTFPGYWVTVALIDKMGRYMIQLIGFFMMSMFMLAMGILYDYLKTHHFLFGLLYALTFFFANFGPNSTTFVLPAELFPTRVRSTCHAISAAAGKAGAIVAAFGIQKLTYNSQVKSIKKALIILSITNMLGFFFTFLVPETMGRSLEEISGEDGNTGAGGGGAPAAANAGVGVSASDVSRDEKFPASSTEWQTSMHA

SEQ ID NO: 14439 - protein, 364 aa, Panicum virgatum
  misc_feature: Useful for making plants with altered carbohydrate content
MGSSGGIRGLRRRVSRLLLLLLLAASTGGPTARAREAQPLPEAAAAGTRRAPERHGLSLDFYAKTCPAVDQIVANVTAARYRDFPAAGPAVLRLFHHDCFVEGCDASILIAPTASASPKVERDMEENKNLAQEAFDAVELAKAAVESRCPGVVSCADVLALATRDYVQQAGGPYYAVKKGRKDSRVSLAGKVRGSLPRANSTVDELLRVFAGKGLGAADLVALSGAHTVGFTHCVHVLGRIYDFRGTRRPDPLMDARLVKALRMSCPSSGGSARVVVPFDVSTPFQFDHAYYANLQARLGLLGSDQALFLDPRTRPLVQELAGNKTRFFQAFVASMDRMGAIRIKKGRKGEVRKVCSQHLLPPV

SEQ ID NO: 14440 - protein, 338 aa, Arabidopsis thaliana
  misc_feature: Useful for making plants with altered cell wall content and/or composition
SSIFFFLFLTSTILISPVQPTTSKPPAPRPHRELSADYYSKKCPQLETLVGSVTSQRFKEVPISAPATIRLFFHDCFVEGCDGSILIETKKGSKKLAEREAYENKELREEGFDSIIKAKALVESHCPSLVSCSDILAIAARDFIHLAGGPYYQVKKGRWDGKRSTAKNVPPNIPRSNSTVDQLIKLFASKGLTVEELVVLSGSHTIGFAHCKNFLGRLYDYKGTKRPDPSLDQRLLKELRMSCPFSGGSSGVVLPLDATTPFVFDNGYFTGLGTNMGLLGSDQALFLDPRTKPIALEMARDKQKFLKAFGDAMDKMGSIGVKRGKRHGEIRTDCRVFL

SEQ ID NO: 14441 - protein, 250 aa, Panicum virgatum
  misc_feature: Useful for making plants with altered carbohydrate content
MAGRRIAVAAAFLALAAVVPAALAQAPGPAAAPSGPPNVTAILEKGGQYTTFIRLMKETQQDTQLNSQLNSSFGNNGGGGYTVFAPTDNAFNNLKPGTLNSLTQQQQVSLVQGHVLPNFYSMDSFQTASNPVRTQASGRDGPYTLNITSDTNNQVNVSSGVVDVRINNALYNAKPLAVYSVDKVLLPMELFGAKAPAAAPTASEGKPRKGGSSDASSPAGSEDAEPTGAASARAVGWSVAGLAAVLGYLL

SEQ ID NO: 14442 - protein, 303 aa, Panicum virgatum
  misc_feature: Useful for making plants with altered carbohydrate content
MASSRLCRPLVAASFLAAFAAVSSAGKVAVYWGQGGGEGTLADTCASGLYDFVNIAFVSAFGNGGGQPPVLNLADHCDPAAGTCAVFSSDIRSCQARGVKVLISLGGATPTYSLTSAEEARGLADYLWDNFLGGASAASRPLGDAALDGVDFDIEQGGGDHYDELARALSSRCGGACLLTAAPQCPYPDAHLGKAIGTGLFSHVWVQFYNNPMARCQYAPGGASDLEDAWARWTAAVPPPADVFLGLPAAESAAENGGYIDADTLKSQVLPAVRGAANYGGLMLWDRARDAASGYSSSVRGSV

SEQ ID NO: 14443 - protein, 399 aa, Capsicum annuum
  misc_feature: Useful for making plants with modulated water use efficiency
MEGTSSIDQESTTSDSLSIAPAASSSMVVKQQPSMTTTKPPESLCRMGSGTSSVIIDGENGVEAESRKLPSSKYKGVVPQPNGRWGAQIYEKHQRVWLGTFNEENEAARAYDVAAQRFRGRDAVTNFKPLLENQESDDDVEIAFLNSHSKAEIVDMLRKHTYIDELEQSKKLFGYTKDGTMAKNKDGLIDISSFFGGGGTIDKVNNKVREQLFEKAVTPSDVGKLNRLVIPKQHAEKHFPLQNGNNSKGVLLNFEDLNGKVWRFRYSYWNSSQSYVLTKGWSRFVKEKNLKAGDIVSFQRSTSGDKQLYIDFKARNMAPTNPVVTNQVQAQVQVPRVQMMRLFGVNICKIPATINNVVDNNNNNNNNMANCSGGKRMMEMELLTFESCRKKQRVIIDAL

SEQ ID NO: 14444 - protein, 502 aa, Arabidopsis thaliana
  misc_feature: Useful for making plants with altered carbon content
  misc_feature: Useful for making plants with altered nitrogen content
  misc_feature: Useful for making plants with modulated carbon-nitrogen partitioning
MEVEGKGGEAGTTTTTAPRRFALPVDAENKATTFRLFSVAKPHMRAFHLSWFQFFCCFVSTFAAPPLLPVIRENLNLTATDIGNAGIASVSGAVFARIVMGTACDLFGPRLASAALTLSTAPAVYFTAGIKSPIGFIMVRFFAGFSLATFVSTQFWMSSMFSGPVVGSANGIAAGWGNLGGGATQLIMPIVFSLIRNMGATKFTAWRIAFFIPGLFQTLSAFAVLLFGQDLPDGDYWAMHKSGEREKDDVGKVISNGIKNYRGWITALAYGYCFGVELTIDNIIAEYFFDRFHLKLQTAGIIAASFGLANFFARPGGGIFSDFMSRRFGMRGRLWAWWIVQTSGGVLCACLGQISSLTVSIIVMLVFSVFVQAACGLTFGVVPFISRRSLGVVSGMTGAGGNVGAVLTQLIFFKGSTYTRETGITLMGVMSIACSLPICLIYFPQWGGMFCGPSSKKVTEEDYYLAEWNDEEKEKNLHIGSQKFAETSISERGRATTTHPQT

SEQ ID NO: 14445 - protein, 522 aa, Arabidopsis thaliana
  misc_feature: Useful for biocontainment applications
  misc_feature: Useful for making plants with modulated biomass
MKTQHQWWEVLDPFLTQHEALIAFLTFAAVVIVIYLYRPSWSVCNVPGPTAMPLVGHLPLMAKYGPDVFSVLAKQYGPIFRFQMGRQPLIIIAEAELCREVGIKKFKDLPNRSIPSPISASPLHKKGLFFTRDKRWSKMRNTILSLYQPSHLTSLIPTMHSFITSATHNLDSKPRDIVFSNLFLKLTTDIIGQAAFGVDFGLSGKKPIKDVEVTDFINQHVYSTTQLKMDLSGSLSIILGLLIPILQEPFRQVLKRIPGTMDWRVEKTNARLSGQLNEIVSKRAKEAETDSKDFLSLILKARESDPFAKNIFTSDYISAVTYEHLLAGSATTAFTLSSVLYLVSGHLDVEKRLLQEIDGFGNRDLIPTAHDLQHKFPYLDQVIKEAMRFYMVSPLVARETAKEVEIGGYLLPKGTWVWLALGVLAKDPKNFPEPEKFKPERFDPNGEEEKHRHPYAFIPFGIGPRACVGQRFALQEIKLTLLHLYRNYIFRHSLEMEIPLQLDYGIILSFKNGVKLRTIKRF

SEQ ID NO: 14446 - protein, 433 aa, Zea mays
  misc_feature: Useful for making plants with altered alkaloid content
MAAPNSNDAASASGTGPAGEEDISIEALARRVQEHMTLSSNPAARRHKFWETQPVGQFRDVADTSLPDGPIEPPTPLSEVRADPYPLPAAFEWLTCDLDDDALLADLYSLLAHNYVEDDENMFRFNYSPAFLRWALKPPSFFRAWHIGVRAKESKKLVAFISGVPARIRARDDVVRMAEINFLCVHKKLRSKRLAPVLIREVTRRVHQENIWQAAYTAGVVLPTPITTCRYWHRSLNPKKLIDVGFSRLGPRMTMSRTVRLYKLPDAPLTPGFRRMELRDVAAVTRLLRAYLARFVVAPDFDEVDVEHWLLPQEDVVDSYLVESPETHEVTDFCSFYTLPSSVLNNANYATLKAAYSYYNVSTKTALQQLMNDALIVAKQKNYDVFNALDVMENESFLKELKFGPGDGQLHYYLYNYRIRNGIKPSELGLVLL

SEQ ID NO: 14447 - protein, 472 aa, Panicum virgatum
  misc_feature: Useful for making plants with altered carbohydrate content
MVKRSVVLYPGLGVGHLTPMVELAKAFLHHGAAVTVALVEPPTKSPDFSAAVARAAASNPSVTFHVLPPPPPAPAGPSGSGGGTSPAHHVVVMLYHLKAMVAPLRDFLRSLPAVDALVLDMFCGDALDVAAELKLPVFYFYASGAGDLAVFLNVGRTSTSTAFAELGDSLVSFPGAPPFKASDLPKEFSEGSPGAKPILGALHRLPEADGILVNTFESLEARAVRALREGLCVPDRSTPPVYCIGPLVSGSGEKEHECLRWLDKQPESSVVFLSFGSLGTFPKKQLEEIAIGLEKSGQRFLWVVRSPRDLEDMSSQPLPEPDLDALLPEGFLGRTKDTGLVLKSWAPQGDVLRHRATGAFVTHCGWNSTLEGITAGLPLLCWPLYAEQRMNKVFIVEVMKLGVEMKGYDEELVKAEEVETKVRWVMESQGGQALRDRVAEVKGRAIEAIEEEGSSHAAFVEFLKDLDTMNLP

SEQ ID NO: 14448 - protein, 506 aa, Arabidopsis thaliana
  misc_feature: Useful for making plants with altered cell wall content and/or composition
MARDFKLIFSISILLLLLDCCYGGKVGVCYGRSADDLPTPSKVVQLIQQHNIKYVRIYDYNSQVLKAFGNTSIELMIGVPNSDLNAFSQSQSNVDTWLKNSVLPYYPTTKITYITVGAESTDDPHINASSFVVPAMQNVLTALRKVGLSRRIKVSTTLSLGILSRSFPPSAGAFNSSYAYFLRPMLEFLAENKSPFMIDLYPYYAYRDSPNNVSLDYVLFESSSEVIDPNTGLLYKNMFDAQVDALYYALTALNFRTIKIMVTETGWPTKGSPKEKAAASSDNAETYNSNIIRHVVTNQGTPAKPGEAMNVYIFSLFNENRKAGLDSERNWGLFYPDQTSVYQLDFTGKSNGFHSNSSGTNSSGSSNSWCIASSKASERDLKGALDWACGPGNVDCTAIQPSQPCFQPDTLVSHASFVFNSYFQQNRATDVACSFGGAGVKVNKDPSYDKCIYITAGGNKTKATNATALTSSASTPRGNELLQWILKLCLMISLFFSLQTMNSQAL

SEQ ID NO: 14449 - protein, 382 aa, Panicum virgatum
  misc_feature: Useful for making plants with altered carbohydrate content
MATPRARFLACIAVALLAPPCGVAGHSRGLRPGRGGAAAPFPVNATRAEMIERQFVEWVRYMGGLRHSTFQHALARAFPSYSLVVDKNPAFGDFTTIQAAIDSLPAINLVRVVIRVNPGTYTEKVTVSPMRAFITLEGAGAESTIVQWGDTADSPTGPKGRPLGTFNSATFAVNAQYFLARNITFKNTAPVPQPGATGKQAVALRVSADNAAFVGCKFLGAQDTLYDHSGRHYYKECYIEGSVDFIFGNALSLYEDCHVHAIARDYGALTAQNRQSTLEDTGFSFVNCRVTGSGALYLGRAWGSFSRVVFAYTYMDNIIIPRGWYNWGDPNREMTVFYGQYKCTGPGASYAGRVAWSHELTDDEAKPFISLSFIDGTEWVRL

SEQ ID NO: 14450 - protein, 383 aa, Arabidopsis thaliana
  misc_feature: Useful for making plants with altered cell wall content and/or composition
MPKLNSTQAPNLFLLLLVILLCSTQTQCHTKGLRLRPRNQKNMNTTSDRTQNPEDEFMKWVRFVGSLKHSVFKAAKNKLFPSYTLTVHKKSNKGDFTKIQDAIDSLPLINFVRVVIKVHAGVYKEKVSIPPLKAFITIEGEGAEKTTVEWGDTAQTPDSKGNPMGTYNSASFAVNSPFFVAKNITFRNTTPVPLPGAVGKQAVALRVSADNAAFFGCRMLGAQDTLYDHLGRHYYKDCYIEGSVDFIFGNALSLYEGCHVHAIADKLGAVTAQGRSSVLEDTGFSFVKCKVTGTGVLYLGRAWGPFSRVVFAYTYMDNIILPRGWYNWGDPSREMTVFYGQYKCTGAGANYGGRVAWARELTDEEAKPFLSLTFIDGSEWIKL

SEQ ID NO: 14451 - protein, 911 aa, Arabidopsis thaliana
  misc_feature: Useful for making plants with modulated heat sensitivity
MNPEKFTHKTNETIATAHELAVNAGHAQFTPLHLAGALISDPTGIFPQAISSAGGENAAQSAERVINQALKKLPSQSPPPDDIPASSSLIKVIRRAQAAQKSRGDTHLAVDQLIMGLLEDSQIRDLLNEVGVATARVKSEVEKLRGKEGKKVESASGDTNFQALKTYGRDLVEQAGKLDPVIGRDEEIRRVVRILSRRTKNNPVLIGEPGVGKTAVVEGLAQRIVKGDVPNSLTDVRLISLDMGALVAGAKYRGEFEERLKSVLKEVEDAEGKVILFIDEIHLVLGAGKTEGSMDAANLFKPMLARGQLRCIGATTLEEYRKYVEKDAAFERRFQQVYVAEPSVPDTISILRGLKEKYEGHHGVRIQDRALINAAQLSARYITGRHLPDKAIDLVDEACANVRVQLDSQPEEIDNLERKRMQLEIELHALEREKDKASKARLIEVRKELDDLRDKLQPLTMKYRKEKERIDEIRRLKQKREELMFSLQEAERRYDLARAADLRYGAIQEVESAIAQLEGTSSEENVMLTENVGPEHIAEVVSRWTGIPVTRLGQNEKERLIGLADRLHKRVVGQNQAVNAVSEAILRSRAGLGRPQQPTGSFLFLGPTGVGKTELAKALAEQLFDDENLLVRIDMSEYMEQHSVSRLIGAPPGYVGHEEGGQLTEAVRRRPYCVILFDEVEKAHVAVFNTLLQVLDDGRLTDGQGRTVDFRNSVIIMTSNLGAEHLLAGLTGKVTMEVARDCVMREVRKHFRPELLNRLDEIVVFDPLSHDQLRKVARLQMKDVAVRLAERGVALAVTDAALDYILAESYDPVYGARPIRRWMEKKVVTELSKMVVREEIDENSTVYIDAGAGDLVYRVESGGLVDASTGKKSDVLIHIANGPKRSDAAQAVKKMRIEEIEDDDNEEMIED

SEQ ID NO: 14452 - protein, 1186 aa, Arabidopsis thaliana
  misc_feature: Useful for making plants with modulated biomass
MASLITTKAMMSHHHVLSSTRITTLYSDNSIGDQQIKTKPQVPHRLFARRIFGVTRAVINSAAPSPLPEKEKVEGERRCHVAWTSVQQENWEGELTVQGKIPTWLNGTYLRNGPGLWNIGDHDFRHLFDGYSTLVKLQFDGGRIFAAHRLLESDAYKAAKKHNRLCYREFSETPKSVIINKNPFSGIGEIVRLFSGESLTDNANTGVIKLGDGRVMCLTETQKGSILVDHETLETIGKFEYDDVLSDHMIQSAHPIVTETEMWTLIPDLVKPGYRVVRMEAGSNKREVVGRVRCRSGSWGPGWVHSFAVTENYVVIPEMPLRYSVKNLLRAEPTPLYKFEWCPQDGAFIHVMSKLTGEVVASVEVPAYVTFHFINAYEEDKNGDGKATVIIADCCEHNADTRILDMLRLDTLRSSHGHDVLPDARIGRFRIPLDGSKYGKLETAVEAEKHGRAMDMCSINPLYLGQKYRYVYACGAQRPCNFPNALSKVTYIPQTIGFQYSIVLNEPFDNCMRQVDIVEKKVKNWHEHGMIPSEPFFVPRPGATHEDDGENKLQQNEKKKSENSDTSPLCRKFTLGYNGAAGVEPQLSPPSESGIITCTTLGAGSGSLVPPINSQIMASLITTKAMMSHHHVLSSTRITTLYSDNSIGDQQIKTKPQVPHRLFARRIFGVTRAVINSAAPSPLPEKEKVEGERRCHVAWTSVQQENWEGELTVQGKIPTWLNGTYLRNGPGLWNIGDHDFRHLFDGYSTLVKLQFDGGRIFAAHRLLESDAYKAAKKHNRLCYREFSETPKSVIINKNPFSGIGEIVRLFSGESLTDNANTGVIKLGDGRVMCLTETQKGSILVDHETLETIGKFEYDDVLSDHMIQSAHPIVTETEMWTLIPDLVKPGYRVVRMEAGSNKREVVGRVRCRSGSWGPGWVHSFAVTENYVVIPEMPLRYSVKNLLRAEPTPLYKFEWCPQDGAFIHVMSKLTGEVVASVEVPAYVTFHFINAYEEDKNGDGKATVIIADCCEHNADTRILDMLRLDTLRSSHGHDVLPDARIGRFRIPLDGSKYGKLETAVEAEKHGRAMDMCSINPLYLGQKYRYVYACGAQRPCNFPNALSKVDIVEKKVKNWHEHGMIPSEPFFVPRPGATHEDDGVVISIVSEENGGSFAILLDGSSFEEIARAKFPYGLPYGLHGCWIPKD

SEQ ID NO: 14453 - protein, 985 aa, Arabidopsis thaliana
  misc_feature: Useful for making plants with modulated biomass
MMESRSPICNTCGEEIGVKSNGEFFVACHECSFPICKACLEYEFKEGRRICLRCGNPYDENVFDDVETKTSKTQSIVPTQTNNTSQDSGIHARHISTVSTIDSELNDEYGNPIWKNRVESWKDKKDKKSKKKKKDPKATKAEQHEAQIPTQQHMEDTPPNTESGATDVLSVVIPIPRTKITSYRIVIIMRLIILALFFNYRITHPVDSAYGLWLTSVICEIWFAVSWVLDQFPKWSPINRETYIDRLSARFEREGEQSQLAAVDFFVSTVDPLKEPPLITANTVLSILALDYPVDKVSCYVSDDGAAMLSFESLVETADFARKWVPFCKKYSIEPRAPEFYFSLKIDYLRDKVQPSFVKERRAMKRDYEEFKIRMNALVAKAQKTPEEGWTMQDGTSWPGNNTRDHPGMIQVFLGYSGARDIEGNELPRLVYVSREKRPGYQHHKKAGAENALVRVSAVLTNAPFILNLDCDHYVNNSKAVREAMCFLMDPVVGQDVCFVQFPQRFDGIDKSDRYANRNIVFFDVNMRGLDGIQGPVYVGTGTVFRRQALYGYSPPSKPRILPQSSSSSCCCLTKKKQPQDPSEIYKDAKREELDAAIFNLGDLDNYDEYDRSMLISQTSFEKTFGLSTVFIESTLMENGGVPDSVNPSTLIKEAIHVISCGYEEKTEWGKEIGWIYGSITEDILTGFKMHCRGWRSIYCMPLRPAFKGSAPINLSDRLHQVLRWALGSVEIFLSRHCPLWYGCSGGRLKLLQRLAYINTIVYPFTSLPLVAYCTLPAICLLTGKFIIPTLSNLASMLFLGLFISIILTSVLELRWSGVSIEDLWRNEQFWVIGGVSAHLFAVFQGFLKMLAGLDTNFTVTSKTADDLEFGELYIVKWTTLLIPPTSLLIINLVGVVAGFSDALNKGYEAWGPLFGKVFFAFWVILHLYPFLKGLMGRQNRTPTIVILWSILLASVFSLVWVRINPFVSKTDTTSLSLNCLLIDC

SEQ ID NO: 14454 - protein, 985 aa, Arabidopsis thaliana; identical to SEQ ID NO: 14453
  misc_feature: Useful for making plants with altered cell wall content and/or composition

SEQ ID NO: 14455 - protein, 52 aa, Arabidopsis thaliana
  misc_feature: Useful for making plants with altered alkaloid content
  misc_feature: Useful for making plants with altered lignin content
MGSEQNDSTSFSPSEPKLCVKGCGFFGSPSNMNLCSKCYQRHPSHGGTNRFR

SEQ ID NO: 14456 - protein, 567 aa, Panicum virgatum
  misc_feature: Useful for making plants with altered carbohydrate content
MPPLPKRPGPLLVLLVVAFAAATAAAGATVSFYPSAEAAAAAHCDGTLYPDVCLSTLADIPDLHKKPLPDVICAAVNRTEDVVAATASNCSSYLRERSLTARDRLALSDCLELLSTSMDELQATVADLESPAATGGGGSASSSSAVGARRVTMDHVMTVLSAAITNQYTCLDGFAYQNGGRVRRYIEPTLHHVSRMVSNSLATAKKLPGATPSSPSPAAVRHPFMGYGQMVKGFPRWVRPGDRRLLQAPASGIAADAVVAQDGSGNYTTVSAAVAAAPTNSKRRYVIYIKAGAYMENVEVGKKHVNLMFVGDGIGKTVIKASRNVVDGSTTFRSATVAVVGNNFLGRDLTIENSAGPSKHQAVALRVGADLSAFYRCSFVGYQDTLYVHSLRQFFRDCDVYGTIDFVFGNTAVVLQGCNLYARRPLPNQSNIFTAQGREDPNQNTGISVHRCKVAAAADLAGREASTRTYLGRPWKQYSRTVFMQSELDSLIDPAGWLEWSGDFALDTLYYGEYMNTGAGAGTSGRVKWKGYRVITSAAEASAFTVGSFIDGDVWLAGTSIPFTTGL

SEQ ID NO: 14457 - protein, 297 aa, Arabidopsis thaliana
  misc_feature: Useful for making plants with altered cell wall content and/or composition
MTGNIGKGVTQYKVTDPSDDPLNPKPGTLRYGATLVKGKKWITFKRNMKIKLHKPLLISSFTALDGRGASVHISGPACLIVYRATDVIIHGLKIHDCKAHPPSSVMGPDSKIIQLGHMDGDAIRLVTAKKVWIDHNTLYDCEDGLLDVTLGSTDVTVSNNWFRNQDKVMLLGHDDGYVKDKDMRVTVVFNHFGPNCNQRMPRVRHGYAHVANNYYQGWTQYAIGGSMSPRVKSESNYFVAPKSGSKEVLEKHGPITAQIKGSQSQTLNRLKYSLLQPERYTAPETPSVSTTTLNMTF

SEQ ID NO: 14458 - protein, 512 aa, Panicum virgatum
  misc_feature: Useful for making plants with altered carbohydrate content
MDASLFISVGLAAVLIPLSLALLNRLRLGRLPPGPRPWPVLGNLRQIKPIRCRCFQEWAERYGPIISVWFGSGLTVVVSTSELTKEVLKEHDQQLADRPRNRSTQRFSRNGQDLIWADYGPHYIKVRKLCNLELFTPKRLEALRPIREDEVTAMVESVHRAATAPGNEGKPLVVRNHLSMVAFNNITRLAFGKRFMNANGEIDEQGREFKTIVNNGIRIGASLSVAEFIWYLRWLCPLNEELYKTHNERRDRLTMKIIEEHAKALQESGAKQHFVDALFTLKQQYDLSEDTVIGLLWDMITAGMDTTVISVEWAMAELVRNPRVQKKLQEELDRVVGRDRVMSETDFQNLPYLQAVVKESLRLHPPTPLMLPHKASTNVKIGGYNIPKGANVMVNVWAVARDPKVWSNPLEYRPERFLEENIDIKGSDFRVLPFGAGRRVCPGAQLGINLVASMIGHLLHHFEWSLPSGTRPEDVNMMESPGLVTFMGTPLQAVAKPRLENEELYKRVPVEM

SEQ ID NO: 14459 - protein, 1110 aa, Arabidopsis thaliana
  misc_feature: Useful for making plants with altered lignin content
MSWFLIAVATIAAVVSYKLIQRLRYKFPPGPSPKPIVGNLYDIKPVRFRCYYEWAQSYGPIISVWIGSILNVVVSSAELAKEVLKEHDQKLADRHRNRSTEAFSRNGQDLIWADYGPHYVKVRKVCTLELFTPKRLESLRPIREDEVTAMVESVFRDCNLPENRAKGLQLRKYLGAVAFNNITRLAFGKRFMNAEGVVDEQGLEFKAIVSNGLKLGASLSIAEHIPWLRWMFPADEKAFAEHGARRDRLTRAIMEEHTLARQKSSGAKQHFVDALLTLKDQYDLSEDTIIGLLWDMITAGMDTTAITAEWAMAEMIKNPRVQQKVQEEFDRVVGLDRILTEADFSRLPYLQCVVKESFRLHPPTPLMLPHRSNADVKIGGYDIPKGSNVHVNVWAVARDPAVWKNPFEFRPERFLEEDVDMKGHDFRLLPFGAGRRVCPGAQLGINLVTSMMSHLLHHFVWTPPQGTKPEEIDMSENPGLVTYMRTPVQAVATPRLPSDLYKRVPYDMLAKEVLKEHDQKLADRHRNRSTEAFSRNGQDLIWADYGPHYVKVRKVCTLELFTPKRLESLRPIREDEVTAMVESVFRDCNLPENRAKGLQLRKYLGAVAFNNITRLAFGKRFMNAEGVVDEQGLEFKAIVSNGLKLGASLSIAEHIPWLRWMFPADEKAFAEHGARRDRLTRAIMEEHTLARQKSSGAKQHFVDALLTLKDQYDLSEDTIIGLLWDMITAGMDTTAITAEWAMAEMIKNPRVQQKVQEEFDRVVGLDRILTEADFSRLPYLQCVVKESFRLHPPTPLMLPHRSNADVKIGGYDIPKGSNVHVNVWAVARDPAVWKNPFEFRPERFLEEDVDMKGHDFRLLPFGAGRRVCPGAQLGINLVTSMMSHLLHHFVWTPPQGTKPEEIDMSENPGLVTYMRTPVQAVATPRLPSDLYKRVPYDMMSWFLIAVATIAAVVSYKLIQRLRYKFPPGPSPKPIVGNLYDIKPVRFRCYYEWAQSYGPIISVWIGSILNVVVSSAELAKEVLKEHDQKLADRHRNRSTEAFSRNGQDLIWADYGPHYVKVRKVCTLELFTPKRLESLRPIREDEVTAMVESVFRDCNLPENRAKGLQLRK

SEQ ID NO: 14460 - protein, 172 aa, Arabidopsis thaliana
  misc_feature: Useful for making plants with altered cell wall content and/or composition
MSWFLIAVATIAAVVSYKLIQRLRYKFPPGPSPKPIVGNLYDIKPVRFRCYYEWAQSYGPIISVWIGSILNVVVSSAELAKEVLKEHDQKLADRHRNRSTEAFSRNGQDLIWADYGPHYVKVRKVCTLELFTPKRLESLRPIREDEVTAMVESVFRDCNLPENRAKGLQLRK

SEQ ID NO: 14461 - protein, 135 aa, Arabidopsis thaliana
  misc_feature: Useful for making plants with modulated drought sensitivity
MSTISPSLAVIAFLFLILLNLSSVFADPSTEGGEIIRLPSEKINGEKNRGEFCEGIAKPASCPVQCFRPDPVCGEDSVTYWCGCADALCHGVRVVKQGACDVGNGVGLSVPGQALLLIHIVWMMLLGFSILFGLF

SEQ ID NO: 14462 - protein, 510 aa, Panicum virgatum
  misc_feature: Useful for making plants with altered carbohydrate content
MAAAVAAVSLLLFLSAQGAAPVLGFTRGDFPEDFVFGSATSAYQYEGAVAEDGRSPSIWDTFTHAGRMPDKSNGDIATDGYHKYKDDVKLVTDTNLEAYRFSISWSRLIPKGRGTVNPKGLEYYNNLIDELVRHGVQVHVMMYQLDLPQVLEDEYGGWLNPRIVEDFTAYADVCFKEFGDRVSYWTTLDEVNVAAVGSYDIGQIPPARCSDPFGVTKCTVGNSSVEPYIAAHNMLLAHASATRLYRAKYQAVQKGVVGINIYTMWPYPLTNSTADLEATQRFRDFYFGWIVEPLVFGDYPQAVKKNVGSRLPSFTKVQSEAIRGTLDFIGINHYYSFYVNDRPLEIGIRDFALDISAEYRGSRTDPPIGQHAPTSIPADPKGLQLLVEYLNKAYGNLPVYIQETGYATKNGSLHDTDRVDYMKNHIRSTLTALRNGANVKGYFAWCFMDVFEYLTGFKSQYGLYRVDFKDQALPRQARLSARWYSEFLRNKEIQIREENELDDAGSHAQQ

SEQ ID NO: 14463 - protein, 100 aa, Zea mays
  misc_feature: Useful for making plants with modulated flowering time
MERHAEKPLLVLPSCLLFLLLAPLVSAVPTPRSLRLGSQHHQQQHPPALKLDSSQDTPAIAAAMMKNTGRPTARVDVEVNDYQPSGPNNRHDPPKGPGRP

SEQ ID NO: 14464 - protein, 248 aa, Panicum virgatum
  misc_feature: Useful for making plants with altered carbohydrate content
MAVAGALLVVLSILAREAAAGGYGGWQSAHATFYGGGDASGTMGGACGYGNLYSSGYGTNTAALSTALFNDGAACGSCYELRCQNAGGSCLPGSITVTATNFCPPNYGLPSDDGGWCNPPRPHFDMAEPAFLHIAQYRAGIVPVAFRRVSCVKKGGIRFTINGHSYFNLVLVTNVAGAGDVRSVSIRSTRTGWQPMSRNWGQNWQSNAFLDGQALSFQVTASDGRAVTSNNAAPRGWQFGQTFEGAQF

SEQ ID NO: 14465 - protein, 569 aa, Panicum virgatum
  misc_feature: Useful for making plants with altered carbohydrate content
MASSSPSSRLLFFLSCLALALLAGAEVHHHEFVVQETPVKRLCNTHNIITVNGQFPGPTLEVREGDTLVVNVVNRAQYNVTIHWHGIRQIRTGWADGPEFVTQCPIRPGGSYKYRFTIQGQEGTLWWHAHSSWLRATVYGALIIRPRENKAYPFGKPSREVPVILGEWWNANPIDVIREAQRTGGGPNVSDAFTINGQPGDFYNCSQEETTAIPVKPGETALLRFINAALNHELFVSIAQHKMTVVAADASYTKPFTTSVLMIAPGQTTDVLVTMDQAPTRYYVAARAYVSGQNVAFDNTTTTAVIEYDCGCASDFGPKIQPAFPALPAFNDTAAAAAFAAGIKSPGKVKVHEDVDEYLFFTVGLGLFNCEPGQLCAGPNNNTRFTASMNNVSFVFPQHDSLLHAHYYKIPGVFTTDFPAYPPVQFDYTAKNVSRALWQPVPGTKLYPLRFGSVVQLVLQDTSIVTPENHPIHIHGYDFFILAEGCGNFDPKKDVEKFNYVDPPQRNTVAVPVNGWAVIQFVADNPGVWLMHCHLDVHITWGLAMAFLVEDGYGKLQSLEPPPIDLPMC

SEQ ID NO: 14466 - protein, 219 aa, Zea mays
  misc_feature: Useful for making plants with modulated biomass
MDPYHYQTMYDPRGFPIIHPQPYLQHPVAGALGDSRVRGGGSGARRRPGAKLSTDPQSVAARERRHRISDRFRVLRSLVPGGSKMDTVSMLEQAIHYVKFLKTQISLHQAALMQHEEGCHAELAAYSAVAVVGDNEVTLASHGRTGACDEMMQLQVAAEEALSYGVDAHQPYGLDPRQLSGGHELPPLPASCIFLEEPADACYSVCDLDDGDTGLPGSY

SEQ ID NO: 14467 - protein, 584 aa, Panicum virgatum
  misc_feature: Useful for making plants with altered carbohydrate content
MAMALSSSSSALPCSLLIAALMLLASITQVQGITRYYDFNVTMANVTRLCATKSIVTVNGQFPGPKLVAREADRVVVRVTNHAQHNISLHWHGIRQLRTGWADGPAYITQCPIQTGQSYVYNFTITGQRGTLWWHAHISWLRATVYGPLVVLPKLGVPYPFPAPYKEVPVIFGEWWQADTEVVIKQAVQTGGGPNVSDAHTINGLPGPLYNCSAKDTYKLKVKPGKTYMLRLINAALNDELFFSVANHSLTVVEVDAVYVKPFTVDTLIISPGQTTNVLLTAKPFYPGANYYMSAAPYSTARSGTFDNTTVAGILEYEYPDAAPAAPSFNKALPLHKPALPALNDTNFVGNFTAKLRSLTTPQYPAAVPTAVDRKFFFTVGLGTHPCPANTTCQGPTNTTQFAASVNNVSFVLPTRALLHSHFTGLSTGVYSPDFPVSPLTPFNYTGTPPNNTNVASGTKLMVIPYGASVELVMQGTSILGIESHPLHLHGFNFFVVGQGYGNYDPVKDPAKFNLVDPVERNTVGVPAGGWVAIRFLADNPGVWFMHCHLEAHTSWGLRMAWLVLDGSLPHQKLLPPPSDLPKC

SEQ ID NO: 14468 - protein, 573 aa, Arabidopsis thaliana
  misc_feature: Useful for making plants with altered cell wall content and/or composition
MVTWVLNYLLVAFLFAISYNIDAASAGITRHYQFDIQLKNITRLCKTKTIVTVNGKFPGPRVTAREGDNLQIKVVNHVSNNISIHWHGIRQLRSGWADGPSYVTQCPIRMGQSYVYNFTVTGQRGTLWWHAHIQWMRATVYGPLIILPKLHQPYPFPKPYKQVPILFGEWFNADPQAVVQQALQTGAGPNASDAHTFNGLPGPLYNCSTKDTYKLMVKPGKTYLLRLINAALNDELFFTIANHTLTVVEADACYVKPFQTNIVLLGPGQTTNVLLKTKPIYPNATFYMLARPYFTGQGTIDNTTVAGILQYQHHTKSSKNLSIIKPSLPPINSTSYAANFTKMFRSLASSTFPANVPKVVDKQYFFAIGLGTNPCPKNQTCQGPTNTTKFAASINNVSFILPNKTSLLQSYFVGKSKNVFMTDFPTAPIIPFNYTGTPPNNTMVSRGTKVVVLKYKTTVELVLQGTSILGIEAHPIHLHGFNFYVVGQGFGNFNPARDPKHYNLVDPVERNTINIPSGGWVAIRFLADNPGVWLMHCHIEIHLSWGLTMAWVVLDGDLPNQKLLPPPSDFPKC

SEQ ID NO: 14469 - protein, 567 aa, Arabidopsis thaliana
  misc_feature: Useful for making plants with altered cell wall content and/or composition
MEGVRVPIACALILLAISSITSASIVEHTFNVQNLTVSRLCKRQVITVVNGSLPGPTIRVKEGDSLVIHVLNHSPHNITIHWHGIFHKLTVWADGPSMITQCPIQPGQRYAYRFNITGQEGTLWWHAHASFLRATVYGALVIRPKSGHSYPFPKPHKEVPILFGEWWNTDVVALEEAAIATGVPPNNSDAYTINGRPGNLYPCSKDRMFSLNVVKGKRYLLRIINAAMNIQLFFKIANHRLTVVAADAVYTAPYVTDVIVIAPGQTIDALLFADQSVDTSYYMAAHPYASAPAVPFPNTTTRGVIHYGGASKTGRSKPVLMPKLPSFFDTLTAYRFYSNLTALVNGPHWVPVPRYVDEEMLVTIGLGLEACADNTTCPKFSASMSNHSFVLPKKLSILEAVFHDVKGIFTADFPDQPPVKFDYTNPNVTQTNPGLLFTQKSTSAKILKFNTTVEVVLQNHALIAAESHPMHLHGFNFHVLAQGFGNYDPSRDRSKLNLVDPQSRNTLAVPVGGWAVIRFTANNPGAWIFHCHIDVHLPFGLGMIFVVKNGPTKSTTLPPPPPDLPKC

SEQ ID NO: 14470 - protein, 217 aa, Zea mays
  misc_feature: Useful for making plants with altered lignin content
MGGRVDHEYSYLFKMVLIGDSGVGKSNILSRFTRNHFSLDSKSTIGVEFATKSLQMDGKTIKAQIWDTAGQERYRAITSAYYRGAVGALLVYDITKRQSFDNVHRWLRELRDHADSSIVIMMVGNKSDLIHLRAISEDEGKALAEKEGLFFLETSAMEAINVEQAFQTIMTEVYGIVNRKALAAKEAAAATASLPSQGKIISIDSTAGNTKRACCST

SEQ ID NO: 14471 - protein, 400 aa, Panicum virgatum
  misc_feature: Useful for making plants with altered carbohydrate content
MGLRHRASSLRLLSLALGLAVLLVSVSAQQKFGINYGQIANDLPDPTRVAGLLQSMNVNKVKLYDADPRVLTAFANTGVEFIIAVGNENLQTMAASPAAARQWVATHVQPYIPSTRITCVTVGNEVFSSNDTVMMSSLLPAMKAVYAALGDLGLGTQVTVSSAHSVNVLATSFPPSSGAFREDLAEYIQPILDFHGQTGSPFLINAYPFFAYKANPGSVSLPYVLFEPNPGVRDPNTNLSYDNMLYAQIDAVYAAMKAMGHTDVGVRISETGWPSKGDDDETGATVQNAAAYNGNLMQRIAMNQGTPLKPNVPIDVYVFALFNEDMKPGPASERNYGLFYPNGSPVYAINAGSGSGGGSLNPYYTSMFSSSSKLAVSTTFLTERVILLLLLQAIVILLQS

SEQ ID NO: 14472 - protein, 392 aa, Arabidopsis thaliana
  misc_feature: Useful for making plants with altered cell wall content and/or composition
MATHSLSFFFRVLLLLFLTLSERIKGQGVGINYGQIANNLPSPARVAVLLRSLNITRVKLYDADPNVLFSFSNSQVDFMIGLGNEYLQNMSTDPTKAQDWLQQRLEPHISKTRITSIVVGNEIFKTNDHVLIQSLLPAMKSVYAALTNLGLEKQVTVTSAHSLDILSTSYPPSSGSFKEEFIQYLQPLLDFHSQIESPFLINAYPFFAYKDSPKEVPLEYVLFQPNQGMVDPNTNLHYDNMLFAQVDALYSAIKTLGHTDIEVRISETGWPSKGDENEIGASPENAALYNGNLLKLIQQRKGTPAKQSVPIDVYVFALFNENLKPGPVSERNYGLFYPDGKPVYNVGMQGYLPDIIYTSRATTIKILNLWRVVMGLAVAWFILDMGDKMRMR

SEQ ID NO: 14473 - protein, 265 aa, Arabidopsis thaliana
  misc_feature: Useful for making plants with modulated light quality response
  misc_feature: Useful for making plants with modulated nitrogen use efficiency
MAQTMLLTSGVTAGHFLRNKSPLAQPKVHHLFLSGNSPVALPSRRQSFVPLALFKPKTKAAPKKVEKPKSKVEDGIFGTSGGIGFTKANELFVGRVAMIGFAASLLGEALTGKGILAQLNLETGIPIYEAEPLLLFFILFTLLGAIGALGDRGKFVDDPPTGLEKAVIPPGKNVRSALGLKEQGPLFGFTKANELFVGRLAQLGIAFSLIGEIITGKGALAQLNIETGIPIQDIEPLVLLNVAFFFFAAINPGNGKFITDDGEES

SEQ ID NO: 14474 - protein, 636 aa, Arabidopsis thaliana
  misc_feature: Useful for making plants with altered cell wall content and/or composition
MGLNFREKAWILLGILCCSSLICSVKAIVTYDRKAVIINGQRRILLSGSIHYPRSTPEMWPDLIQKAKDGGLDVIQTYVFWNGHEPSPGQYYFEDRYDLVKFIKVVQQAGLYVHLRIGPYVCAEWNFGGFPVWLKYVPGMVFRTDNEPFKAAMQKFTEKIVRMMKEEKLFETQGGPIILSQIENEYGPIEWEIGAPGKAYTKWVAEMAQGLSTGVPWIMCKQDDAPNSIINTCNGFYCENFKPNSDNKPKMWTENWTGWFTEFGGAVPYRPAEDIALSVARFIQNGGSFINYYMYHGGTNFDRTAGEFIATSYDYDAPLDEYGLPREPKYSHLKRLHKVIKLCEPALVSADPTVTSLGDKQEAHVFKSKSSCAAFLSNYNTSSAARVLFGGSTYDLPPWSVSILPDCKTEYYNTAKVRTSSIHMKMVPTNTPFSWGSYNEEIPSANDNGTFSQDGLVEQISITRDKTDYFWYLTDITISPDEKFLTGEDPLLTIGSAGHALHVFVNGQLAGTAYGSLEKPKLTFSQKIKLHAGVNKLALLSTAAGLPNVGVHYETWNTGVLGPVTLNGVNSGTWDMTKWKWSYKIGTKGEALSVHTLAGSSTVEWKEGSLVAKKQPLTWYKVRETEESMNHDHQQS

SEQ ID NO: 14475 - protein, 527 aa, Panicum virgatum
  misc_feature: Useful for making plants with altered carbohydrate content
MNHSAKMTPALRLLLAFLAIGSCIAADNIDLWPMPKMVSHGTQKLYIKKDITMSMVGSTYSDDKSILKDAFQRMVDLITLNHVVDGMNPSSLVLTCINIVVHTTEDELNFGADESYNLTVPTTGDPLYAQIEAQTVFGALHGLQTFGQLCYFDFTSRLIGLNSAPWIITDTPRFPYRGLLIDTARHYLPVKIIKGVIDAMTYSKMNVLHWHIVDEQSFPIEIPSYPKLWNGSYSYSERYTMSDAMDIVRYAERRGVNVLAEIDVPGHARSWGVGYPSLWPSDSCREPLDVSKNFTFEVIDGILSDFSKIFKFKFAHLGGDEVNTSCWTKTPHIEGWLNNSHMNASDAYRDFVLRSQKIAISHGYDIINWEETFNNFGDKLDRKTVVHNWLGEDVAPKVVATGLRCIVSNQDKWYLDHLDASWEGFYMNEPLKGIDDTKQQHLVIGGEVCMWGEEIDASDIEQTIWPRAAAAAERLWTPIEKLANDTRLVTSRLARFRCLLNQRGVAAAPLAGYGRASPAEPGPCVRQ

SEQ ID NO: 14476 - protein, 490 aa, Arabidopsis thaliana
  misc_feature: Useful for making plants with altered cell wall content and/or composition
MAQKLNLLNLAVPPVTHRSNFPSTFTFGVATSAYQIEGGWNEGKKGPSIWDKFTHIEGKILDGSNGDVAVDHYHRYKEDVDLIGQLGFGAYRFSISWSRIFPDGLGTEVNEEGIAFYNDLINTLLEKGIQPYVTLYHWDLPSHLQEAIGGWTNRKIVDYFGLYADACFANFGDRVKHWITLNEPLQTSVNGHCIGIFAPGRNEKPLIEPYLVSHHQVLAHATAVSIYRSKYKESQGGQIGLSVDCEWAEPNSEKPEDKVAADRRIDFQLGWFLDPLFFGDYPASMRQKLGDNLPRFTPEEKEFMLQNSWDFLGLNHYTSRLISHVSNKEAESNFYQAQELERIVELENGDLIGERAASDWLYAVPWGIRKTLNYMSKKYNHPPIFITENGMDDEDDGSASIHDMLDDKRRVDYFKSYLANVSQAIEDGVDIKGYFAWSLLDNFEWAQGYTKRFGLVYVDYKNGLTRHPKSSAYWFMKFLKGDEENKGKKE

SEQ ID NO: 14477 - protein, 480 aa, Panicum virgatum
  misc_feature: Useful for making plants with altered carbohydrate content
MKTRSSARGEPRRLGNVALLALMLCSVVALSLIRGRFAPIVNSAGDAIKSEEEAAAVSKAAVNIDTGDGADEAAAEAAAEEKDKEEAQPKPTAAAAKPVCYETSHRSDTCEAAGDVRVMGSSQTVYVDTLDREWKTKPYCRKHDNFALSHVKEWTLKPLPSGAAPRCTVNSTATAFVLSTGGFTGNPFHDYTDVLIPAFITAHHLGGEVQFLVSSYKSWWVNRYIQIFQQMSRHEVVDIDADDDVRCYRNVVVGPTFHRELGVDASKTPSGYSTADFRKMLRDAFGLERATATPSGDQWDIRRRPRLLIISRRPSRGRAFMNERAMADMAASLGFDVRIGEPDTSTDTSKFARLVNSCDVMVGVHGAGLTNMVFLPAGAVVVQVVPYGRLEWLARNTFAEPSAGMEVHYLEYAVQLDETTLSEQYPSDHPALRDPMAIHKQGWNALKTTYLDKQNVRPHLGRLKNTFLQALKMLPHGRDD

SEQ ID NO: 14478 - protein, 562 aa, Arabidopsis thaliana
  misc_feature: Useful for making plants with altered cell wall content and/or composition
MLTKTNDSRLIDRSSGFDQRTGIYHSLRPSLSLPPIDQPLSAAEFALSLLLKSSPPATAGKNIEALTYLVNSSSGDNLTYGELLRRVRSLAVSLRERFPSLASRNVAFILSPSSLDIPVLYLALMSIGVVVSPANPIGSESEVSHQVEVSEPVIAFATSQTVKKLQSSSLPLGTVLMDSTEFLSWLNRSDSSSVNPFQVQVNQSDPAAILFSSGTTGRVKGVLLTHRNLIASTAVSHQRTLQDPVNYDRVGLFSLPLFHVFGFMMMIRAISLGETLVLLGRFELEAMFKAVEKYKVTGMPVSPPLIVALVKSELTKKYDLRSLRSLGCGGAPLGKDIAERFKQKFPDVDIVQGYGLTESSGPAASTFGPEEMVKYGSVGRISENMEAKIVDPSTGESLPPGKTGELWLRGPVIMKGYVGNEKASAETVDKEGWLKTGDLCYFDSEDFLYIVDRLKELIKYKAYQVPPVELEQILHSNPDVIDAAVVPFPDEDAGEIPMAFIVRKPGSNLNEAQIIDFVAKQVTPYKKVRRVAFINAIPKNPAGKILRRELTKIAVDGNASKL

SEQ ID NO: 14479 - protein, 1062 aa, Arabidopsis thaliana
  misc_feature: Useful for making plants with altered cell wall content and/or composition
MAGNEWINGYLEAILDSQAQGIEETQQKPQASVNLREGDGQYFNPTKYFVEEVVTGVDETDLHRTWLKVVATRNSRERNSRLENMCWRIWHLTRKKKQLEWEDSQRIANRRLEREQGRRDATEDLSEDLSEGEKGDGLGEIVQPETPRRQLQRNLSNLEIWSDDKKENRLYVVLISLHGLVRGENMELGSDSDTGGQVKYVVELARALARMPGVYRVDLFTRQICSSEVDWSYAEPTEMLTTAEDCDGDETGESSGAYIIRIPFGPRDKYLNKEILWPFVQEFVDGALAHILNMSKVLGEQIGKGKPVWPYVIHGHYADAGDSAALLSGALNVPMVLTGHSLGRNKLEQLLKQGRQSKEDINSTYKIKRRIEAEELSLDAAELVITSTRQEIDEQWGLYDGFDVKLEKVLRARARRGVNCHGRFMPRMAVIPPGMDFTNVEVQEDTPEGDGDLASLVGGTEGSSPKAVPTIWSEVMRFFTNPHKPMILALSRPDPKKNITTLLKAFGECRPLRELANLTLIMGNRDDIDELSSGNASVLTTVLKLIDKYDLYGSVAYPKHHKQSDVPDIYRLAANTKGVFINPALVEPFGLTLIEAAAHGLPMVATKNGGPVDIHRALHNGLLVDPHDQEAIANALLKLVSEKNLWHECRINGWKNIHLFSWPEHCRTYLTRIAACRMRHPQWQTDADEVAAQDDEFSLNDSLKDVQDMSLRLSMDGDKPSLNGSLEPNSADPVKQIMSRMRTPEIKSKPELQGKKQSDNLGSKYPVLRRRERLVVLAVDCYDNEGAPDEKAMVPMIQNIIKAVRSDPQMAKNSGFAISTSMPLDELTRFLKSAKIQVSEFDTLICSSGSEVYYPGGEEGKLLPDPDYSSHIDYRWGMEGLKNTVWKLMNTTAVGGEARNKGSPSLIQEDQASSNSHCVAYMIKDRSKVMRVDDLRQKLRLRGLRCHPMYCRNSTRMQIVPLLASRSQALRYLFVRWRLNVANMYVVVGDRGDTDYEELISGTHKTVIVKGLVTLGSDALLRSTDLRDDIVPSESPFIGFLKVDSPVKEITDIFKQLSKATA

SEQ ID NO: 14480 - protein, 397 aa, Arabidopsis thaliana
  misc_feature: Useful for making plants with modulated nitrogen use efficiency
MDFNAGVPMSSLSPLMNQDAMWQMNLSSDETMETGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDNTQQ

SEQ ID NO: 14481 - protein, 397 aa, Arabidopsis thaliana
  misc_feature: Useful for making plants with modulated low light sensitivity
MDFNAGVPMSSLSPLMNQDAMWQMNLSSDETMETGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPRGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLSLRPGEPLCVFYTRYGICKFGPSCKFDHPMRVFTYDNTASETDEVVETSTGKSRRLSVSETRQAATTSSGKDTTIDNTQQ

SEQ ID NO: 14482 - protein, 371 aa, Panicum virgatum
  misc_feature: Useful for making plants with altered carbohydrate content
MKGGDVSSISPLVSFVLGAAMATVCVLFFMSASPTRRLADISAFSSGNATSSDLRLASSDSDNGVVADGDVEVTATPAPAPAPVQAASPWGDLEEVLRRAATKDRTVIMTQINAAWTRPGSLLDLFFESFRSGEGGVARLLEHLVIVTMDPAAYQGCQAVHRHCYFLRTSNGVDYRSEKMFMSKDYLEMMWGRNRFQQTVLELGYNFLFTDVDVMWFRDPFRHISMAADIAISSDVYMGDPYSLRNFPNGGFLFVRSSAKTIDFYRAWQQGRWRFFGKHEQDVFNLIKHDMAAKLDLAIQFLDTTYISGFCQLSKDLNKICTLHANCCVGLGAKLHDLRGVLDVWRNYTAGTPQDRRAGKFQWKLPGICIH

SEQ ID NO: 14483 - protein, 206 aa, Arabidopsis thaliana [sequence omitted]

SEQ ID NO: 14484 - protein, 206 aa, Arabidopsis thaliana
  misc_feature: Useful for making plants with modulated nitrogen use efficiency
  misc_feature: Useful for making plants with modulated phosphate use efficiency
MKHNNVIPNGHFKKHWQNYVKTWFNQPARKTRRRIARQKKAVKIFPRPTSGPLRPVVHGQTLKYNMKVRTGKGFTLEELKAAGIPKKLAPTIGIAVDHRRKNRSLEGLQTNVQRLKTYKTKLVIFPRRARKVKAGDSTPEELANATQVQGDYLPIVREKPTMELVKLTSEMKSFMAFDKIRLERTNKRHAGARAKRAAEAEKEEKK

SEQ ID NO: 14485 - protein, 418 aa, Panicum virgatum
  misc_feature: Useful for making plants with altered carbohydrate content
MGRERRPWPAAAAAVLLLVASCVAAAPLQQHQRARITGDAGGVLDDNPVGKLKVFVYEMPRKYNQMLLSKDSRCLHHMFAAEIFMHQFLLSSAVRTLDPEEADWFYTPVYTTCDLTPQGFPLPFRAPRIMRSAIKYVATTWPYWNRTEGADHFFLTPHDFGACFHYQEERAMERGILPLLRRATLVQTFGQRNHVCLQEGSITIPPYANPHKMQAHLINPGTPRSIFVYFRGLFYDMGNDPEGGYYARGARASVWENFKDNPLFDISTEHPSTYYEDMQRAIFCLCPLGWAPWSPRLVEAVVFGCIPVIIADDIVLPFADAIPWEQISVFVAERDVPRLDSILTSIPLQDILRKQRLLAGASVKQALLFHQPARPGDAFDQILNGLARQLPHGKGVFLQPGEKVLDWDAGLESDLKPW

SEQ ID NO: 14486 - protein, 165 aa, Triticum aestivum
  misc_feature: Useful for making plants with modulated cold sensitivity
MIEAMLPLLKPSPYGGRIVNVSSRLGRANGRRNKIGDAILREQLLTDDCLSEELIGGIVTKFLEQVKQNSWSSIEWPQMYTDYSISKLAVNVYTRLMAKRLADRSEGQKIYINCFCPGWVKTAMTDWEGNISAEEGADTGVWLALLPQAQATIGKFYAERREISF

SEQ ID NO: 14487 - protein, 380 aa, Arabidopsis thaliana
  misc_feature: Useful for making plants with altered cell wall content and/or composition
MSAILAAAIGGAVGALALIALFVFLLWFCVFRRKNLSRTSETGSSDPSTQEGRNVAIELSMREARRFEMEELAQATKSFTNKSLIGIGKFGEVYKGLLQDGVLVAIKKRPGLPTQEFVNEVRYLSSIHHRNLVTLLGFCQESNTQFLVYEYVPNGSVSSHLYGAGGKVPGNRLEFRHRLAISIGAAKGLAHLHSLSPRLIHKDFKTANVLVDENFIAKVADAGVRNFLGREDVGTSSHIVADQIFLSPEVQEFKRFSEKSDVYAFGVFLLELVSGREASEPSPSSSTQTLVDWMQNLTDYADIPMMIDERLGGTYTAEGVEELITLTLRCVDVSSEKRPTMSFVVTELERILDKEVSLTTVMGEGTPTVTLGSQLFKATK

SEQ ID NO: 14488 - protein, 333 aa, Panicum virgatum
  misc_feature: Useful for making plants with altered carbohydrate content
MAKQQGVVASMVALALLLGTFAAIPTGVQSIGVCYGVNGGGLPSAGDVVRLYQSNGINLMRIYFPDADALRALSGTNIGLIMDVPNENLGSIASDPNAAAAWVRDNVQAFPAVSFRYIAVGNEVAGGDTASILPAMRNIDAALADAGLGAVKVSTAVQSGVTQGFPPSAGSFSQGHMGPIAQYLQSTGAPLLANVYPYFSYIGNKAQIDINYALFTSPGTVVQDGGNAYQNLFDALVDTFYSALENAGAGNVGIVVSESGWPSAGGDAATAANAQTYNQNLINHVGQGTPKRPGPIEIYIFAMFNEDRKPGAETEKHFGLFNPDQSPAYPISF

SEQ ID NO: 14489 - protein, 81 aa, Arabidopsis thaliana
  misc_feature: Useful for making plants with altered cell wall content and/or composition
VVSESGWPTAGGAATGVDNARTYVNNLIQTVKNGSPRRPGRATETYIFAMFDENSKQGPETEKFWGLFLPNLQPKYVVNFN

SEQ ID NO: 14490 - protein, 338 aa, Panicum virgatum
  misc_feature: Useful for making plants with altered carbohydrate content
MARQQVASSMLAVALIVASIPTAVDSIGVCYGVVGNNLPSRSDVVQLYRSRGITGMRIYFPDRQALDALRGSGIALILDTGNDDNVLARLASSASTAASWVQTNVRPYYPAVNMKYIAVGNEVQGAAAQARILPAMRNLDAALAAAGLGGSIKVSTSVRFDAVASSFPPSSGVFAQGYMADVARYLAGTGAPLLANVYPYFAYRGNPRDISLGYATFRPGSTTVRDGGNGLTYTNLFDAMVDAVVAALEKAGAPNVRVVVSESGWPSAGGFAASVDNARSYNQGLIDHVGRGTPKRPGAALETFIFAMFNENQKGGDPTERNFGLFYPNKQPVYPIRF

SEQ ID NO: 14491 - protein, 336 aa, Panicum virgatum
  misc_feature: Useful for making plants with altered carbohydrate content
MARQQVIASSMLAVALIVGAFASIPTAVESIGVCYGVVGNNIPSRSDVVQLYRSRGITGMRVYFPDSQALDALRGSGIALILDTGNSDDVLARLASSAASWVQTNVRPYYPAVSIKYIAVGNEVQGAAAQGRILPAMRSLDAALAAAGLGAIKVSTSVRFDAVANSFPPSSGAFAQGYMADIARYLAGTGAPLLANVYPYFAYRGNPRDISLGYATFRPGTTVRDSGNGLAYTNLFDAMVDAVVAALEKAGAPNVRVVVSESGWPSAGGFGASVDNARSYNQGLVDHVGRGTPKRPGALETFIFAMFNENQKDGDPTERNFGLFFPNKQPVYPIRF

SEQ ID NO: 14492 - protein, 462 aa, Zea mays
  misc_feature: Useful for making plants with altered lignin content
MFGRAPKKSDNTKYYEILGMPKSASQDDLKKTYRKAAIKNHPDKGGDPEKLLHMHFHHIICDRHEIPRHEIKKALAKALTTDQLFYLREQFTLFGPNKSGHISLQNMKTMLCEDRGIFLEIADFIKGLGLTILRGVMEERSSGRSRGFGYVTFASADDAKNVLDCEHVLGSRTLEVKIATPKEEMKSQGTKKATRIFVARIPQSVDESMFRRHFEAFGEILDLYMPKEHGSKGHRGIGFITFQSAESVDSIMQESHELDGTTVVVDRATPKEEDVRYPPSRPSQGGYGAYNAYISAATRYATLGAPTLYDHPGSAYGRGYYGSSQAVGKKIFVGRLPQEANTDDLRHYFGRFGRIVDAYIPKDPKRSGHRGFGFVTFADEGVAERVSRRSHEILGHEVAIDTAAPLENDSAGGGYIDPMDLYGAYGSMRSFGRFCGGLDYNYGYGPSSGSSRSRSDWRYRPY

SEQ ID NO: 14493 - protein, 379 aa, Arabidopsis thaliana
  misc_feature: Useful for making plants with modulated biomass
MERKLVVLGIPWDIDSDGLKDYMSKFGDLEDCIVMKDRSTGRSRGFGYVTFASAEDAKNALKGEHFLGNRILEVKVATPKEEMRQPAKKVTRIFVARIPSSVSESDFRSHFERYGEITDLYMPKDYNSKQHRRIGFITFSSADSVEDLMEDTHDLGGTTVAVDRATPKEDDHPPRPPPVARMSRPPVAIAGGFGAPGGYGAYDAYISAATRYAALGAPTLYDNPATFYGRGEPTTRGIGNKIFVGRLPQEASVDDLRDYFGRFGHIQDAYIPKDPKRSGHRGFGFVTFAENGVADRVARRSHEICGQEVAIDSATPLDEAGPSAGASSMLSSSRPEYFGGYGGPMRAFGRMYGGMSLDDWGYGMPNARPSRPDRRYRPY

SEQ ID NO: 14494 - protein, 337 aa, Panicum virgatum
  misc_feature: Useful for making plants with altered carbohydrate content
MARRRGVAPVLAAALVVAALAATATSVRAIGVCYGVIGSGLPSKSDVVQLYKSHGIGNMRFYFADQDVLKALRGSGIGLALDVGNENLRDLAANPASAASWVKDNVQAYYPDVNIRYIVVGNEVDGAASVLQAMQNVHDALTSANLASSIKVSTAVKMDVLDDNSSPPSNGVFRDPSVMSPIVQFLAGNGAPLLANVYPYFAYKDSQGIDLNYALFEPSSTTVVDTNGLTYTNLFDAMVDAIHAALDKVGGGGVDVVVSESGWPSADGRGASVENARTYNQNLINHAGKGTPRKPGPMEVYVFAMFNEDKKDGDPTEKKFGLFNGPDKTPVYPINFA

SEQ ID NO: 14495 - protein, 276 aa, Arabidopsis thaliana
  misc_feature: Useful for making plants with modulated drought sensitivity
MEILPIPAESFKVGFIGAGKMAESIARGVVASGVLPPNRICTAVHSNLNRRDVFESFGVNVFSTSEEVVKESDVVIFSVKPQVVKKAVTELKSKLSKNKILVSVAAGIKLNDLQEWSGQDRFIRVMPNTPAAVGEAASVMSLGTGATEEDGAIVAMLFGAVGKILKADEKMFDAVTGLSGSGPAYIFLAIEALADGGVAAGLPRELALSLASQTVLGAATMVSKTGKHPGVLKDDVTSPGGTTIAGVHELEKGSFRATLMNAVVAAAKRSRELSQS

SEQ ID NO: 14496 - protein, 315 aa, Arabidopsis thaliana
  misc_feature: Useful for making plants with altered alkaloid content
  misc_feature: Useful for making plants with altered terpenoid content
MQVTKVARMLAAKSEIDVKGCTVMALLDGGTLRRHKSWLKAEPPAILVATVASLCHMLEKHIFRIDSVRVLVVDEVDFLFYSSKQVGSVRKLLTSFSSCDKRQTVFASASIPQHKHFVHDCIQQKWTKRDVVHVHVSAIMPMPLCLLHRFVMCEKTNKHQVLLALLESDAPESAIIFVGEQSEKSKKAGNDPSTTLLMEFLKTSYKGSLEILLLEGDMNFNSRAASLTEIRQGGGFLLVSTDIAARGIDLPETTHIFNFDLPQTVTDYLHRAGRAGRKPFSDRKCIVANLITSEERFVLQRYENELMFSCEEMML

SEQ ID NO: 14497 - protein, 390 aa, Panicum virgatum
  misc_feature: Useful for making plants with altered carbohydrate content
MSSPPARMDLDGNPVAPLTICMIGAGGFIGSHLCEKLMAETAHVVLAVDVYCDKIRHLVDPAPPHLAGRISFHRLNIKNDSRLEGLIKMADLTINLAAICTPADYNTRPLDTIYSNFIDALPVVKYCSENNKRLIHFSTCEVYGKTIGSFLPKDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVVLMIENPARANGHIFNVGNPNNEVTVRELAQMMTEVYANVSGEAPLDEPMIDVSSSQFYGEGYDDSDKRIPDITIINKQLGWNPKTPLKDLLETTLTYQHKTYKEAVKRQMSQASASS

SEQ ID NO: 14498 - protein, 389 aa, Arabidopsis thaliana
  misc_feature: Useful for making plants with altered cell wall content and/or composition
  misc_feature: Useful for making plants with altered lignin content
MANGADRLDLDGKPIKPMTICMIGAGGFIGSHLCEKLMTETPHKVLALDVYNDKIKHLLEPDTVQWAGRIQFHRINIKHDSRLEGLIKMADLTINLAAICTPADYNTRPLDTIYSNFIDALPVVKYCSENNKRLIHFSTCEVYGKTIGSFLPKDHPLRQDPEFYVLKEDISPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTEVYAKVSGETAIESPTIDVSSKEFYGEGYDDSDKRIPDMTIINRQLGWNPKTSLWDLLESTLTYQHTTYAEAIKKATSKPVAS

SEQ ID NO: 14499 - protein, 257 aa, Arabidopsis thaliana
  misc_feature: Useful for making plants with altered cell wall content and/or composition
MAMLGLVLSVLTTILALSEARIPGVYNGGGWETAHATFYGGSDASGTMGGACGYGNLYSQGYGVNTAALSTALFNNGFSCGACFELKCASDPKWCHSGSPSIFITATNFCPPNFAQPSDNGGWCNPPRPHFDLAMPMFLKIAEYRAGIVPVSFRRVPCRKRGGIRFTINGFRYFNLVLVTNVAGAGNIVRLGVKGTHTSWMTMSRNWGQNWQSNSVLVGQSLSFRVTSSDRRSSTSWNIAPANWKFGQTFMGKNFRV

SEQ ID NO: 14500 - protein, 138 aa, Arabidopsis thaliana
  misc_feature: Useful for making plants with modulated drought sensitivity
MSGEEEENAAELKIGDEFLKAKCLMNCEVSLILEHKFEQLQQISEDPMNQVSQVFEKSLQYVKRFSRYKNPDAVRQVREILSRHQLTEFELCVLGNLCPETVEEAVAMVPSLKTKGRAHDDEAIEKMLNDLSLVKRFE

SEQ ID NO: 14501 - protein, 258 aa, Arabidopsis thaliana
  misc_feature: Useful for biocontainment applications
  misc_feature: Useful for making plants with modulated biomass
MSISMALFSPPISSSLQNPNLIPKISTSLLSTKRFSLISVPRASSDNGTTSPVVKIPKPASVAVEEVPVKSPAESSSASENGAVGGEATDSSTETVIKYQNAKWVNGTWDLKQFEKDGKTDWDSVIVSEAKRRKWLEDNPETTSNDELVVFDTSIIPWWAWMKRYHLPEAELLNGRAAMIGFFMAYFVDSLTGVGLVDQMGNFFCKTLLFVAVAGVLFIRKNEDLDKLKDLFDETTLYDKQWQAAWKEPDSSTVSSKK

SEQ ID NO: 14502 - protein, 357 aa, Arabidopsis thaliana
  misc_feature: Useful for making plants with altered cell wall content and/or composition
MRDSIYLLWIDNRLVVIIMMVMMVSCRCVLGLENINPIFFDEGLSHLFGEGNLIRSPDDRSVRLLLDKYTGSGFISSSMYQHGFFSSLIKLPGAYTAGIVVAFYTSNGDVFVKDHDELDIEFLGNLEGKPWRFQTNMYGNGSTNRGREERYRLWFDPSKEFHRYSILWTPTKIIFWVDDVPIREILRKEEMNGDYPQKPMSLYATIWDASSWATSGGKFGVDYTFSPFVSEFKDIALDGCNVSDSFPGENNNNNIGNYNNINCSVSDQFLMSNDYSTISPKQATAMRRFRERYMYYSYCYDTIRYSVPPPECVIVTAEKNRFRDTGRLKFGGSHPKVHKARKKRRRNRSTPVVSADL

SEQ ID NO: 14503 - protein, 112 aa, Arabidopsis thaliana
  misc_feature: Useful for making plants with modulated biomass
MAGISRVLGGFRTLMSKAATVEAVTVAGEGKGIFKTRPVSQQLASFAGERELTRGSALKKVWEYVKLHNLQNPANKKEIHCDDKLKTIFDGKDKVGITEIMKLLSPHFPKSV

SEQ ID NO: 14504 - protein, 510 aa, Panicum virgatum
  misc_feature: Useful for making plants with altered carbohydrate content
MGAGRRGGMRATLLLVLVALSFVTVARAAASGGGGAGGEDGERFLRLWTTDGGGEADGQEEDFFKWDEEEDDDDEAEEGHVMAWGKGTERPATCRNVVNVDTFGAAGDGDADDTEAFSSAWKTACSLDNAVFLVPAGRRYKVGAITFMGPCKAKIIIQIQGTIVAPEEPSEWDPRSPRLWLLFSGLAGARIQGGGVIDGSGSKWWANSCKINKSNPCKAAPTAVTIDSSRGVRVKGLRVQNAQQMHLTVYRSRNVRLAGVRIEAPEDSPNTDGIHVAESTAVTIQNCRIGTGDDCISIVNASFNIRMKNIDCGPGHGISIGSLGKDGTFAAVENVALDTARISRAQNGVRIKTWQGGAGYVQNVRFSNVAVDDVDHPIVIDQFYCDARAGPCRSSTSSGVQVANVAYLNISGTSRRAEAIRFACSDAAPCTDIVLRDINLRRSGGDGGGGEVQTVCNCAIGFDYGRVSPAADCLRSSTCGGAPDHRPDDDDGKGKAVAGTMPAPILHTEL

SEQ ID NO: 14505 - protein, 468 aa, Arabidopsis thaliana
  misc_feature: Useful for making plants with altered cell wall content and/or composition
MIKPFIISLFALLMVASYGATGKMLFKELDILGKLENLDVPEDDIEDDVTFFDFSSFTSQYSGKNLVNVDSFNASGDGVSDDTQAFIRAWTMACSAPNSVLLVPQGRSYLVNATKFDGPCQEKLIIQIDGTIIAPDEPSQWDPKFPRNWLQFSKLQGVVFQGNGVIDGSGTKWWAASCKKNKSNPCVGAPTALTIYSSSNVYVRGLTIRNSQQMHLIIQRSTTVRISRVMVTSPGDSPNTDGIHITASTDVVVQDSKISTGDDCVSIVNGSAKIKMKRIYCGPGHGISIGSLGQGHSKGTVTAVVLETAFLKNTTNGLRIKTWQGGNGYVKGVRFENVVMQDVANPIIIDQFYCDSPSTCQNQTSAVHISEIMYRNITGTTKSSKAINFKCSDAVPCSHIVLNNINLEGNDGKVEAYCNSAEGFGYGVVHPSADCLYSHDDKSLNQTDQYLAETIMVEKETENAHDEL

SEQ ID NO: 14506 - protein, 552 aa, Panicum virgatum
  misc_feature: Useful for making plants with altered carbohydrate content
MRITGSGATAVAAASLRLRPGRLGEVLAVALLFASASLSSLAGAESPPAAAAGRHDYEDALHKSLLYFEAQRSGRLPHGQRVAWRDHSGLTDGLEQGVDLVGGYYDAGDHVKFGLPMAFTVTMLSWSLLEYGADVADAGELAHALESIKWGTDYFIKAHTQPDELWAEVGDGDTDHYCWQRPEDMTTSRQAYKVDRERPGSDVAGETAAAMAAASMVFREHNPHYASLLLHHALQLFEFADKYRGKYDSSIAEVKSYYASVSGYHDELLWAALWLHRATGRAEFLDYAVDNAHAFGGTGWAITEFSWDVKYAGVQILAARLLLRGEHSPRHRETLERYRAKAEHYVCACLGRNAAGGADANVERSPGGMLYIRQWNNMRYVTSAAFLLSVYSGYLLSPAAAGAAGEAVAACAGGGAATAGEVFAMARSQVDYVLGSNPRGVSYLVGYGARFPARVHHRAASIVPYKHSREFIGCAQGFDDWFVRKGANPNVVVGAIVGGPDRRDRFRDHRENYMQTEACTYNTAPMVGMFAMLNRLARDEVTAAAADTSVNR

SEQ ID NO: 14507 - protein, 332 aa, Panicum virgatum
  misc_feature: Useful for making plants with altered carbohydrate content
MARMALAAALVVVAVAGVLAGGARAQLVEGFYAQSCPQAEKIIKDYVAEHVPRVPTIAATLLRTHFHDCFVRGCDASLLLNATGGKEAEKDAAPNKTLRGFGFIDRIKEILEKECPGVVSCADVLALAARDSVVVTGGPSWSVPTGRRDGTVSLKQEALDNIPAPTMNFTELLQNFQNKSLNLADLVWLSGAHTIGIGHCNTFSERLYNFTGRGGPSDADPSLDPAYADNLRRTKCKTLTDNTTIVEMDPGSFRTFDLSYYRGVLKHRGLFQSDAALLNDATAKADILFVVNSPPEVFFQVFAASMVKLGAVEVKTGSEGEIRKHCAVVNKH

SEQ ID NO: 14508 - protein, 418 aa, Panicum virgatum
  misc_feature: Useful for making plants with altered carbohydrate content
MGKGLIPADLDTWKQRRKVITPGFHALFIEAMVRIFTKCSERTISKLEQLTASEGQVVMDLEAEFSNLALDIIGLGVFNFDFDSVTKESPVIKAVYGTLFEAEHRSTFYIPYWNLPFTKWIVPRQRKFHSDLKVINDCLDYLIKNAKETRQEADVEKLQQRDYTSLKDVSLLRFLVDMRGADVDDRQLRDDLMTMLIAGHETTAAVLTWSVFLLAQSPTKMRKAQAEVDSVLSNGAITVESLKKLEYIKLIILEALRLYPQPPLLIRRSLQPDKLPGGYNGAKEGYEIPTGTDIFVSAYNLHRSPYFWDRPNEFEPERFSVPKKEESIEGWSGFDPGRSPGAMYPNEIIADFAFLPFGGGPRKCVGDQFALLESTVALSLLLQKFDVELRGSPDEVEMVTGATIHTKNGLWCRLRRRT

SEQ ID NO: 14509 - protein, 364 aa, Panicum virgatum
  misc_feature: Useful for making plants with altered carbohydrate content
MGSLASERTVVGWAARDATGHLSPYTYTVRKTGPEDVVVKVLYCGICHTDIHQAKNHLGASKYPMVPGHEVVGEVVEVGPEVSKHRVGDVVGVGVIVGCCRECRPCKANVEQYCNKRIWSYNDVYTDGRPTQGGFASTMVVDQKFVVPIPAGLAPEQAAPLLCAGVTVYSPLKHFGLTAPGLRGGILGLGGVGHMGVKVAKAMGHHVTVISSSSRKRAEAMDELGADAYLVSSNAEAMAAAADSLDYIIDTVPVHHPLEPYLALLRLDGKHVLLGVVGEPLSFVAPMVMLGRKAVTGSFIGSIDETAELLRFCVDKGLTSQIEVVKMGYVNEALERLERNDVRYRFVVDVAGSNIEEATGAPAN

SEQ ID NO: 14510 - protein, 578 aa, Arabidopsis thaliana
  misc_feature: Useful for making plants with altered lignin content
MGSVEAGEKKALGWAARDPSGVLSPYSYTLRSTGADDVYIKVICCGICHTDIHQIKNDLGMSNYPMVPGHEVVGEVLEVGSDVSKFTVGDVVGVGVVVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAIEHLGADDYVVSSDPAEMQRLADSLDYIIDTVPVFHPLDPYLACLKLDGKLILMGVINTPLQFVTPLVILGRKVISGSFIGSIKETEEVLAFCKEKGLTSTIETVKIDELNIAFERLRKNDVRYRFVVDVAGSNLVEEAATTTNMGSVEAGEKKALGWAARDPSGVLSPYSYTLRSTGADDVYIKVICCGICHTDIHQIKNDLGMSNYPMVPGHEVVGEVLEVGSDVSKFTVGDVVGVGVVVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISS

SEQ ID NO: 14511 - protein, 357 aa, Arabidopsis thaliana
  misc_feature: Useful for making plants with altered cell wall content and/or composition
  misc_feature: Useful for making plants with altered lignin content
MGIMEAERKTTGWAARDPSGILSPYTYTLRETGPEDVNIRIICCGICHTDLHQTKNDLGMSNYPMVPGHEVVGEVVEVGSDVSKFTVGDIVGVGCLVGCCGGCSPCERDLEQYCPKKIWSYNDVYINGQPTQGGFAKATVVHQKFVVKIPEGMAVEQAAPLLCAGVTVYSPLSHFGLKQPGLRGGILGLGGVGHMGVKIAKAMGHHVTVISSSNKKREEALQDLGADDYVIGSDQAKMSELADSLDYVIDTVPVHHALEPYLSLLKLDGKLILMGVINNPLQFLTPLLMLGRKVITGSFIGSMKETEEMLEFCKEKGLSSIIEVVKMDYVNTAFERLEKNDVRYRFVVDVEGSNLDA

SEQ ID NO: 14512 - protein, 236 aa, Panicum virgatum
  misc_feature: Useful for making plants with altered carbohydrate content
ARWRFVNADECLMTRMQEMSLDYHFTVEQEVSSSVCAFFGFNGTAGVWRISAINEAGGWKDRTTVEDMDLAIRASLKGWKFVYLGDVQVKSELPSTFKAFRFQQHRWSCGPANLFRKMLMEIVTNKKVTIWKKIHVIYNFFLIRKIVAHIITFSFYCLVIPATIFVPEVRIPKWGCVYIPSAITLLNSVGTPRSFHLLFFWVAFENVMSLHRTKATLIGLLEAGRANEWVVTAKLG

SEQ ID NO: 14513 - protein, 141 aa, Zea mays
  misc_feature: Useful for making plants with modulated nitrogen use efficiency
MQDPRDDDFLAPKLHKKKVVYRPQPSGHLKGEPELLRREFPQSSGMVQKPPKRSLKGEPRTPPSDRGTPDSLPESGPTDEYRALRRKYLMLEEENFALDKELSMEDEEMKALEDEKLALLDQLVVLEGLVEPSQLQSQPRP

SEQ ID NO: 14514 - protein, 491 aa, Panicum virgatum
  misc_feature: Useful for making plants with altered carbohydrate content
AAVEVRVREVRDPRFFPILCDPLSRATAEAEVAAGESSRRFPALEGPRPVYGTCCPGAMPRPGTEVRSKALLACTSHAAGSCCGSLLLGSCSTLRNCGTATMVPRMLLLLCFCLLAFPPPGPLAVEAFVGGYGINYGRIANNIPSPDKVVELLKKSKIRNVKIYDSDHNILDAFKGSGLNLVIAIPNELVKDMAANESRSMDWLNQNVKPYLPQTRIVGITVGNEVLGGQDQSLYQPLVDAVKNVYNGLKRLHLEKEIELFTPHSEAVFANSYPPSACVFKEELMPYMKPLLDLFAMIHSPFYVNSYPFLAYISDPEHIDINYALFKPNNGIVDPNTSLHYDNMFDAQIDAAYAALHAAGYDDMEVRVAETGWASSGDQNEAGASSENARTYNFNLRKRLFLRKGTPLKPKRPVKAYIFALFNENQKPGPSSERHYGLFLPDGRISYDIGVSGLLPSSASSSMLSVKKIRAGGWILHYLAMVLLSIFIFGP

SEQ ID NO: 14515 - protein, 399 aa, Arabidopsis thaliana
  misc_feature: Useful for making plants with altered cell wall content and/or composition
MGYCVPLRKSPTSHMVFSSFFLSFLLVFSILSSQTAVAFIGTYGVNYGRIADNLPSPDAVATLLKSAKIRNTRIYDADHSVLTAFRGTGIEIIVGLGNEFLKDISVGEDRAMNWIKENVEPFIRGGTKISGIAVGNEILGGTDIGLWEALLPAAKNVYSALRRLGLHNVVEVSSPHSEAVFANSYPPSSCTFRDDVAPFMKPLLAFFWQIQSPFYINAYPFLAYKSDPITIDINYALFEHNKGILDPKTKLHYDNMFDAMVDASYAALEKAGYTKVPVIVSETGWASKGDADEPGASVKNARTYNRNLRKRLQKRKGTPYRPDMVVRAYVFALFNENSKPGPTSERNFGLFKPDGTIAYDIGLTGLKSSSATRYRFKSSLVSASAFTCLLLLFHRLFHL

SEQ ID NO: 14516 - protein, 360 aa, Panicum virgatum
  misc_feature: Useful for making plants with altered carbohydrate content
MHNNNWAVLVCTSRFWFNYRHMANTLSLYRTVKRLGIPDERIILMLADDMACNPRNSYPAQVFNNENHQLNLYGDNVEVDYRGYEVTVENFLRVLTGRHESAVPRSKRLLSDEGSHILLYMTGHGGDEFLKFQDSEELQSHDLADAVKQMKEKHRFKELLIMVDTCQAATLFSQLHSPGVLAIGSSMKGENSYSHHLDSDIGVSVVDRFTYYTLAFFEKLNMYSNASLNSLFNSYDRSMLMSTAYYRMDLYERPLNEVPVTNFFGSVMKTLHTDSAYTGFLSAHDDETPMSIRDNQHDHFMSKNEARARRSNKEKEAQIIPHGWTEVLLEQLEGKNTDTVVLYGLGAMGILLALSTWLSM

SEQ ID NO: 14517 - protein, 388 aa, Arabidopsis thaliana
  misc_feature: Useful for making plants with altered cell wall content and/or composition
MKILTLVMLLCYSFVSSTGDTTIHTNNWAVLVCTSRFWFNYRHMANTLSLYRTVKRLGIPDERIILMLADDMACNARNEYPAQVFNNENHKLNLYGDNVEVDYRGYEVTVENFLRVLTGRHENAVPRSKRLLSDEGSHILLYMTGHGGDEFLKFQDAEELQSHDLADAVKQMKEKRRFKELMIMVDTCQAATLFNQLQSPGVLAIGSSLKGENSYSHHLDSDIGVSVVDRFTYYTLAFFERLNIYDNASLNSLFRSYDPRLLMSTAYYRTDLYQPHLVEVPVTNFFGSVMETIHTDSAYKAFSSKISERKINSEMPFNQLSEHDLKEELENTNIPNDELIAEKQKCPYSQMRADLHEKVEKLENVDTVVNLSIAVMVLAVMVSSSLLR

SEQ ID NO: 14518 - protein, 199 aa, Arabidopsis thaliana
  misc_feature: Useful for making plants with modulated biomass
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 14519 - protein, 189 aa, Glycine max
  misc_feature: Useful for making plants with modulated biomass
  misc_feature: Useful for making plants with modulated flowering time
MVQSRKFRGVRQRNWGSWVSEIRHPLLKRRVWLGTFETADEAARAYDEAAILMSGRNAKTNFPVGENQMGNHSSSTSSSSTTTLSAVLSAKLRKCCKSPSPSLTCLRLDTENSHIGVWQKRAGPRSDSNWIMMVELEKKNNKGPSSESELPVVVVDDDAPEKVKPEESTGLDEEQKMALQMIEELLNRN

SEQ ID NO: 14520 - protein, 498 aa, Panicum virgatum
  misc_feature: Useful for making plants with altered carbohydrate content
MAPAEEPTAATLAPPPHFVIIPLAAQGHTIPMVDFARLLAERGARASIVTTPVNGARLRGVADQAARAKLALEVVELPFPTGVDGLPPGIENADQVTDDNHFIPLFDALKRLAGPLEAYLRGLAARPSCVVSDWCNGWTAGVATSLGIPRLFFHGPSCFYSLCDLNSVDHGLREHTAAAGDQDKFVVPGMPVRVEVTKATAPGFFNAPGWEALWAECVEAMRAADGAVVNTFLDLEGQFVACYEAALGKPVWALGPLCLANKGDAEAMAARGNKAEAAQQSAVTAWLDAKDAGSVVFVSFGSLVRKLLRLPLEVGHGLEDSGRPFLWVVKEAEAAAPEVQGWLAALEARTAGRGLVARGWVPQLAVLSHRAVGGFVTHCGWNSLLEAVAHGVPVVTWPHFADQFLNERLVVDVLGVGVPIGATAPVMMFDDENMPVGREDVARAVAALMGGGAEADERRRKAREYGEKAHRAMEKGGSSYENLTQLIESFRQRGGKQG

SEQ ID NO: 14521 - protein, 164 aa, Arabidopsis thaliana
  misc_feature: Useful for biocontainment applications
  misc_feature: Useful for making plants with modulated biomass
MSRPGDWNCRSCSHLNFQRRDSCQRCGDSRSGPGGVGGLDFGNFGGRAMSVFGFTTGSDVRPGDWYCTVGNCGTHNFASRSTCFKCGTFKDETGAGGGGGGIGGPAMFDADIMRSRVPGNGGRSSWKSGDWICTRIGCNEHNFASRMECFRCNAPRDFSNRTSF

SEQ ID NO: 14522 - protein, 193 aa, Arabidopsis thaliana
  misc_feature: Useful for making plants with altered cell wall content and/or composition
MLNSSYLSFALIFFCCILFSALASSLPVSDPELVVEEVHRKINESISRRKLGFFSCGSGNPIDDCWRCDKDWEKNRKRLADCGIGFGKNAIGGRDGEIYVVTDPGNDDPVNPRPGTLRYAVIQDEPLWIIFKRDMTIQLKEELIMNSFKTLDGRGASVHISGGPCITIQYVTNIIIHGLHIHDCKQGGNTYVR

SEQ ID NO: 14523 - protein, 414 aa, Arabidopsis thaliana
  misc_feature: Useful for making plants with altered alkaloid content
  misc_feature: Useful for making plants with altered lignin content
MAGMASDGTQYDPRQFDTKMNAILGEEGEETFYTNYDEVCDSFDAMELQPDLLRGIYAYGFEKPSAIQQRGIIPFCKGLDVIQQAQSGTGKTATFCSGVLQQLDISLVQCQALVLAPTRELAQQIEKVMRALGDYLGVKAQACVGGTSVREDQRVLQSGVHVVVGTPGRVFDLLRRQSLRADAIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTSEDERMMADIQRFYNVVVEELPSNVADLL

SEQ ID NO: 14524 - protein, 242 aa, Arabidopsis thaliana
  misc_feature: Useful for making plants with altered terpenoid content
  misc_feature (121)..(121): Xaa is any aa, unknown, or other
MLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKXDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 14525 - protein, 79 aa, Arabidopsis thaliana
  misc_feature: Useful for making plants with altered lignin content
  misc_feature: Useful for making plants with modulated flowering time
  misc_feature (79)..(79): Xaa is any aa, unknown, or other
MVKQELKIQVTTSSSSLSHSSSSSSSSTSALRHQSCKNKIKKYKGVRMRSWGSWVTEIRAPNQKTRIWLGSYSTAEAAX

SEQ ID NO: 14526 - protein, 1973 aa, Arabidopsis thaliana
  misc_feature: Useful for making plants with altered cell wall content and/or composition
MSHEIVPVDPIDVPSTSYSRPILGPREDSPERATEFTRSLTFREHVSSEPFDSERLPATLASEIQRFLRIANLVESEEPRIAYLCRFHAFEIAHHMDRNSTGRGDEEFTVRRRKEKSDVRELKRVYHAYKEYIIRHGAAFNLDNSQREKLINARRIASVLYEVLKTVTSGAGPQAIADRESIRAKSEFYVPYNILPLDKGGVHQAIMHLPEIKAAVAIVRNTRGLPPPEEFQRHQPFLDLFEFLQYAFGFQNGNVANQREHLILLLSNTIIRQPQKQSSAPKSGDEAVDALMKKFFKNYTNWCKFLGRKNNIRLPYVKQEALQYKTLYIGLYLLIWGEASNLRFMPECLCYIFHHMAYELHGVLTGAVSMITGEKVAPAYGGGHESFLADVVTPIYMVVQKEAEKNKNGTADHSMWRNYDDLNEFFWSLECFEIGWPMRPEHDFFCVESSETSKPGRWRGMLRFRKQTKKTDEEIEDDEELGVLSEEQPKPTSRWLGKTNFVETRSFWQIFRSFDRMWSFFVLSLQALIIMACHDVGSPLQVFNANIFEDVMSIFITSAILKLIKGILDIIFKWKARNTMPINEKKKRLVKLGFAAMWTIILPVLYSHSRRKYICYFTNYKTWLGEWCFSPYMVAVTIYLTGSAIELVLFFVPAISKYIETSNHGIFKTLSWWGQPRLYVGRGMQETQVSQFKYTFFWILVLLTKFAFSYAFEIKPLIEPTRLIMKVGVRNYEWHEIFPEVKSNAAAIVAVWAPIMVVYFMDTQIWYSVYCTIFGGLYGVLHHLGEIRTLGMLRGRFHTLPSAFNASLIPHSTKDEKRRKQRGFFPFNLGRFHKKVVYFALQGSDGQKNSMAKFVLVWNQVINSFRTEDLISNKELDLMTMPLSSEVLSGIIRWPIFLLANKFSTALSIAKDFVGKDEVLYRRIRKDEYMYYAVKECYESLKYILQILVVGDLEKKIISGIINEIEESIRQSSLLEEFKMAELPALHDKCIELVQLLVEGSAEQLQVEKSEELHGKLVKALQDIFELVTNDMMVHGDRILDLLQSREGSGEDTGIFMRVIEPQLFESYGEWRCIHFPLPDSASLSEQIQRFLLLLTVKDSAMDIPENLDARRRLSFFATSLFMDMPDAPKVRNMMSFSVLTPHYQEDINYSTNELHSTKSSVSIIFYMQKIFPDEWKNFLERMGCDNLDALKKEGKEEELRNWASFRGQTLSRTVRGMMYCREALKLQAFLDMADDEDILEGYKDVERSNRPLAAQLDALADMKFTYVVSCQMFGAQKSSGDPHAQDILDLMIKYPSLRVAYVEEREEIVLDVPKKVYYSILVKAVNGFDQEIYRVKLPGPPNIGEGKPENQNHAIVFTRGEALQTIDMNQDHYLEEAFKMRNLLQEFLRNRGRRPPTILGLREHIFTGSVSSLAWFMSYQETSFVTIGQRLLANPLRVRFHYGHPDVFDRIFHITRGGISKSSRTINLSEDVFAGYNTTLRRGCITYNEYLQVGKGRDVGLNQISKFEAKVANGNSEQTISRDIYRLGQRFDFFRMLSCYFTTIGFYFSSLISVIGIYIYLYGQLYLVLSGLQKTLILEAKVKNIKSLETALASQSFIQLGLLTGLPMVMEIGLEKGFLIAFQDFILMQLQLAAFFFTFSLGTKTHYFGRTILHGGAKYRPTGRKVVVFHANFSENYRLYSRSHFIKGFELMILLVVYELFKHTSQSNMAYSFITFSVWFMSFTWLCAPFLFNPSGFTWEIIVGDWRDWNRWIKEQGGIGIQQDKSWQSWWNDEQAHLRGSGVGARCLEIILSLRFFVYQYGLVYHLDITQSNTNIIVYALSWVVILATFFTVKAVDLGRQLFSTRKHLVFRFFKVFVFVSILTIIITLANICHLSVKDLLVSCLAFLPTGWGLILIAQAVRPKIEGTSLWEFTQVLARAYDYGMGVVLFAPMAILAWLPIISAFQTRFLFNEAFNRRLQIQPILAGKKKNR

SEQ ID NO: 14527 - protein, 358 aa, Arabidopsis thaliana
  misc_feature: Useful for making plants with altered cell wall content and/or composition
  misc_feature: Useful for making plants with altered lignin content
MADNKVNLSINGQSKVPPGFRFHPTEEELLHYYLRKKVNSQKIDLDVIREVDLNKLEPWDIQEECRIGSTPQNDWYFFSHKDKKYPTGTRTNRATVAGFWKATGRDKIICSCVRRIGLRKTLVFYKGRAPHGQKSDWIMHEYRLDDTPMSNGYADVVTEDPMSYNEEGWVVCRVFRKKNYQKIDDCPKITLSSLPDDTEEEKGPTFHNTQNVTGLDHVLLYMDRTGSNICMPESQTTTQHQDDVLFMQLPSLETPKSESPVDQSFLTPSKLDFSPVQEKITERPVCSNWASLDRLVAWQLNNGHHNPCHRKSFDEEEENGDTMMQRWDLHWNNDDNVDLWSSFTESSSSLDPLLHLSV

SEQ ID NO: 14528 - protein, 343 aa, Arabidopsis thaliana
  misc_feature: Useful for making plants with altered alkaloid content
  misc_feature: Useful for making plants with altered terpenoid content
  misc_feature (113)..(113): Xaa is any aa, unknown, or other
MSDSGEPKPSQQEEPLPQPAAQETQSQQVCTFFKKPTKSKNIRKRTIDADEEDGDSKSESSILQNLKKVAKPDSKLYFSSGPSKSSTTTSGAPERSVFHYDSSKEIQVQNDSXATATLETETDFNQDARAIRERVLKKADEALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDEDDEADKDSDEDENALPFACFICREPFVDPVVTKCKHYFCEHCALKHHTKNKKCFVCNQPTMGIFNAAHEIKKRMAEERSKAEEGL

SEQ ID NO: 14529 - protein, 480 aa, Panicum virgatum
  misc_feature: Useful for making plants with altered carbohydrate content
MARPHVMVVPYPGAGNINPALQVAKLLHRHGVYVTFVNTEHNHRRVQATEGAGAVRGREGFRFEAIPDGLSEADRGKQDYGRGLAVSTSTRCAAPLRDLIALLNATPGVPPVTCVLPTMLMSFALGVARELGIPTMAFWTGSAAALMTHMRLRELEERGYVPLKDESYLTNGYLEKTVIDWIPGMPPIRLGDFSSFLRTTDPNDFGLRFNESEANKCAKAGALILNTFDGLEADVLAALRAEYPRIYTVGPLGSLLRQNLDSAAAADDSTGLSLWKQDAECLAWLDAQEQQRSVVYVNFGSHTVLTPEQLAEFAWGLAASGHLILWCIRDNLVRGGGGGPAVLPPDFWAAAAGRCHVTAWCPQEQVLRHPAVGCFLTHSGWNSTCEGVAAGVPMVCWPGFSDQYTNCKYACEVWGVGVRLDPEVWREQVAAHVREAMESEEMRRRAAKWKEEAETATSPGGSSFENLLTMVRALSGTHES

SEQ ID NO: 14530 - protein, 488 aa, Arabidopsis thaliana
  misc_feature: Useful for making plants with altered tocopherol content
MEIRSLIVSMNPNLSSFELSRPVSPLTRSLVPFRSTKLVPRSISRVSASISTPNSETDKISVKPVYVPTSPNRELRTPHSGYHFDGTPRKFFEGWYFRVSIPEKRESFCFMYSVENPAFRQSLSPLEVALYGPRFTGVGAQILGANDKYLCQYEQDSHNFWGDRHELVLGNTFSAVPGAKAPNKEVPPEEFNRRVSEGFQATPFWHQGHICDDGRTDYAETVKSARWEYSTRPVYGWGDVGAKQKSTAGWPAAFPVFEPHWQICMAGGLSTGWIEWGGERFEFRDAPSYSEKNWGGGFPRKWFWVQCNVFEGATGEVALTAGGGLRQLPGLTETYENAALVCVHYDGKMYEFVPWNGVVRWEMSPWGYWYITAENENHVVELEARTNEAGTPLRAPTTEVGLATACRDSCYGELKLQIWERLYDGSKGKVILETKSSMAAVEIGGGPWFGTWKGDTSNTPELLKQALQVPLDLESALGLVPFFKPPGL

SEQ ID NO: 14531 - protein, 305 aa, Arabidopsis thaliana
  misc_feature: Useful for making plants with altered cell wall content and/or composition
MVSSTLLVMSISLFLGLSILLVVHGKDFNQDIDITWGDGRGNILNNGTLLNLGLDQSSGSGFQSKAEYLYGKVDMQIKLVPGNSAGTVTTFYLKSQGLTWDEIDFEFLGNVSGDPYIVHTNVYTQGKGDREQQFYLWFDPTAAFHNYSILWNPSHIVFYIDGKPIREFKNLEVLGVAYPKNQPMRMYGSLWNADDWATRGGLVKTNWSQGPFVASFMNYNSENACVWSIVNGTTTTSPCSPGDSTSSSSSSTSEWFSQRGMDSSSKKVLRWVQRKFMVYNYCKDKKRFSNGLPVECTAKNKNTKS

SEQ ID NO: 14532 - protein, 292 aa, Arabidopsis thaliana
  misc_feature: Useful for making plants with altered cell wall content and/or composition
MAGLQAKTLMFVLAAALATLGRTFVEADFSKNFIVTWGKDHMFMNGTNLRLVLDKSAGSAIKSKVAHLFGSVEMLIKLVPGNSAGTVAAYYLSSTGSTHDEIDFEFLGNATGQPYTIHTNLYAQGKGNREQQFRPWFNPTNGFHNYTIHWNPSEVVWFVDGTPIRVFRNYESEGIAYPNKQGMKVFASLWNAEDWATQGGRVKTNWTLAPFVAEGRRYKARACLWKGSVSIKQCVDPTIRSNWWTSPSFSQLTASQLTKMQKIRDGFMIYDYCKDTNRFKGVMPPECSKKQF

SEQ ID NO: 14533 - protein, 638 aa, Arabidopsis thaliana
  misc_feature: Useful for making plants with modulated nitrogen use efficiency
MESTIVMMMMITRSFFCFLGFLCLLCSSVHGLLSPKGVNFEVQALMDIKASLHDPHGVLDNWDRDAVDPCSWTMVTCSSENFVIGLGTPSQNLSGTLSPSITNLTNLRIVLLQNNNITGKIPAEIGRLTRLETLDLSDNFFHGEIPFSVGYLQSLQYLRLNNNSLSGVFPLSLSNMTQLAFLDLSYNNLSGPVPRFAAKTFSIVGNPLICPTGTEPDCNGTTLIPMSMNLNQTGVPLYAGGSRNHKMAIAVGSSVGTVSLIFIAVGLFLWWRQRHNQNTFFDVKDGNHHEEVSLGNLRRFGFRELQIATNNFSSKNLLGKGGYGNVYKGILGDSTVIAVKRLKDGGALGGEIQFQTEVEMISLAVHRNLLRLYGFCITQTEKLLVYPYMSNGSVASRMKAKPVLDWSIRKRIAIGAARGLVYLHEQCDPKIIHRDVKAANILLDDYCEAVVGDFGLAKLLDHQDSHVTTAVRGTVGHIAPEYLSTGQSSEKTDVFGFGILLLELVTGQRAFEFGKAANQKGVMLDWVKKIHQEKKLELLVDKELLKKKSYDEIELDEMVRVALLCTQYLPGHRPKMSEVVRMLEGDGLAEKWEASQRSDSVSKCSNRINELMSSSDRYSDLTDDSSLLVQAMELSGPR

SEQ ID NO: 14534 - protein, 573 aa, Panicum virgatum
  misc_feature: Useful for making plants with altered carbohydrate content
MKSGERPKLVRGLRQESRRFRLLVIVVGFFLVSLTFVVISKPDAILFSLNGKLPVEQAPTSILIKQKVDSPPATSRKTATDALPGGDPRVVDDEADVRPKGTKREEEESRVLSEPDPTSGMTELTANKDGGGRKSDEETLGGEGKGKQDGEERGHAAEKHKVTLPTVSNYTIHDSEDTENGKQDDGTGSDLQGSKPLCDFSNFRANVCEMRGDVRVHPNATSIMFMEPAGSQRDELWKIKPYPRKGDEFCLSHITELTVKSSKVAPECTKYHDVPAVIFSLTGYTGNLFHDFTDVMVPLFTTASEFNGEVQFLITDMALWWTIKYHTVLQKLSKYPLIDFSKDEQVHCFKHVIVGLHAYMEFTIDSSKAPHNYSMVDFNRFMRGAYSLPRDTVTVLGEYPKVKPRLLIIKRHRTRMFLNLDEIIAMAEELGFEVVTDEANVSSDISKFARLVNTVDVMMGVHGAGLTNCVFLPQNATLIQIVPWGGLEWVSRTDFGNPAELMGMHYKQYSISVDESSLTEQYPRDHEIFKNPIAFHKHGFDFIRQTFMDKQNVKLDCKRFRPILLEALDNLNP

SEQ ID NO: 14535 - protein, 533 aa, Panicum virgatum
  misc_feature: Useful for making plants with altered carbohydrate content
MAVSAARVAVATAASLAAHWLIRSFLQPHYPALGLLLPAAVFLAIAVLGGGSDAGGSAPPGPAAVPVFGNWLQVGNDLNHRFLARLSVRYGPVFRLRLGVRNLVVVSDPRLAAEVLHTQGVEFGSRPRNVVFDIFTANGADMVFTEYGDHWRRMRRVMTLPFFTARVVQQYRGMWEAEMDAVVADISGDGSAAQRGGFVVRRRLQLMLYNIMYRMMFDARFDSVDDPMFVEATRFNSERSRLAQSFEYNYGDFIPILRPFLRGYLDRCRDLQARRLAFFNNNYVEKRRKIMDTPGEKDKLRCAIDHILQAEKNGEITPENVIYIVENINVAAIETTLWSIEWALAEVVNHPAVQRKVRDEIRDVIGDDEPITESSIHKLPYLQAVIKEALRLHSPIPLLVPHMNLEEAKLGGYTIPKGSKVVVNARWLANNPELWEKPEEFRPERFLGEEKAVDATVGGKVDFRFLPFGVGRRSCPGIILALPILALIVGKLVRSFEMVPPPGVEKLDVSEKGGQFSLHIAKHSVIAFHPISA

SEQ ID NO: 14536 - protein, 194 aa, Panicum virgatum
  misc_feature: Useful for making plants with altered carbohydrate content
MARMALAAALVAVAVAGVLAGGARAQLVEGFYASCCPQAEKIIKNYVAEHVPRVPTIAATLLRTHFHDCFVRGCDASLLLNATGGKEAEKDAAPNKTLRGFAFIDRIKAIIEKECPGVVSCADILALAARDSVVVTGGPSWSVPTGRRDGTVSLKQEALDNIPGPTMNFTQLLQSFQNKSLSLADLVWLSAGVW

SEQ ID NO: 14537 - protein, 568 aa, Panicum virgatum
  misc_feature: Useful for making plants with altered carbohydrate content
MGTDSPSPSTAPVAGLGAKGAARAVAQHHQAVVGFLLGFFLVLLLYTTVSSQFGSQNAIGVLQSTSTSPAVRTGQNAMTPTSPSPKPNDVKKGDHIKEDNKEQQSNTPNKMEEDRTQHGINGIEKENQTEAKLDDEKVKNPEGGQAAVNDARSDRMEEEDLIRQEIDQGSMIKNDTNIGQVTPRKPICDLSDPRYDICEISGDARALGANRTVLYLPPAGERGADSQEWSIRDQSRKYLEFVGNVTVRSLNASQAAAAPACTSRHAVPAVVFAMNGLTSNPWHDFSDVLIPLFLTTRALDGEVQFLVSDLQPWFVDKYRLILRNLSRHDVVDFNRDGGVRCYPRVTVGLRSHRDLGIDPARAPRNYTLLDFQLYVREIYGLPPPGIDVPYKEQQQRTMPRLMLINRGRTRKFVNFPEIVAAARDAGFEVVPVEPRRDLGVEELARAVDSCDVLMGAHGAGLTNFFFLRSNAVMLQVVPWGHMEHSCMVFYGGPAREMRLRDVEYSIAAVESTLYDKYGEDSPVISDPESIHRQGWQFGMRYYWIEQDIRLNVTRFAPTLHQVLQMLKE

SEQ ID NO: 14538 - protein, 532 aa, Panicum virgatum
  misc_feature: Useful for making plants with altered carbohydrate content
MAAAAGSPWRSAGPVAALALLLLLAAAPAAAAGGSAAVNGDRLRAEQIRKQASDAAASAAALAAASRRLHLDRARHLRLLSSLHRNLTNTLRALSLAADSDPSASDPAAAAAADANASSPRQLDLQAKDLIRAARAAIAESKPLFDPQLKIQRLKDAIFAQNELLARAKKRGAFASLIAAKSIPKPLHCLAVRLTAERIARPEQYADPVPPQRALEDPALFHYAIFSDNVLAASCVVRSAVANSNDPSKHVFHVVTDRMNLGAMQVIIRRMDLKGAHYEVKAFEDYKFLNSSYVPVLRQLESANLQKFYFENKLENATKDASNMKFRNPKYLSMLNHLRFYLPEMYPKLHRILFLDDDVVVQRDLTGLWKIDMDGKVNGAVETCFGSFHRYWQYMNFSHPLIKAKFSPNACGWAYGMNFFDLDSWRREKCTEQYHYWQNQNANRTLWKLGTLPPGLITFYSTTKPLDKSWHVLGLGYNPSISMEEIRNAAVVHFNGNMKPWLDIGMNQFRHLWTKYVDYDDEYIRQCNFAPP

SEQ ID NO: 14539 - protein, 670 aa, Arabidopsis thaliana
  misc_feature: Useful for making plants with modulated herbicide sensitivity
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGADILVEALERQGVETVFAYPGGASMEIHQALTRSSSIRNVLPRHEQGGVFAAEGYARSSGKPGICIATSGPGATNLVSGLADALLDSVPLVAITGQVPRRMIGTDAFQETPIVEVTRSITKHNYLVMDVEDIPRIIEEAFFLATSGRPGPVLVDVPKDIQQQLAIPNWEQAMRLPGYMSRMPKPPEDSHLEQIVRLISESKKPVLYVGGGCLNSSDELGRFVELTGIPVASTLMGLGSYPCDDELSLHMLGMHGTVYANYAVEHSDLLLAFGVRFDDRVTGKLEAFASRAKIVHIDIDSAEIGKNKTPHVSVCGDVKLALQGMNKVLENRAEELKLDFGVWRNELNVQKQKFPLSFKTFGEAIPPQYAIKVLDELTDGKAIISTGVGQHQMWAAQFYNYKKPRQWLSSGGLGAMGFGLPAAIGASVANPDAIVVDIDGDGSFIMNVQELATIRVENLPVKVLLLNNQHLGMVMQWEDRFYKANRAHTFLGDPAQEDEIFPNMLLFAAACGIPAARVTKKADLREAIQTMLDTPGPYLLDVICPHQEHVLPMIPSGGTFNDVITEGDGRIKY

SEQ ID NO: 14540 - protein, 457 aa, Arabidopsis thaliana
  misc_feature: Useful for making plants with altered cell wall content and/or composition
MGKEDGFRTQKRVSTASSAAAGVLPTTMASGGVRRPPPRGRQIQKTFNNVKMTILCGFVTILVLRGTIGINFGTSDADVVNQNIIEETNRLLAEIRSDSDPTDSNEPPDSDLDLNMTYTLGPKITNWDQKRKLWLTQNPDFPSFINGKAKVLLLTGSPPKPCDNPIGDHYLLKSVKNKIDYCRIHGIEIVYNMAHLDKELAGYWAKLPMIRRLMLSHPEIEWIWWMDSDALFTDMVFEIPLSRYENHNLVIHGYPDLLFDQKSWIALNTGSFLFRNCQWSLDLLDAWAPMGPKGPIREEAGKILTANLKGRPAFEADDQSALIYLLLSQKETWMEKVFVENQYYLHGFWEGLVDKYEEMMEKYHPGLGDERWPFITHFVGCKPCGSYADYAVERCLKSMERAFNFADNQVLKLYGFGHRGLLSPKIKRIRNETTFPLKFVDRFDIRRTTPLKIEARS

SEQ ID NO: 14541 - protein, 450 aa, Panicum virgatum
  misc_feature: Useful for making plants with altered carbohydrate content
MWAARLVGERRMRQIQRFARNAKLTVVCLFLTVLVLRGTVGAGRFGTPQQDLIELRQHFVSHPHRALAEHHDARSRGSATTTTTTTSSSSSGRGDDEPDPPPRTLRDPPYTLGPKITDWDEQRAAWHRRHPETPPFLNDVKPRVLLVTGSSPKPCENPVGDHYLLKSIKNKIDYCRVHGIEIFYNMALLDAEMAGFWAKLPLIRALLLAHPEVEFLWWMDSDAMFTDMAFELPWERYGPYNLVMHGWDEMVYDDKNWIGLNTGSFLLRNCQWSLEMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKQMDRAFNFGDNQILQMYGFTHKSLASRRVKRIRNETSNPLKMKGELGLLHPAFKAVKTST

SEQ ID NO: 14542 - protein, 150 aa, Arabidopsis thaliana
  misc_feature: Useful for making plants with modulated biomass
MSKRKTKEPKVENVTLGPAVREGEQVFGVVHVFASFNDTFIHVTDLSGRETLVRITGGMKVKADRDESSPYAAMLAAQDVAQRCKELGITAIHVKLRATGGNKTKTPGPGAQSALRALARSGMKIGRIEDVTPIPTDSTRRKGGRRGRRL

SEQ ID NO: 14543 - protein, 85 aa, Arabidopsis thaliana
  misc_feature: Useful for making plants with modulated nitrogen use efficiency
MSSRGKRKDEDVRASDDESETHAPAKKVAKPADDSDQSDDIVVCNISKNRRVSVRNWNGKIWIDIREFYVKDGKTLPGKKGNFIL

SEQ ID NO: 14544 - protein, 365 aa, Arabidopsis thaliana
  misc_feature: Useful for making plants with altered alkaloid content
  misc_feature: Useful for making plants with altered terpenoid content
  misc_feature: Useful for making plants with modulated nitrogen use efficiency
MKRPRPTSQPSISSTVKPPLSPPVTPILKQKLHRTGTPKWFPLKLTHTELTLPLTFPTGQTFRWKKTGAIQYSGTIGPHLVSLRQRPGDDAVSYCVHCSTSPKSAELALLDFLNAEISLAELWSDFSKKDPRFGELARHLRGARVLRQDPLECLIQFLCSSNNNIARITKMVDFVSSLGLHLGDIDGFEFHQFPSLDRLSRVSEEEFRKAGFGYRAKYITGTVNALQAKPGGGNEWLLSLRKVELQEAVAALCTLPGVGPKVAACIALFSLDQHSAIPVDTHVWQIATNYLLPDLAGAKLTPKLHGRVAEAFVSKYGEYAGWAQTLLFIAELPAQKTLLQSFSQPINKLDESAEVNETSCDTLKP

SEQ ID NO: 14545 - protein, 147 aa, Panicum virgatum
  misc_feature: Useful for biocontainment applications
MRGIGGPLLTIGDLLSDLAVDGGDDPLAAGGDASVPSSPSAAQQAGEADPSDLSRLFEEHYNNLMKALQDNDPSWPSLMLKLCAALKAADKLVSSANTDAEQLMEKVKVLEGVLERGDRAVEQIVESLQRSGLAKDHRSSQSKSASK

SEQ ID NO: 14546 - protein, 489 aa, Panicum virgatum
  misc_feature: Useful for making plants with altered carbohydrate content
MGSIAADAGKPHAVLVPFAAQGHVTPMLKLGKILHFWGFHVTFVNTDYNHRRLHRSRGAGALGGLPGFRFATIPDGLPQSEADVTQDLPSLCRSTAETCLPHFRSLLAELNASPDAPPVTCVVGDNVMSFTLDAAREIGVPCALLWTSSTCGYVGYRYSRTLIDEGVFPLKEEQLTNGFLDTPVDNAPGLSKYTRFKDLPSFIRSTDPDEFMLHFALKVTEQIAGADAVILNTLYELEQEAVDGMRAMIPPAASIHAVGPLALLAEQIVPHGGQLDALGSNLWKEDVSCLAWLEGRSAGSVVFVNYGSTTVMTNAELLKFAWGLANSGHDFVWVIRPDLVSGDAAVLPPEFLEAIEGRGLLAGWCPQDAVLRHEAVGVFLTHCGWNSTLESLCAGVPMLCWPFFAEQQTNCRYTCAEWGVGMEIGQDVRREAVEGKIREAMDGEKGKEMRRRAAEWREAAVRATRPGGGSYASLEKLVNDVLLSGGKGS

SEQ ID NO: 14547 - protein, 277 aa, Arabidopsis thaliana
  misc_feature: Useful for making plants with modulated biomass
MGSQQAAVSFLSNLAKAAFGLGTAATVLNTSLFTVDGGERAVIFDRFRGVMDQTVGEGTHFLIPILQRPHIFDIRTKPHTFSSISGTKDLQMVNLTLRVLSRPEVSRLPYIFQTLGLEYDEKVLPSIGNEVLKAVVAQFNADQLLTERPHVSALVRESLITRAKDFNIVLDDVAITHLSYGVEFSRAVEQKQVAQQEAERSKFVVMKADQERRAAVIRAEGESEAAQLISDATAKAGMGLIELRRIEASREIASTLARSPNVAYLPGGQSMLFALNR

SEQ ID NO: 14548 - protein, 485 aa, Zea mays
  misc_feature: Useful for making plants with modulated oxidative stress sensitivity
MMMMMMAGEHVLAALGTLLLASLLTLVLNHFLPLLLNPKAPRGSFGWPLLGETLRFLTPHASNTLGGFLEDHCSRYGRVFKSHLFCTPTVVSCDQDLNHFILQNEERLFQCSYPRPIHGILGKSSMLVVLGEDHKRLRNLALALVTSTKLKPSYLGDIEKIALHVVGAWRRHGSSGGVRVVAFCEEARKFAFSVIVKQVLGLSPEEPVTARILEDFLAFMKGLISFPLYIPGTPYAKAVRARERISSTVKGIIKERRSAGSWNKQGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFTAVHLNPSLHGDAQQFQPCRWEGTSQGTSKRFTPFGGGPRLCPGSELAKVETAFFLHHLVLNYRWRIDGDDIPMAYPYVEFQRGLPIEIEPTSPES

SEQ ID NO: 14549 - protein, 366 aa, Arabidopsis thaliana
  misc_feature: Useful for making plants with modulated nitrogen use efficiency
MALSAIGFEGYEKRLEVTFFEPSIFQDSKGLGLRALTKSQLDEILTPAACTIVSSLSNDQLDSYVLSESSFFVYPYKVIIKTCGTTKLLLSIPPLLKLAGELSLSVKSVKYTRGSFLCPGGQPFPHRSFSEEVSVLDGHFTQLGLNSVAYLMGNDDETKKWHVYAASAQDSSNCNNNVYTLEMCMTGLDREKAAVFYKDEADKTGSMTDNSGIRKILPKSEICDFEFEPCGYSMNSIEGDAISTIHVTPEDGFSYASFEAVGYDFNTLDLSQLVTRVLSCFEPKQFSVAVHSSVGANSYKPEITVDLEDYGCRERTFESLGEESGTVMYQTFEKLGKYCGSPRSTLKCEWSSNNSCSSEDEKDEGI

SEQ ID NO: 14550 - protein, 125 aa, Arabidopsis thaliana
  misc_feature: Useful for biocontainment applications
MGSMFSGNRMSKEEMEVVVNKAKEIVSAYPVVVFSKTYCGYCQRVKQLLTQLGATFKVLELDEMSDRGEIQSALSEWTGQTTVPNVFIKGKHIGGCDRVMETNKQGKLVPLLTEAGAIANNSSQL

SEQ ID NO: 14551 - protein, 514 aa, Arabidopsis thaliana
  misc_feature: Useful for making plants with modulated carbon-nitrogen partitioning
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASRSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTAALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGGKLLAAQIVQIIVIVGWVTVTMGPLFYGLHKMNLLRISAEDEMAGMDMTRHGGFAYAYNDEDDVSTKPWGHFAGRVEPTSRSSTPTPTLTV

SEQ ID NO: 14552 - protein, 514 aa, Arabidopsis thaliana
  misc_feature: Useful for making plants with altered carbon content
  misc_feature: Useful for making plants with altered nitrogen content
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASRSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTAALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGEKLLAAQIVQIIVIIGWVTVTMGPLFYGLHKMNLLRISAEDEMAGMDMTRHGGFAYAYNDEDDVSTKPWGHFAGRVEPTSRSSTPTPTLTV

SEQ ID NO: 14553 - protein, 266 aa, Panicum virgatum
  misc_feature: Useful for making plants with altered carbohydrate content
MAGCSSSSAVLLASLVCAAGLFGAGEASGAAHRVVDPEWHPATATWYGSAEGDGSDGGACGYGTLVNVVPMKARVGAVSPVLFKSGEGCGACYKVRCLDRGICSRRAVTVIVTDECPGGVCAGGRTHFDLSGAAFGRLAVAGAGGQLRNRGEINIVFRRTACRYGGKNIAFHVNEGSTSFWLSLLVEFEDGDGDIGSMQLKQANSAQWQDMQHIWGATWSLTPGPLVGPFSVRLTTLTGKQTLTAQDVIPRNWAPKATYTSRLNFA

SEQ ID NO: 14554 - protein, 264 aa, Arabidopsis thaliana
  misc_feature: Useful for making plants with altered cell wall content and/or composition
MQLFPVMLATLCIVLQLLIGSSALATTNRHVSNSHWLPAVATWYGSPNGDGSDGGACGYGTLVDVKPLHARVGAVNPILFKNGEGCGACYKVRCLDKSICSRRAVTVIITDECPGCSKTSTHFDLSGAVFGRLAIAGESGPLRNRGLIPVIYRRTACKYRGKNIAFHVNEGSTDFWLSLLVEFEDGEGDIGSMHIRQAGAREWLEMKHVWGANWCIIGGPLKGPFSIKLTTLSAGKTLSATDVVPRNWAPKATYSSRLNFSPVL

SEQ ID NO: 14555 - protein, 186 aa, Arabidopsis thaliana
  misc_feature: Useful for making plants with modulated heat sensitivity
MAAFTCTSRPPISLRSETRIVSSSPSASSLSSRRMFAVLPESSGLRIRLSLSPASLTSIHQPRVSRLRRAVVCEAQETTTDIQVVNDSTWDSLVLKATGPVVVDFWAPWCGPCKMIDPLVNDLAQHYTGKIKFYKLNTDESPNTPGQYGVRSIPTIMIFVGGEKKDTIIGAVPKTTLTSSLDKFLP

SEQ ID NO: 14556 - protein, 485 aa, Panicum virgatum
  misc_feature: Useful for making plants with altered carbohydrate content
MSPKEAAQRPHAVLIPQPAQGHVTPMLHLAKALHARGFHITYVNSEYNHRRLLRSRGPASLAGAAGFRFEAVPDGLPPSDNDDVTQDIAALCLSTTEHSAAPFRDLLARLNATPGGPLVSCVVADGVMSFAQRVAEEMGILALVFWTTSACGFMGYLHFAELIKRGYVPLKDESDLTNGYLDTVIDWIPGMPGIRLKDNPSFIRTTDRDDVMLNFDGGEAQNARRARGVILNTYDALEQGVVDALRREFPRVYTVGPLAAFANAARGGELDAIGGNLWKEDTSCLRWLDTQPSGSVVYVNFGSITVMSPAQLSEFAWGLAGSGRPFLWVIRPDLVSGENAMLPEEFVTDTKERGVLASWCPQELVLSHPSVGLFLTHCGWNSTLESICAGVPMLCWPFFAEQPTNCQYVCAKWEIGMEIDSDVRREEVARLVREVMDGETGKAMRVKAMLWKEKAREAVEDGGSSRKNMERLVEFLLAANEDVST

SEQ ID NO: 14557 - protein, 334 aa, Arabidopsis thaliana
  misc_feature: Useful for making plants with altered cell wall content and/or composition
MSNMQFSRGFNPFVILFCLAVVAPIISADVAILRTDYYQKTCPDFHKIVREAVTTKQVQQPTTAAGTLRLFFHDCFLEGCDASVLIATNSFNKAERDDDLNDSLPGDAFDIVTRIKTALELSCPGVVSCADILAQATRDLVTMVGGPYFDVKLGRKDGFESKAHKVRGNVPMANQTVPDIHGIFKKNGFSLREMVALSGAHTIGFSHCKEFSDRLYGSRADKEINPRFAAALKDLCKNHTVDDTIAAFNDVMTPGKFDNMYFKNLKRGLGLLASDHILIKDNSTKPFVDLYATNETAFFEDFARAMEKLGTVGVKGDKDGEVRRRCDHFNNLNV

SEQ ID NO: 14558 - protein, 449 aa, Arabidopsis thaliana
  misc_feature: Useful for making plants with altered cell wall content and/or composition
MVSPETSSSHYQSSPMAKYAGTRTRPVVCISDVVLFLGGAFMSLILVWSFFSFSSISPNLTVKNEESSNKCSSGIDMSQDPTDPVYYDDPDLTYTIEKPVKNWDEKRRRWLNLHPSFIPGAENRTVMVTGSQSAPCKNPIGDHLLLRFFKNKVDYCRIHGHDIFYSNALLHPKMNSYWAKLPAVKAAMIAHPEAEWIWWVDSDALFTDMDFTPPWRRYKEHNLVVHGWPGVIYNDRSWTALNAGVFLIRNCQWSMELIDTWTGMGPVSPEYAKWGQIQRSIFKDKLFPESDDQTALLYLLYKHREVYYPKIYLEGDFYFEGYWLEIVPGLSNVTERYLEMEREDATLRRRHAEKVSERYAAFREERFLKGERGGKGSKRRPFVTHFTGCQPCSGDHNKMYDGDTCWNGMIKAINFADNQVMRKYGFVHSDLGKTSPLQPVPFDYPDEPW

SEQ ID NO: 14559 - protein, 589 aa, Arabidopsis thaliana
  misc_feature: Useful for making plants with altered carbon content
  misc_feature: Useful for making plants with altered nitrogen content
MDQKVRQFEVCTQDGSVDRHGNPAIRANTGKWLTAILILVNQGLATLAFFGVGVNLVLFLTRVMGQDNAEAANNVSKWTGTVYIFSLLGAFLSDSYWGRYKTCAIFQASFVAGLMMLSLSTGALLLEPSGCGVEDSPCKPHSTFKTVLFYLSVYLIALGYGGYQPNIATFGADQFDAEDSVEGHSKIAFFSYFYLALNLGSLFSNTVLGYFEDQGEWPLGFWASAGSAFAGLVLFLIGTPKYRHFTPRESPWSRFCQVLVAATRKAKIDVHHEELNLYDSETQYTGDKKILHTKGFRFLDRAAIVTPDDEAEKVESGSKYDPWRLCSVTQVEEVKCVLRLLPIWLCTILYSVVFTQMASLFVVQGAAMKTNIKNFRIPASSMSSFDILSVAFFIFAYRRFLDPLFARLNKTERNKGLTELQRMGIGLVIAIMAMISAGIVEIHRLKNKEPESATSISSSSTLSIFWQVPQYMLIGASEVFMYVGQLEFFNSQAPTGLKSFASALCMASISLGNYVSSLLVSIVMKISTTDDVHGWIPENLNKGHLERFYFLLAGLTAADFVVYLICAKWYKYIKSEASFSESVTEEEEV

SEQ ID NO: 14560 - protein, 297 aa, Arabidopsis thaliana
  misc_feature: Useful for making plants with modulated flowering time
MVPYQELTLQRSFSYNSRKINPVTSPARSSHVRSPSSSALIPSIPEHELFLVPCRRCSYVPLSSSSSASHNIGKFHLKFSLLLRSFINIINIPACKMLSLPSPPSSSSSVSNQLISLVTGGSSSLGRRVTGTLYGHKRGHVTFSVQYNQSSDPVLLLDLAMSTATLVKEMSSGLVRIALECEKRHRSGTKLFQEPKWTMYCNGRKCGYAVSRGGACTDTDWRVLNTVSRVTVGAGVIPTPKTIDDVSGVGSGTELGELLYMRGKFERVVGSRDSEAFYMMNPDKNGGPELSIFLLRI

SEQ ID NO: 14561 - protein, 375 aa, Arabidopsis thaliana
  misc_feature: Useful for making plants with modulated nitrogen use efficiency
MAAAMASHVSTARSPALSFSSSSSSFFPGTTLRRFSAVSLPSPALPRLRVSCQASSVTSPSSPSDVKGKSDLKDFLAIDDFDTATIKTILDKASEVKALLKSGERNYLPFKGKSMSMIFAKPSMRTRVSFETGFFLLGGHALYLGPNDIQMGKREETRDVARVLSRYNDIIMARVFAHQDILDLANYSSVPVVNGLTDHNHPCQIMADALTMIEHIGQVEGTKVVYVGDGNNMVHSWLELASVIPFHFVCACPKGYEPDKERVSKAKQAGLSKIEITNDPKEAVIGADVVYSDVWASMGQKDEAEARRKAFQGFQVDEALMKLAGQKAYFMHCLPAERGVEVTNGVVEAPYSIVFPQAENRMHAQNAIMLHLLGF

SEQ ID NO: 14562 - protein, 415 aa, Zea mays
  misc_feature: Useful for making plants with altered lignin content
MMAICSAHTTTISLRSPCTTTVSNAAAGLVQKQVIFLTSINRRSGSRRRGGGVSRTLLQVSCSADGNKPVVIGLAADSGCGKSTFMRRLTSVFGGAAEPPRGGNPDSNTLISDTTTVICLDDYHSLDRTGRKEKGVTALDPRANNFDLMYEQVKAIKQGQAVQKPIYNHVTGLLDPPELITPPKIFVIEGLHPMFDERVRDLLDFSIYLDISDEVKFAWKIQRDMAERGHSLESIKASIEARKPDFDAYIDPQKQYADAVIEVLPTQLIPNDDEGKVLRVKLIMKEGVDNFNPVYLFDEGSTISWVPCGRKLTCSYPGIKFAYGPDIYFGNEVSVLEMDGQFDRLDELIYVESHLSNLSTKFYGEVTQQMLKHADFPGSNNGTGLFQTIVGLKIRDLYEQIVAERAGAPAEAAKV

SEQ ID NO: 14563 - protein, 2044 aa, Arabidopsis thaliana
  misc_feature: Useful for making plants with modulated flowering time
MASKGGKSKPDIVMASKSGKSKPDNESRAKRQKTLEAPKEPRRPKTHWDHVLEEMAWLSKDFESERKWKLAQAKKVALRASKGMLDQASREERKLKEEEQRLRKVALNISKDMKKFWMKVEKLVLYKHQLVRNEKKKKAMDKQLEFLLGQTERYSTMLAENLVEPYKQGQNTPSKPLLTIESKSDEERAEQIPPEINSCLESGSPELDEDYDLKSEDETDEKHFTKRERQEELEALQNEVDLPVEELLRRYTSGRVSRETSPVKDENEDNLTSVSRVTSPVKDENQDNLASVGQDHGEDKNNLAASEETEGNPSVRRSNDSYGHLAISETHSHDLEPGMTTASVKSRKEDHTYDFNDEQEDVDFVLANGEEKDDEATLAVEEELAKADNEDHVEEIALLQKESEMPIEVLLARYKEDFGGKDISEDESESSFAVSEDSIVDSDENRQQADLDDDNVDLTECKLDPEPCSENVEGTFHEVAEDNDKDSSDKIADAAAAARSAQPTGFTYSTTKVRTKLPFLLKHSLREYQHIGLDWLVTMYEKKLNGILADEMGLGKTIMTIALLAHLACDKGIWGPHLIVVPTSVMLNWETEFLKWCPAFKILTYFGSAKERKLKRQGWMKLNSFHVCITTYRLVIQDSKMFKRKKWKYLILDEAHLIKNWKSQRWQTLLNFNSKRRILLTGTPLQNDLMELWSLMHFLMPHVFQSHQEFKDWFCNPIAGMVEGQEKINKEVIDRLHNVLRPFLLRRLKRDVEKQLPSKHEHVIFCRLSKRQRNLYEDFIASTETQATLTSGSFFGMISIIMQLRKVCNHPDLFEGRPIVSSFDMAGIDVQLSSTICSLLLESPFSKVDLEALGFLFTHLDFSMTSWEGDEIKAISTPSELIKQRVNLKDDLEAIPLSPKNRKNLQGTNIFEEIRKAVFEERIQESKDRAAAIAWWNSLRCQRKPTYSTSLRTLLTIKGPLDDLKANCSSYMYSSILADIVLSPIERFQKMIELVEAFTFAIPAARVPSPTCWCSKSDSPVFLSPSYKEKVTDLLSPLLSPIRPAIVRRQVYFPDRRLIQFDCGKLQELAMLLRKLKFGGHRALIFTQMTKMLDVLEAFINLYGYTYMRLDGSTPPEERQTLMQRFNTNPKIFLFILSTRSGGVGINLVGADTVIFYDSDWNPAMDQQAQDRCHRIGQTREVHIYRLISESTIEENILKKANQKRVLDNLVIQNGEYNTEFFKKLDPMELFSGHKALTTKDEKETSKHCGADIPLSNADVEAALKQAEDEADYMALKRVEQEEAVDNQEFTEEPVERPEDDELVNEDDIKADEPADQGLVAAGPAKEEMSLLHSDIRDERAVITTSSQEDDTDVLDDVKQMAAAAADAGQAISSFENQLRPIDRYAIRFLELWDPIIVEAAMENEAGFEEKEWELDHIEKYKEEMEAEIDDGEEPLVYEKWDADFATEAYRQQVEVLAQHQLMEDLENEAREREAAEVAEMVLTQNESAHVLKPKKKKKAKKAKYKSLKKGSLAAESKHVKSVVKIEDSTDDDNEEFGYVSSSDSDMVTPLSRMHMKGKKRDLIVDTDEEKTSKKKAKKHKKSLPNSDIKYKQTSALLDELEPSKPSDSMVVDNELKLTNRGKTVGKKFITSMPIKRVLMIKPEKLKKGNLWSRDCVPSPDSWLPQEDAILCAMVHEYGPNWNFVSGTLYGMTAGGAYRGRYRHPAYCCERYRELIQRHILSASDSAVNEKNLNTGSGKALLKVTEENIRTLLNVAAEQPDTEMLLQKHFSCLLSSIWRTSTRTGNDQMLSLNSPIFNRQFMGSVNHTQDLARKPWQGMKVTSLSRKLLESALQDSGPSQPDNTISRSRLQETQPINKLGLELTLEFPRGNDDSLNQFPPMISLSIDGSDSLNYVNEPPGEDVLKGSRVAAENRYRNAANACIEDSFGWASNTFPANDLKSRTGTKAQSLGKHKLSASDSAKSTKSKHRKLLAEQLEGAWVRPNDPNLKFDFTPGDREEEEEQEVDEKANSAEIEMISCSQWYDPFFTSGLDDCSLASDISEIE

SEQ ID NO: 14564 - protein, 399 aa, Panicum virgatum
  misc_feature: Useful for making plants with altered carbohydrate content
MITQINGAAAAVVAAFLVFSTHLYFPTTAHLYCPATPLPQGLSDLTEPSFPFCPLTGSSVCNDHQYGCKYNPLCDDFPPDFPPPDTPMVTVFCVDPNGCCDFTTVQAAVNAVPNHSRKRNVVWINKGIYFEKVTVPASKPNITFQGQGFDITAIAWNDTAKSANGTFYSASVSIFASGFIAKNISFINVAPIPRPGAVDAQAVAIRINGDQAAFWGCGFFGAQDTLCDDRGRHYFKECFIQGSIDFIFGDARSLYENCRLISIADPVPSGQRSITGSVTAHGRVSEDDNTGYSFVKCSIGGTGWIWLGRAWRPYSRVVFAYTSMSDIIASEGWNDWNDPSRDQTVFYGEYKCTGDGANLADRVPYAQKLSDVQVLPYLSTSFIDGDQWLKPYRDSLISA

SEQ ID NO: 14565 - protein, 393 aa, Arabidopsis thaliana
  misc_feature: Useful for making plants with altered cell wall content and/or composition
MKIISLSISIGIAIIAVLASKTLFKTHPEAFGIKAISYSFKKSLCDHHHHHHHHHHHHHRHKPSDTKRKVSICDDFPKNIPPLDTDTTSYLCVDKNGCCNFTTVQSAVDAVGNFSQRRNVIWINSGMYYEKVVIPKTKPNITLQGQGFDITAIAWNDTAYSANGTFYCATVQVFGSQFVAKNISFMNVAPIPKPGDVGAQAVAIRIAGDESAFVGCGFFGAQDTLHDDRGRHYFKDCYIQGSIDFIFGNAKSLYQDCRIISMANQLSPGSKAVNGAVTANGRSSKDENSGFSFVNCTIGGTGHVWLGRAWRPYSRVVFVSTTMTDVIAPEGWNNFNDPSRDATIFYGEYNCSGPGADMSKRAPYVQKLNETQVALLINTSFIDGDQWLQFSDL

SEQ ID NO: 14566 - protein, 162 aa, Arabidopsis thaliana
  misc_feature: Useful for making plants with modulated biomass
MLLGKRQRPPINRTTSLSEIKFDLNLPSESEPSNQQKPTVASPYGSNGQAVTAAVDQNRGFLDQRLLSMVTPRGNLRRHSGDFSDARHFLRSCALCERLLVPGRDIYMYRGDKAFCSSECRQEQMAQDERKEKGKSAAPAKEPAVTAPARAKPGKGRAAAAV

SEQ ID NO: 14567 - protein, 87 aa, Arabidopsis thaliana
  misc_feature: Useful for making plants with altered alkaloid content
  misc_feature: Useful for making plants with altered terpenoid content
MDSYSSPPMGGSGSSVSPEVMMESVKTQLAQAYAEELIETLRTKCFDKCVTKPGSSLGGSESSCISRCVERYMEATAIISRSLFTQR

SEQ ID NO: 14568 - protein, 335 aa, Glycine max
  misc_feature: Useful for making plants with altered lignin content
  misc_feature: Useful for making plants with altered terpenoid content
MENSTQESHLRSENSVSYESPYPIYGMSFSPSHPHRLALGSFIEEYTNRVDILSFHPDTLSLTPNPSLSFDHPYPPTKLMFHPRKPPSSSSDLLATSGDYLRLWEVRDNSVEAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWDLPTLASPTGIDPVCMYSAGCEINQLQWSAVQPEWIAIAFANKMQLLKV

SEQ ID NO: 14569 - protein, 302 aa, Arabidopsis thaliana
  misc_feature: Useful for biocontainment applications
MVSVNPRPKGFPVFDSSNMSLPSSDGFGSIPATGRTSTVSFSEDPTTKIRKPYTIKKSRENWTDQEHDKFLEALHLFDRDWKKIEAFVGSKTVVQIRSHAQKYFLKVQKSGANEHLPPPRPKRKASHPYPIKAPKNVAYTSLPSSSTLPLLEPGYLYSSDSKSLMGNQAVCASTSSSWNHESTNLPKPVIEEEPGVSATAPLPNNRCRQEDTERVRAVTKPNNEESCEKPHRVMPNFAEVYSFIGSVFDPNTSGHLQRLKQMDPINMETVLLLMQNLSVNLTSPEFAEQRRLISSYSAKALK

SEQ ID NO: 14570 - protein, 305 aa, Panicum virgatum
  misc_feature: Useful for making plants with altered carbohydrate content
MGVATNGSAAGQAPAPALKFLIYGRTGWIGGLLGGLCAARGIPFAYGAGRLENRAQLEADIDAAAPTHVFNAAGVTGRPNVDWCEAHRAETVRANVVGTLTLADVCRGRGLVLINYATGCIFEYDDAHPLGSGVGFKEEDTPNFVGSFYSKTKAMVEELLKNYENVCTLRVRMPISSDLSNPRNFITKITRYEKVVNIPNSMTILDELLPISIEMAKRNLTGIWNFTNPGVVSHNEILEMYRDYIDPSFSWKNFNLEEQAKVIVAPRSNNELDQTKLKNEFPELLSIKESLIKYVFEPNRKTSKA

SEQ ID NO: 14571 - protein, 115 aa, Arabidopsis thaliana
  misc_feature: Useful for making plants with modulated biomass
  misc_feature: Useful for making plants with modulated flowering time
MFFAHVSGCNTCFPPTPIPNLNPISNPTTPSCSRDAIKLGVCAKILDVAVGTVIGNPSDTLCCSVLQGLVDLDAAVCLCTTIKANILGINIDLPISLSLLINTCGKKLPSDCICA

SEQ ID NO: 14572 - protein, 381 aa, Arabidopsis thaliana
  misc_feature: Useful for making plants with altered cell wall content and/or composition
MASELTNRRHEIEQPEAESYYPKPIKPWFVAIRPIRYMLREQRLVFVLVGIAIATLGFTIFSKSSNHQPIPYDVDPLSGYGMRSESSYLPATIHKKPSIEYMSRIGSAGGKIPLGLKRKVLRVVVTGGAGFVGSHLVDRLMARGDNVIVVDNFFTGRKENVMHHFNNPNFEMIRHDVVEPILLEVDQIYHLACPASPVHYKFNPVKTIITNVVGTLNMLGLAKRVGARFLLTSTSEVYGDPLQHPQVETYWGNVNPIGVRSCYDEGKRTAETLTMDYHRGANVEVRIARIFNTYGPRMCIDDGRVVSNFVAQALRKEPLTVYGDGKQTRSFQFVSDLVEGLMRLMEGEHVGPFNLGNPGEFTMLELAKVVQETIDPNAKIE

SEQ ID NO: 14573 - protein, 460 aa, Arabidopsis thaliana
  misc_feature: Useful for making plants with altered cell wall content and/or composition
MAVFVLSLLILSSFSAIPFTYADSGMIGVNYGRIADNLPAPEKVVELLKTQGINRIKLYDTETTVLTALANSGIKVVVSLPNENLASAAADQSYTDTWVQDNIKKYIPATDIEAIAVGNEVFVDPRNTTTYLVPAMKNVQSSLVKFNLDKSIKISSPIALSALASSYPPSAGSFKPELIEPVIKPMLDLLRKTSSHLMVNAYPFFAYAANADKISLDYALFKENAGNVDSGNGLKYNSLLDAQIDAVFAAMSAVGFNDVKLVVTETGWPSAGDENEIGAGSANAAAYNGGLVKRVLTGNGTPLKPKEPLNVYLFALFNENQKTGPTSERNYGLFYPNENKVYDVSLNGKSTPVNDNKEKVVPVKPSLVGQTWCVANGKTTKEKLQEGLDYACGEGGADCRPIQPGATCYNPESLEAHASYAFNSYYQKNARGVGTCNFGGAAYVVSQPPKYGKCEFPTGH

SEQ ID NO: 14574 - protein, 486 aa, Arabidopsis thaliana
  misc_feature: Useful for making plants with altered cell wall content and/or composition
MANYKGRGNVMIRSMLLGLYGIINIVCVNGTFINYKDALTKSLIFLEAQRSGKLPPNNRVPWRGDSALDDGKLVNVDLSGGYYDAGDNVKYGLPMAFTITTLAWSTITYEKELRATGELENARAAIRWGTDYFLKCASRKNRLYVQVGDPNADHQCWARPENMKTPRTVLEISDKVPGTEIAAEAAAAFAASSIVFRHVDHKYARRLLNKAKLLFKLAKSHKGTYDGECPFYCSNSGYNDELIWAATWLYKATRNHLYLSYLKFEAISAYVAEFSWDLKYAGAQILITKLIFEGHKGLDLYKQQADSFVCSNLPGSPYHQVFTTPGGMIHLRDGANSQYVTATAFLFSAYADILQKHNQKISCGSHQFDSTHLMAFAKKQIDYILGHNPQGRSYMVGFGPNPPKQAHHRGASVPMHEANAPLSCPLSFVKWYNKNVPNANELTGAILGGPDRQDKFQDLRWTSVYTEPCTYINSIAVGVLAKLAAA

SEQ ID NO: 14575 - protein, 294 aa, Arabidopsis thaliana
  misc_feature: Useful for making plants with altered alkaloid content
MTIDSQQKTSKFRWGEMDEDDDFDFLLPPKQVIGPDENGLKTTIEYKFNDEGNKVKITTRTRVRKLASARLNKRAMERRNWPKFGDAANEEAGSHLTMVSTEEILLERPRAPGTKADESKATGDGLSQLGKGGAVLMVCRICHKKGDHWTSKCPYKDLAAPTDVFIDKPPTGESSTMSAAPGTGKAAYVPPSMRAGADRSAVGSDMRRRNDENSVRVTNLSEDTREPDLMELFHPFGAVTRVYVAIDQKTGVSRGFGFVNFVSREDAQRAINKLNGYGYDNLILRVEWATPRPT

SEQ ID NO: 14576 - protein, 439 aa, Panicum virgatum
  misc_feature: Useful for making plants with altered carbohydrate content
MRVLEDDLFPSTPGKVKIERAGTMNQQLHRCFASTSTMFLWALFLVAMTASYLSFQSFVNTSSKYFAASWGGLHWERQIRASAAPRRPPGSADGAGMSVLVTGAAGFVGTHCSLALRKRGDGVVGVDNFNAYYDPSLKKARKALLSSHGVFVVEGDINDGRLLAKLFDVVPFTHVLHLAAQAGVRYAMENPASYVHSNIAGLVTLLEACKDADPQPAIVWASSSSVYGLNDKVPFSERDRTDQPASLYAATKKAGEEITHTYNHIYGLSITGLRFFTVYGPWGRPDMAYFSFTRNILQGKPITVYRGKDHVDLARDFTYIDDIVKGCLGSLDTAGKSTGTGGKKRGPAPYRIFNLGNTSPVTVPNLVSILEKHLRVKAKKNVVEMPGNGDVPFTHANISLAREQLGYKPTTNLDVGLKKFVKWYLSYYGYSRGSKNFRQ

SEQ ID NO: 14577 - protein, 429 aa, Arabidopsis thaliana
  misc_feature: Useful for making plants with altered cell wall content and/or composition
MPSIEDELFPSTPGKFKIDRSNRQLHRCFASTSTMFLWALFLIALTASYLSFQSFVDSGSRYLTASWGGIQWEKQVRTSAQIHRSGGISVLVTGATGFVGSHVSLALRKRGDGVVGLDNFNNYYDPSLKRARRSLLSSRGIFVVEGDLNDAKLLAKLFDVVAFTHVMHLAAQAGVRYALENPQSYVHSNIAGLVNLLEICKAANPQPAIVWASSSSVYGLNEKVPFSESDRTDQPASLYAATKKAGEEITHTYNHIYGLAITGLRFFTVYGPWGRPDMAYFSFTRNILQGKPITIYRGKNRVDLARDFTYIDDIVKGCLGSLDSSGKSTGSGGKKRGAAPYRIFNLGNTSPVTVPILVDILEKHLKVKAKRNFVEMPGNGDVPFTHANISSARNEFGYKPTTDLETGLKKFVRWYLSYYGYNTKAKLVH

SEQ ID NO: 14578 - protein, 426 aa, Panicum virgatum
  misc_feature: Useful for making plants with altered carbohydrate content
MAVEILESCMVTPGEAATPKHGVWLSNLDLLVARSHTPTVYVYRPSPGPAFFSPDVLKAALSKALVPFYPLAGRLARDGAGRPEIHCTGDGALFVTARADATLQDLGGFVPSDELRRMLVPSVDGGDDRAGILAMFQVTFFKCGGVCVGAAIHHTAADGLAALDFVNTWAAIARGVGEAAPRPWLDRTLLRARSPPAVRFEHAEYSRRGGGGSKAGKVQFDSAILPVSKAQIDALKAGKKQSTFKAVVAYVWRCACKARGLAATEDTRLYMTADARSRVRPPLPAGYLGNAIFRASTVAKVGDVVSEPLDAAADRISGATARLDDEYIRSLVDYLDQVVSDAAGLRKGEWVMPETDLWVISWQGLPIYDADFGWGRPAFMSRACLQFSGLVYLVPGPDGDGRLDVVVAMEPKSLSRFKELLYEELK

SEQ ID NO: 14579 - protein, 181 aa, Arabidopsis thaliana
  misc_feature: Useful for biocontainment applications
  misc_feature: Useful for making plants with modulated biomass
  misc_feature: Useful for making plants with modulated flowering time
MARPQQRFRGVRQRHWGSWVSEIRHPLLKTRIWLGTFETAEDAARAYDEAARLMCGPRARTNFPYNPNAIPTSSSKLLSATLTAKLHKCYMASLQMTKQTQTQTQTQTARSQSADSDGVTANESHLNRGVTETTEIKWEDGNANMQQNFRPLEEDHIEQMIEELLHYGSIELCSVLPTQTL

SEQ ID NO: 14580 - protein, 140 aa, Arabidopsis thaliana [sequence omitted]

SEQ ID NO: 14581 - protein, 235 aa, Arabidopsis thaliana
  misc_feature: Useful for making plants with modulated nitrogen use efficiency
MPKSKRDRPVTLSKTKKKGREHKECIVNGIREAVEKYSSVYVFSFENMRNIKFKEFRQQFRHNGKFFLGSNKVMQVALGRSAEDELRSGIYKVSKLLRGDTGLLVTDMPKEEVESLFNAYEDSDFSRTGSIAVETVELKEGPLEQFTHEMEPLLRKLEMPVRLNKGTVELVADFVVCEEGKQLSPKSAHILRLLRMKMATFKLNLLCRWSPSDFELYREDLSELYREDLSDVETS

SEQ ID NO: 14582 - protein, 565 aa, Arabidopsis thaliana
  misc_feature: Useful for making plants with altered cell wall content and/or composition
MTTVHTFSILLFFCSLFSASLIIAKVQHHDFVIQETPVKRLCKTRNAITVNGMFPGPTLEVNNGDTLEVKVHNRARYNITIHWHGVRQIRTGWADGPEFVTQCPIRPGKSYTYRFTIQGQEGTLWWHAHSSWLRATVYGALIIHPTPGSSFPFPKPDRQTALMLGEWWNANPVDVINQATRTGAAPNISDAYTINGQPGDLYNCSTKETVVVPINSGETSLLRVINAALNQPLFFTVANHKLTVVGADASYLKPFTTKVLMLGPGQTTDVLLTADQPPKRYYIAARAYQSAQNAPFDNTTTTAILQYKKTTTTSKPIMPVLPAFNDTNTVTSFSRKFKSLRNVVVPKTIDDNLFFTIGLGLDNCPKKFPKSRCQGLNGTRFTASMNNVSFVLPSNFSLLQAHSNGIPGVFTTDFPSKPPVKFDYTGNNISRALFQPVKGTKLYKLKYGSRVQVVLQDTNIVTSENHPIHLHGYDFYIVGEGFGNFNPKKDTSKFNLVDPPLRNTVAVPVNGWAVIRFVADNPGVWLMHCHLDVHIKWGLAMAFLVDNGVGELETLEAPPHDLPIC

SEQ ID NO: 14583 - protein, 268 aa, Arabidopsis thaliana
  misc_feature: Useful for making plants with modulated biomass
  misc_feature: Useful for making plants with modulated flowering time
MSREREGFGEYYETVKKIKKDPAFETTTDHAVMGIRRHVAVPPGTTLNTVTPCAACKLLRRRCAEECPFSPYFSPHEPHKFAAVHKVFGASNVSKMLLEVGESQRGDAANSLVYEANLRLRDPIYGCMGAISALQHHIQSLQSELTTVRTEILRHKYQEATTITSLQNNFNSTTTTSSVSCDQHALASAILLPPPPPPPPTPRPPRLLSSQPAPPPTPPVSLPSPSMVVSSSSSSNSSATNSMYNPPPSSTAGYSNSLSSDNNVHYFD

SEQ ID NO: 14584 - protein, 434 aa, Zea mays
  misc_feature: Useful for making plants with altered lignin content
MHGGGAASPDAAICISPEAGPIVGVAPAGIRVENCYVFKSRLQEYAQRVGIPTPEYHTLKEGPSHEPVFKSTVFVNNTKYESLPGFFSRKAAEQSAAEVALMEIAMSAPVTEIRNMPAVQETGLCKNLLQEYAQKMNYAIPSYICTKQASGVAPFVCSVEIGGILYIGAAARTKKEAEIKAARTALLAIQSQSEGGANGAKKYIVVPGQRPDKEANKNPTETPIPLRVKKRGSRKKWNKRKFRRMADRIVDAGKDAEGLGTLVHDDYEEARRIGYELPTDTAMVQFNKEVVMTQPGEGDRIVQLEPPRDPAEFQYNKEARSVEQDPPRDPAEVQHNKEARSVEQDPPRDPAEVQHNKEARTVEQDPPSNTEVWKPDNKATTTEQESVSAYIALRSNGDSTDVEAAPGDTLMMQGEESEATMQEASHAGEQAQPN

SEQ ID NO: 14585 - protein, 405 aa, Arabidopsis thaliana
  misc_feature: Useful for making plants with modulated biomass
  misc_feature (67)..(67): Xaa is any aa, unknown, or other
  misc_feature (68)..(68): Xaa is any aa, unknown, or other
  misc_feature (233)..(233): Xaa is any aa, unknown, or other
  misc_feature (269)..(269): Xaa is any aa, unknown, or other
MGGLAMEEMPLSVLFEQARKIHLAASESGVDQDVVKKGCEMFQKCEDMIGKLALFSSNETKEDISTXXLKYLLVPYYLAELTEKIIQEDRIQIVKASYAKLKEFFSFCEAMELVPDEELEASSRGGSGAPADRRALKIARFKRQKAAEAKLLEIKERKERRGRSTKASALSTPVESGEDDIPDDDSEEEREAWLSSINLAICKAIDLLEMLKREEEMLSAIKERQLKDGEGGXSRDALDDRTKKAETWHRDAAARIQYSKPAQPITCAXFAQDVLEGRASVSQGHEHKNQPLIFGPASIVGGPLSTERERMIAQVFQPSHRMPTMCIEDAGLTEMNIMNDWQEQTKKAIEEATTSWYNDKPLRRKEEDEEDDDEDDEPVMKARAFDDWKDDNPRGAGNKKLTPCG

SEQ ID NO: 14586 - protein, 708 aa, Panicum virgatum
  misc_feature: Useful for making plants with altered carbohydrate content
MLISLASSLRSSLLPIQFQPHPLPELHRLISWWLQTMCIQGHAVALVVPAGLLLTLTLLVAGIPWEACNSTITGNYTANSTYGGNLRLVAAALPGNVSTSPTLFAKAVIGTAPDIVYALGQCSGDQSAAACHDCINASFAAAQKLCPFNKGAAVFYDTCFVGFSGRDFLASTTNSDDQEVQLYNGQNITSDGADRFNATAYELLNAMAEHMATTNSEKFLTGTIGFDDTTYPNIYGMASCTSDLTPGQCRGCLDAAIAEMPRVFIPNTKGARIAGLRCIVRYEVYRFYNGSTMLQLPGTHAGRIGSKKSNDTGKILAIVLPIVVAIAASLAMCVFCRRRTKSKSKRSLSFTSHMEDIECIESLVIDLPTLRLATNNFAEDKKLGEGGFGAVYKGSLPNGQEIAVKRLSQNSRQGIGELRNELVLIAKLQHKNLVRLVGVCLEEEEKLLVYEYMPNTSLDTFLFDSEKRKELDWGKRFTIINGITRGLQYLHEDSQLKIVHRDLKASNILLDTAMNPKISDFGLARLFGEDQSQDTTRRVVGTYGYMAPEYALRGQYSIKSDIYSFGVLILEIITGRRNSDSYNSDQSVDLPSLVWEHWTTRSITDMVDPYFRSDSSWDEILRCIHIGLSCVQEDPVDRPTISAISIMLDSGTVPSQPPSRPAFYVEMSGNVDSGMYSSQSYPGFVNKSTAKSTVVSPNELSVTDPEPR

SEQ ID NO: 14587 - protein, 518 aa, Arabidopsis thaliana
  misc_feature: Useful for making plants with altered cell wall content and/or composition
MASSSSISNHKIPNTLMFLVIVNFLYLIQTNSAVSISSNSNSHFSRFSRHRSSPSSKTKQGFLATVQESMNHALLARSLAFNLTLSHRTVQTHTFDPIHDCLELLDDTLDMLSRIHADNDEEDVHTWLSAALTNQDTCEQSLQEKSESYKHGLAMDFVARNLTGLLTSSLDLFVSVKSKHRKLLSKQEYFPTFVPSSEQRRLLEAPVEELNVDAVVAPDGSGTHKTIGEALLSTSLASSGGRTKIYLKAGTYHENINIPTKQKNVMLVGDGKGKTVIVGSRSNRGGWTTYKTATVAAMGEGFIARDMTFVNNAGPKSEQAVALRVGADKSVVHRCSVEGYQDSLYTHSKRQFYRETDITGTVDFIFGNSAVVFQSCNIAARKPLPGQRNFVTAQGRSNPGQNTGIAIQNCRITAESMTYLGRPWKEYSRTVVMQSFIGGSIHPSGWSPWSGGFGLKSLFYGEYGNSGPGSSVSGRVKWSGCHPSLTVTEAEKFTVASFIDGNIWLPSTGVSFDPGLVN

SEQ ID NO: 14588 - protein, 671 aa, Panicum virgatum
  misc_feature: Useful for making plants with altered carbohydrate content
MGSMEGLSRTVIHFLLLFCIVCKCLASDLEATQKATLKIDASPKLARKIPDTLLGVFFKEMGRGGAGGLWAELVSNRGFEAGGPNTPSNIDPWLIIGNESSIFVETDRTSCFSRNIVALRMEVICNNCPAGGVGIYNPGFWGMNIEDGKTYNLVMYVKSAETAPLTVSLTSSDGSQNLASVAIMVAGKSKWIKVEQKMVAKGTNRTSRLQITSKKKGVVWFDQVSLMPADTYKGHGFRDELVSMLLDLKPQFLRFPGGCFVQGGWLRNAFRWRESIGPWEERPGHFGDCWNYWTDDGLGYFEFLQLSEDLGAAPIWVFNSGLSYNDEVDTAAIAPFVKDVLDSLEFARGSANSSWGSVRAAMGHPEPFPVKYAAIGNEDCGKKFYNGNYLKFYNAIREAYPDIQLISNCDGSSGPLDHPADLYDFHVYADAKTLFSMKNTFDKTSRSGPKAFVSEYAVWKTDAGRGTLLASLAEAAFLTGLEKNSDVVEMACHAPLFVNDDIEKKWNPDVIVFNTWQHYGTPSYWMQVLFRESSGAIVHPTTISSSSSGNSSLAASAITWQDSDNSSFLRVKIINFESVAVQITISTTGLQASIDVLRSTATVLTSSNVMDENSFSNQDKVSPVKSQLFDAGAHMQVTLAPHSFTSFDLALAPSKLVTLAGRVNKYLISEL

SEQ ID NO: 14589 - protein, 371 aa, Arabidopsis thaliana
  misc_feature: Useful for making plants with altered cell wall content and/or composition
MSVSIPVLMKRLCLYNSLSLFLFHLFPSPSLALSFSVELNLLKAQMVWANAKMRLALSLVTVFFGISLANLEVGFYSNTCPQAESIVKRVVSGAALSDPNLPAILLRLHFHDCFVEGCDGSILVNNGAISEKNAFGHEGVRGFEIVEAVKAELEAACPGVVSCSDIVALAARDAISLANGPAYEVPTGRRDGRVSNMSLAKDMPEVSDSIEILKAKFMQKGLNAKDLVLLSAAHTIGTTACFFMSKRLYDFLPGGQPDPTINPTFLPELTTQCPQNGDINVRLPIDRFSERLFDKQILQNIKDGFAVLQTDAGLYEDVTTRQVVDSYLGMLNPFFGPTFESDFVKAIVKMGKIGVKTGFKGEIRRVCSAFN

SEQ ID NO: 14590 - protein, 174 aa, Arabidopsis thaliana
  misc_feature: Useful for making plants with modulated nitrogen use efficiency
MVPNTTTVKFLCSYGGRITPRYPDGKLRYQGGDTRVLSVTRAISFTELKKKLGEICGIAVTSLRCQLPTDDLDALVTVRSDEDLKNLMEEYDLAITAQVKIHVFLSPLKSTRTTANSSPPPSTTSSSSSKSRSRSPPSPSTPETCPSCVERSIRNNGCYVHRSPSHNQLYFINN

SEQ ID NO: 14591 - protein, 259 aa, Brassica napus
  misc_feature: Useful for making plants with altered alkaloid content
  misc_feature (154)..(154): Xaa is any aa, unknown, or other
  misc_feature (210)..(210): Xaa is any aa, unknown, or other
MAMGMAELGFPYWNPLRRRFPPDSPFFASGNVERELLAKQVALDFTEDEINNLQIIVETESRRISCPIVGCPERLKSLDNFEDHYKARHTASCSVCSRVYPTSRLLSIHISEAHDSFFQAKVARGYDMYECLVEGCGLKFKNYKARHRHLVDKXKFPTTFEFFKRTQLSKKRREKLQKQRVPKLKHEEDKEEASSDAMEVEDKASLDGLXSALSTLTTSDTTPSNVSFGRRHGRGLTFVPRSVHREKPTNSSSTPGPKT

SEQ ID NO: 14592 - protein, 631 aa, Arabidopsis thaliana
  misc_feature: Useful for making plants with altered cell wall content and/or composition
MENRFLQLTLSNPEGFVTGIQYNGIDNVLAYYTNKEYDRGYWDVVWNFPGKKAKKTKGTLDRIEATKMEVITQNDEKIELSFTRTWNTSSTTAVPVNIDKRFVMLQNSSGFYSYAIFERLQGWPAVELDNMRLVFKLNKKKFHYMAISDDRQRYMPVPDDRVPPRGQPLAYPEAVQLLDPIEPEFKGEVDDKYEYSMESKDIKVHGWISTNDSVGFWQITPSNEFRSAGPLKQFLGSHVGPTNLAVFHSTHYVGADLIMSFKNGEAWKKVFGPVFIYLNSFPKGVDPLLLWHEAKNQTKIEEEKWPYNFTASDDFPASDQRGSVSGRLLVRDRFISSEDIPANGSYVGLAAPGDVGSWQRECKGYQFWSKADENGSFSINNVRSGRYNLYAFAPGFIGDYHNDTVFDISPGSKISLGDLVYEPPRDGSTLWEIGVPDRSAAEFYIPDPNPSFVNKLYLNHSDKYRQYGLWERYSELYPDEDMVYNVDIDDYSKNWFFMQVTRKQANGGYKGTTWQIRFQFDDKMKNVTGNFKLRIALATSNVAELQVRVNDLSADPPLFRTEQIGRDNTIARHGIHGLYWLYSVNVPAASLHVGNNTIYLTQALATSPFQGLMYDYIRLEYPDSINYITRS

SEQ ID NO: 14593 - protein, 656 aa, Panicum virgatum
  misc_feature: Useful for making plants with altered carbohydrate content
MGKLRSLCCMGPPRAASPAGAAVDATAGVRVTVSDRYVEIKNGIFELTLSNPDGIVTGVRYNGVDNLMEILNKEDNRGYWDLVWNPPGQKTGIFDVIKGTEFRIIYHDENQAEVSFTRNWDPSLEGKAVPLNIDKRFIVLRGSSGFYTYGIYEHKEGWPDFGLGETRVAFKLRKDKFHYMALADDRQRIMPMPDDRLPPRGQPLAYPEAVLLVDPINPDLRGEVDDKYQYSCEDQYNNVHGWMSFDPPIGFWQITPSDEFRTGGPLKQNLTSHVGPTTLAMFLSAHYAGDDLSPMFTNGEYWKKVHGPVFMYLNSSWDGSDPTMLWEDAKVQMMIEKESWPYCFALSEDFQKTEQRGYISGRLLVRDRYIDDGDLYASGAYVGLALPGEAGSWQRECKGYQFWCRADVDGSFYIRNIITGNYNLYAWVPGFIGDYKLDATLTIVSGDDIYLGDLVYQPPRDGPTMWEIGVPDRSAAEFYVPDPNPKYVNRLYINHPDRQYGLWERYAELYPDSDLVYTIGQSDYSTDWFYAQVNRKVDENTYQPTTWQIKFNLDSVSPGSTYKFRVALASSARAELQVFFNDKDRGVPHFATGLIGRDNAIARHGIHGLYWLFNINVNSDWLVQGMNTIYLKQPRNQSPFQGLMYDYLRLEEPCGC

SEQ ID NO: 14594 - protein, 405 aa, Arabidopsis thaliana
  misc_feature: Useful for making plants with altered cell wall content and/or composition
MGSSQSSQLLDEEEEEEDEAESEGEEVEEEEDEAESELNNRRIELDNLLVKKVLEQEPEMLPCHASASPLSPQLSSLGTPRIGPSIKVWDPYNVLAPPPPSSPPLFSRISSAAEHDRSAVTEVYFISHGECDLNLRPDLIGGRCHVATLTPNGKRQARALAVFLNSEGVRFTSVFSSPLDRARSMAVSVCQEMNFPEEHLQVSDAVVEMSLGDWESCHRSEIYTPETLSLIERCQPDFSAPSGESLRQVEFRMVQFLNGTVSGLSEKLRSELLPSTQHTNSRGFSLATSIHRPILTRKKSGKSRFQVMNATGDHEGSEEIFSNHNDEQHLGDINIKSSSSQLSTCIGVFTHSLPIKCLLTGILGCSPVMTHKICVEDSSVTVLQHSWKTGWQVKRLNDTAHLRLL

SEQ ID NO: 14595 - protein, 802 aa, Arabidopsis thaliana
  misc_feature: Useful for making plants with modulated biotic stress sensitivity
MSLQYHVLNSIPSTTFLSSTKTTISSSFLTISGSPLNVARDKSRSGSIHCSKLRTQEYINSQEVQHDLPLIHEWQQLQGEDAPQISVGSNSNAFKEAVKSVKTILRNLTDGEITISAYDTAWVALIDAGDKTPAFPSAVKWIAENQLSDGSWGDAYLFSYHDRLINTLACVVALRSWNLFPHQCNKGITFFRENIGKLEDENDEHMPIGFEVAFPSLLEIARGINIDVPYDSPVLKDIYAKKELKLTRIPKEIMHKIPTTLLHSLEGMRDLDWEKLLKLQSQDGSFLFSPSSTAFAFMQTRDSNCLEYLRNAVKRFNGGVPNVFPVDLFEHIWIVDRLQRLGISRYFEEEIKECLDYVHRYWTDNGICWARCSHVQDIDDTAMAFRLLRQHGYQVSADVFKNFEKEGEFFCFVGQSNQAVTGMFNLYRASQLAFPREEILKNAKEFSYNYLLEKREREELIDKWIIMKDLPGEIGFALEIPWYASLPRVETRFYIDQYGGENDVWIGKTLYRMPYVNNNGYLELAKQDYNNCQAQHQLEWDIFQKWYEENRLSEWGVRRSELLECYYLAAATIFESERSHERMVWAKSSVLVKAISSSFGESSDSRRSFSDQFHEYIANARRSDHHFNDRNMRLDRPGSVQASRLAGVLIGTLNQMSFDLFMSHGRDVNNLLYLSWGDWMEKWKLYGDEGEGELMVKMIILMKNNDLTNFFTHTHFVRLAEIINRICLPRQYLKARRNDEKEKTIKSMEKEMGKMVELALSESDTFRDVSITFLDVAKAFYYFALCGDHLQTHISKVLFQKV

SEQ ID NO: 14596 - protein, 830 aa, Arabidopsis thaliana
  misc_feature: Useful for making plants with altered cell wall content and/or composition
MSSWASFIFLFIFSFLTSFRVFAQDPTYRYHSCPNTTIFSRDSAYFSNLQTLLSFLSSPDASSSYSSGFRNDAVGTFPDRVTGLFDCRGDLPPEVCHNCVAFAVKDTLIRCPNERDVTLFYDECTLRYSNLVVTSALDPTYVYHVCPSWATFPRSSTYMTNLITLLSTLSSPSASYSTGFQNATAGKHPDRVTGLFNCRGDVSPEVCRRCVSFAVNETSTRCPIEKEVTLYYDQCTLRYSNRNILSTSNTNGGIILANSQNMTSNEQARFKDLVLTTMNQATIAAANSSKRFDARSANFTTLHSLYTLVQCTHDLTRQDCLSCLQQIINQLPTEKIGGQFIVPSCSSRFELCLFYNQSAVTTPQPQQNSAPPPPPTSIPSPRPGLNSRFPLITCLSAVSFEKFKDLLKPGFICILIKIVSENTGKGGNSSVIIIAVVVSITALLLLFVAVFSVRTKRRKKMIGAIPLLNVKRKDTEVTEPLAENGDSITTAGSLQFDFKAIVAATNNFLPINKLGQGGFGEVYKGTFPSGVQVAVKRLSKTSGQGEREFENEVVVVAKLQHRNLVRLLGYCLEGEEKILVYEFVHNKSLDYFLFDTTMKRQLDWTRRYKIIGGIARGILYLHQDSRLTIIHRDLKAGNILLDADMNPKVADFGMARIFGMDQTEANTRRVVGTYGYMAPEYAMYGQFSMKSDVYSFGVLVFEIISGMKNSSLYQMDDSVSNLVTYTWRLWSNGSQLDLVDPSFGDNYQTHDITRCIHIALLCVQEDVDDRPNMSAIVQMLTTSSIVLAVPKQPGFFFRGRHEQVGEVGSSVDRLALCSIDDASITSVAPR

SEQ ID NO: 14597 - protein, 321 aa, Arabidopsis thaliana
  misc_feature: Useful for making plants with modulated flowering time
MKLAGLKSIENAHEDSVWAATWVPATEDRPALLLTGSLDETVKLWRPDELDLVRTNTGHSLGVAALAAHPSGIIAASSSIDSFVRVFDVDTNATIAVLEAPPSEVWGMQFEPKGTILAVAGGSSASVKLWDTASWRLISTLSIPRPDAPKPSDKTSSKKFVLSVAWSPNGKRLACGSMDGTICVFDVDRSKLLHQLEGHNMPVRSLVFSPVDPRVLFSGSDDGHVNMHDAEGKTLLGSMSGHTSWVLSVDASPDGGAIATGSSDRTVRLWDLKMRAAIQTMSNHNDQVWSVAFRPPGGTGVRAGRLASVSDDKSVSLYDYS

SEQ ID NO: 14598 - protein, 231 aa, Zea mays
  misc_feature: Useful for making plants with altered lignin content
  misc_feature: Useful for making plants with altered terpenoid content
MESKQWGKTPQEVVGAGGGRQVDLDEEDDLEEFRLPMGHRPTENLDTEGLQQASVYTQLTASNVGFRLLQKMGWKTGKGLGKNEQGILEPIRADMRDAKLGVGKQEEDDFFTSEENVQRKKLNIELEETEEHIKKREVIAEREHKIRSEVKEIQKVFFCNLCNKQYKLAHEFESHLSSYDHNHRKRFKEMREMQSSSGSRDDRQKREQQREEKELAKIAQLADAHRKQQKG

SEQ ID NO: 14599 - protein, 171 aa, Zea mays
  misc_feature: Useful for making plants with modulated flowering time
MAFYYAIALLGMLAVFSSGGNALDDNMLKTTVYIQQLPYQNQRGVAEGTAVISWYIKDGPGASANTIGHAEGLVILTDIARSSWLITTDLVFDGGSLAGSSLQVMGQHESSGQWSIMGGTGQFTMARGVIEYKTIQEDSSSRTFEVCIYAYYTPMNGWKAGLALGDTGSKP

SEQ ID NO: 14600 - protein, 534 aa, Oryza sativa subsp. japonica
  misc_feature: Useful for making plants with modulated phosphate use efficiency
MGGGGGEQQQLEVLHALDVAKTQWYHFTAIVVAGMGFFTDAYDLFCISLVTKLLGRIYYRVDGSPSPGTLPPHVSASVNGVAFVGTLSGQLFFGWLGDKLGRKRVYGITLMLMVLCSLASALSFGHTPTSVMATLCFFRFWLGFGIGGDYPLSATIMSEYANKKTRGAFIAAVFAMQGFGIITGGLVAILVSASFRAAFPAPPYGEDPVASTPPQADFVWRIILMLGALPAALTYYWRTKMPETARYTALVANNAKQAAADMSKVLQVVEMRNIGNNGGSRRPFGLFSGEFVRRHGLHLVGTSATWLLLDIAFYSQNLFQKDIFSAVGWIPKAATMSALEELFRIARAQTLIALCGTVPGYWFTVALIDVVGRFKIQAVGFFMMTLFMLTLALPYHHWTAPGKNHVGFLLLYGLTFFFANFGPNSTTFIVPAEIFPARLRATCHGISAASGKLGAIVGSFGFLYLAQSPDRSKTEHGYPPGIGVRNSLFLLAACNLLGLLFTFLVPESKGKSLEEMSGDAEAQEEAPPPLQTVL

SEQ ID NO: 14601 - protein, 143 aa, Arabidopsis thaliana
  misc_feature: Useful for making plants with altered oil content
  misc_feature: Useful for making plants with modulated cold sensitivity
MATVPGQLIWEIVKRNNCFLVKQFGRGNAKVQFSKESNNLVNINSYKHSGLANKKTVTIQAAGKDQGVVLGTTKTKRQNKPKLSVNKSILKKEFSRMSKVVANQVVDNYYRPDLKKAALARLSAISKGLRVAKSGPKRRNRQA

SEQ ID NO: 14602 - protein, 276 aa, Zea mays
  misc_feature: Useful for making plants with altered alkaloid content
MSPRVVLLFLAALRPCAALVRLHSTTFSFTFLDAPARFGPRVSGDGICGSLRAADPAEACETIKDRGGRRGAGRKAFVLIARGNCSFEEKVRAAQQAGFDASIVYDDEEKASLYSMVGESDGIHIPAIFVSKMAGETLKKFARGEDEECCINSSMDETAGTVLVMSFVSLVVIMSVLASFLFARNCRLLRHGVDNHPPYVKKQVVEKFPCSAYSAPCSSEDNFQEACAICLEDYNNGDMLRHLPCKHEFHKICIDSWLTKWGIFCPICKLEVTLGG

SEQ ID NO: 14603 - protein, 307 aa, Arabidopsis thaliana
  misc_feature: Useful for making plants with altered lignin content
  misc_feature: Useful for making plants with altered terpenoid content
MHRSGTTMAWNVFKFCTALRGLGSIMILLVLGVVGVTYYAVVLTNYGPPLSQGGLDSLAALTILILFHFLLAMLLWSYFSVVFTDPGVVPPNWRPSTDEERGESDPLNSLDFVGLQSDSSSSNPRVRFCRKCNQLKPSRCHHCSVCGRCVLKMDHHCVWVVNCVGALNYKYFLLFLFYTFLETTLVTLVLMPHFIAFFSDEEIPGTPGTLATTFLAFVLNLAFALSVMGFLIMHISLVAGNTTTIEAYEKKTTTKWRYDLGKKKNFEQVFGMDKRYWLIPGYTEEDLRRMPELQGLEYPSKPDFDSQ

SEQ ID NO: 14604 - protein, 337 aa, Arabidopsis thaliana
  misc_feature: Useful for making plants with altered alkaloid content
  misc_feature: Useful for making plants with modulated biomass
MATMARSFLQAISKDEAVAPPLRVVQIEGLAVLKIIKHCKEFSPTLVTGQLLGLDVGSVLEVTNCFPFPVRDDDEEIEADGANYQLEMMRCLREVNVDNNTVGWYQSTVLGSYQTVELIETFMNYQENIKRCVCIIYDPSKADLGVLALKALKLSDSFMELYRGGNFTGEKLREKNFSWMDIFEEIPIKVSNSALVSAFMTELETDTPVSQGDYDRLHSSTTPFLENNMEFLIKCMDDLSMEQQKFQYYYRNLSRQQAQQQAWLQKRRTENMARKSAGEEPLPEEDPSNPIFKAIPEPSRLESFLITNQVSNFCGQINGVAGQNFSRLYLTKALHDN

SEQ ID NO: 14605 - protein, 92 aa, Arabidopsis thaliana [sequence omitted]

SEQ ID NO: 14606 - protein, 394 aa, Panicum virgatum
  misc_feature: Useful for making plants with altered carbohydrate content
MAMAERFGARWLPFRFVLAVVLLVLTTDRASVLLRAEATPIGINYGQIADNLPSPARVSWLLRSMQVSKVKLYDADPYVLSAFLDTGVEFVVGIGNENVSAMVDPAAARAWIQRHVQPYLPATRITCITVGNEVFKGNDTELKANLLPAMQSVYQALAALGLQGTVNVTTAHSLDIMGSSFPPSAGAFRADVAPYLQPILSFLSMARSPFLINCYPYFAYKADPGNVPLEYVLFQPNAGVTDTNTRLNYDNMLYAQVDSVYAAIQALGHADIDVKVSETGWPSRGDPDEAGATPEYAGTYIGNLLRRIEMKQGTPLRPSVPIDVYVFALFNENLKPGPASERNYGLFYPDGTPVYNVGLRGYLPPMDYSQGTRKAVHLLALILIAVAAIALSLS

SEQ ID NO: 14607 - protein, 279 aa, Panicum virgatum
  misc_feature: Useful for making plants with altered carbohydrate content
MAARRAPLALLAASVALLAAAASADSWLYEKFNTDGTVRADYDASGQQVAMLNLDRSSGAGLNSKEQYLYGEFSIQMKLIPGNSAGTVSCFYLTSGDSDDHDEIDMEFMGNSSGQPVVLNTNVWASGDGKKEHQFDLWFDPAADYHTYTIVWNPTNILFKVNGNVIRCFKRYADLPYPSSRPMALHATLWDGSYWATEKGKVPIDWAGAPFVVSYRGYSADACVSGGACPAGSDRWMNKQPDAAEWGTVKWAESNYMRYNYCEDGWRFPQGLPAECSRS

SEQ ID NO: 14608 - protein, 121 aa, Arabidopsis thaliana
  misc_feature: Useful for making plants with altered cell wall content and/or composition
MAITYLLPLFLSLIITSSVSANFQRDVEITWGDGRGQIKNNGELLTLSLDKSSGSGFQSKNEYLFGKVSMQMKLVPGNSAGTVTTLYLKSPGTTWDEIDFEFLGNSSGEPYTLHTNVYTQG

SEQ ID NO: 14609 - protein, 279 aa, Panicum virgatum
  misc_feature: Useful for making plants with altered carbohydrate content
MAARLPPLALLAASLAVMAAVASTDSWLYEKFNTDGTVRADYDASGQQVAMLNLDRSSGAGFNSKEQYLYGEFSIQMKLIPGNSAGTVSCFYLSSGDSDDHDEIDMEFMGNSSGQPVVLNTNVWASGDGKKEHQFDLWFDPAADYHTYTIVWNPTNILFKVDGTVIRCFKRYDDLPYPSSRPMALHATLWDGSYWATEKGKVSIDWARAPFVVSYRGYSADACVSGGACPAGSDRWMNKQPDAAEWGTVKWAESNYMRYNYCEDGWRFPQGLPAECSRS

SEQ ID NO: 14610 - protein, 282 aa, Arabidopsis thaliana
  misc_feature: Useful for making plants with altered cell wall content and/or composition
MVSFCGRRFAFLIIFLFAAQYERVYAGSFHKDVQIHWGDGRGKILDNVGNLLSLSLDKFSGSGFQSHQEFLYGKVEVQMKLVPGNSAGTVTTFYLKSPGTTWDEIDFEFLGNISGHPYTLHTNVYTKGTGDKEQQFHLWFDPTVDFHTYCIIWNPQRVIFTIDGIPIREFKNSEALGVPFPKHQPMRLYASLWEAEHWATRGGLEKTDWSKAPFTAFYRNYNVDACVWSNGKSSCSANSSWFTQVLDFKGKNRVKWAQRKYMVYNYCTDKKRFPQGAPPECS

SEQ ID NO: 14611 - protein, 97 aa, Arabidopsis thaliana
  misc_feature: Useful for making plants with modulated nitrogen use efficiency
MALSTSIRSVSKIIASSEASVSRSVTRSFHSTGVKKMSGGGHGGYDEYYLHAKHMYNLDRMKYQALKMSLGVFTAFSIGVGVPIFAVVFQQRKTQSG

SEQ ID NO: 14612 - protein, 551 aa, Arabidopsis thaliana
  misc_feature: Useful for making plants with altered cell wall content and/or composition
MSSILILLFSLFLFSSPSSSSRHHHHHNSGDTSPVNPSSSLAAQIRLACNATRYPDQCVSSLSEQGRVPPDPKPIQIIHSAISFSFQNLKTAQSKIKSIVDSSVGNLNRTNAANTCLQLLTYSEHRTQSTDQALTRGKIKDARAWMSAALVYQYDSWSALKYVNDTSQVGETMSFLDGLIHVTSNALSMMVSYDNFGDNVASWTYPATERDGFWEKTGPGLGLDPSTGLNLGFPSGLKEDVTVCKDGKCGYKTVQDAVNAAPEDNGMRKFVIKISEGVYEENVIVPFEKKNVVFIGDGMGKTVITGSLNAGMPGITTYNTATVGVVGDGFMARDLTFQNTAGPDAHQAVAFRSDSDFSLIENCEFLGNQDTLYAHGLRQFYKNCRIQGNVDFIFGNSAAVFQDCEILIAPRQINPEKGEKNAVTAQGRIDPSQSTGFVFLNCLINGTEEYMKLFKANPKVHKNFLGRPWKDYSRTVFIGCNLEALITPDGWLPWSGDFALKTLYYGESKNTGPGSDRSQRVSWSSQIPDEHVHVYSVANFIQADEWASMSA

SEQ ID NO: 14613 - protein, 484 aa, Arabidopsis thaliana
  misc_feature: Useful for making plants with altered cell wall content and/or composition
MTSLFFFVLLFSSLLISNGDANPNYKEALSKSLLFFQGQRSGPLPRGQQISWRASSGLSDGSAAHVDLTGGYYDAGDNVKFNLPMAFTTTMLSWSALEYGKRMGPELENARVNIRWATDYLLKCARATPGKLYVGVGDPNVDHKCWERPEDMDTPRTVYSVSASNPGSDVAAETAAALAAASMVFRKVDSKYSRLLLATAKDVMQFAIQYQGAYSDSLSSSVCPFYCSYSGYKDELMWGASWLLRATNNPYYANFIKSLGGGDQPDIFSWDNKYAGAYVLLSRRALLNKDSNFEQYKQAAENFICKILPDSPSSSTQYTQGGLMYKLPQSNLQYVTSITFLLTTYAKYMKATKHTFNCGSSVIVPNALISLSKRQVDYILGDNPIKMSYMVGFSSNFPKRIHHRASSLPSHALRSQSLGCNGGFQSFYTQNPNPNILTGAIVGGPNQNDGYPDQRDDYSHAEPATYINAAFVGPLAYFAAGRST

SEQ ID NO: 14614 - protein, 579 aa, Arabidopsis thaliana
  misc_feature: Useful for making plants with altered cell wall content and/or composition
MESPIFILITLSFFLQSVLASSQTLSNSSTICKTTPDPKYCKSVFPHSQGNVQQYGCFSIRKSLSQSRKFIRTVDRYIKRNAHLSQPAVIRALQDCRFLAGLTMDYLLTSFETVNDTSAKTSFKPLSFPKADDIQTLLSAALTNEQTCLEGLTTAASYSATWTVRTGVALPLVNDTKLLGVSLALFTKGWVPKKKKRAGFAWAQPRSGSSTHTKPFRLFRNGALPLKMTEKTKAVYESLSRRKLADGDSNGDGDDGSMVLISDIVTVSQDGTGNFTNITAAVAAAPNNTDGSAGFFLIYVTAGIYEEYISIAKNKRYMMMIGDGINQTVVTGNRSVVDGWTTFNSATFAVTAPNFVAVNITFRNTAGPEKHQAVALRSGADFSIFYSCSFEAYQDTLYTHSLRQFYRECDVYGTVDFIFGNAAVVFQNCNLYPRKPMPNQFNAITAQGRSDPNQNTGTSIQNCTIKPADDLVSSNYTVKTYLGRPWKEYSRTVYMQSYIDGFVEPVGWREWNGDFALSTLYYAEYNNTGPGSNTTNRVTWPGYHVINSTDAANFTVTGLFIEADWIWKTGVPYTSGLIS

SEQ ID NO: 14615 - protein, 517 aa, Arabidopsis thaliana
  misc_feature: Useful for making plants with altered cell wall content and/or composition
MAIKSIFIIIIISIITSISELYALDPSFLRLSTSLQRSSFPQDFRFGAASSAYQSEGAANVDGREPSIWDTFTKQYPEKISDGSNGDVADEFYYRFKEDVAHMKEIGLDSFRFSISWSRILPRGTVAGGVNQAGINFYNHLINELISNGIRPLVTLFHWDTPQALEDEYGGFLNPQIVKDFVEYVDICFKEFGDRVKEWITINEPNMFAVLGYNVGNIAPGRCSSYVQNCTVGNSATEPYLVAHYLILSHAATVQLYREKYQSFHGGTIGMTIQTYWMIPKYNTPACREAAKRALDFFFGWFADPITYGDYPKTMRELVGNRLPKFTKKQSKMVRGSFDFFGLNYYTSRYVEDVMFYANTNLSYTTDSRVNQTTEKNGVPVGEPTSADWLFICPEGFQDVLLYIKSKFQNPVILVTENGMPSENDKSLSVNIALNDEAKIKYHQLHLTALLEAVSQGADVRGYYIWSLMDDFEWEFGYKYRYGLVYVDFQDGLKRHLKSSALWYHHFLSNSSSYQMD

SEQ ID NO: 14616 - protein, 483 aa, Glycine max
  misc_feature: Useful for making plants with modulated biomass
MDSNGYLVVGVVAFALLCSFRVSLTDSVPLFSPVHDAASLTRNSFPAGFIFGAGSSAYQFEGAAKEGGRGPSIWDTFTHNHPEKIRDGANGDVAVDQYHRYKEDVKIMKDMNLDSYRFSISWPRILPKGKLSGGVNQEGINYYNNLINELLANGVLPYVTLFHWDLPQALEDEYGGFLSSHIVQGGYATGATAPGRCTGPQCLGGDAGTEPYIVTHNQILAHAAAVHVYKTKYQAHQKGKIGITLVSNWFIPLAENSTSDIKAARRAIDFQYGWYMEPLTKGEYPKNMRALVGSRLPKFTKWQAKLVNGSFDFIGLNYYSSGYINGVPPSNDKPNFLTDSRTNTSFERNGRPLGLRAASVWIYFYPRGLLDLLLYTKEKYNNPLIYITENGMNEFNDPTLSVEEALMDIYRIDYYYRHFFYLRSAIKAGANVKGFFAWSFLDCNEWFAGFTVRFGLNFVDYKDGLKRYPKLSAQWYKNFLKRN

SEQ ID NO: 14617 - protein, 507 aa, Panicum virgatum
  misc_feature: Useful for making plants with altered carbohydrate content
AGGGVWRPLLAGAWLLWLLPWASAVRRSDFPASFLFGTATSSYQIEGAYLEGNKSLSNWDVLTHLPGRIKDGSTGDIADDHYHRFEVRTIDDVELMYSLGTNAYRFSISWARILPRGRFGEVNPEGIKFYNELIDSLLLKGIEPFVTLSHYDMPQELEDRYGAWLSAEIRRDFGHLADVCFAAFGDRVKYWVTFNEPNVVARKGYLLGTYPPERCSPPYGSCARGDSGAEPYLATHNIVLTHATAVEIYKRKYQSKQKGSIGIVMSTTWYKPLTDSPEDRLATERVLAFDVPWFLDPIVYGDYPPEMRQLLGSRLPTFSPEERRKLGYKLDFIGINHYTTLYARDCMFSPGCPLGQQSQPALAATTGERNGIPIGPPTPMPTFYVVPEGIEKIVTYVMKRYNNLPMFITENGYAQGGDGYAHVDDWLDDQGRIQYLDSYLTKLAEVIRDGAEVRGYFVWALMDNFEWLYGYTLRFGLHYVDYQTQERKPKSSALWYKGFLQSLHEAQ

SEQ ID NO: 14618 - protein, 41 aa, Arabidopsis thaliana
  misc_feature: Useful for making plants with altered cell wall content and/or composition
MDNFEWEHGYTARFGLYYVDFVNGLKRYPKDSVKWFKRFLK

SEQ ID NO: 14619 - protein, 520 aa, Arabidopsis thaliana
  misc_feature: Useful for making plants with altered cell wall content and/or composition
MKNLTSFVIVILLQSLLFHVYGRHQSSSKNILVDSSPFPSDFLFGTASSAYQYEGAFLTDGKSLNNWDVFTHKNPGKILDKNNADRAVDQYNRFLEDIQLMSFLGVNSYRFSISWCRILPRGRFGEINYLGIKYYNIFIDALISRGIKPFVTLNHVDYPQELEDRFQSWLNPEMQKEFGYLADICFKHFGNRVKYWTTLNEPNQQLILGYLTGKFPPSRCSSPYGNCSQGNSETEPFIAAHNMILAHAKAVNIYKTKYQKEQKGSIGIVVQTSWFEPISDSNADKEAAERAQSFYSNWILDPVIYGKYPKEMVDILGPALPQFSSNEVKNLEKSRADFVGINHYTSYFIQDCLTSACNTGHGAFKAEGYALKLDRKGNVTIGELTDVNWQHIDPTGFHKMLNYLKDRYPNMPMFITENGFGDLQKPETTDKELLNDTKRIQYMSGYLEALQAAMRDGANVKGYFVWSLLDNFEWLFGYKVRFGLFHVDLTTLKRSPKQSASWYKNYIEEHVNRRDIVDNY

SEQ ID NO: 14620 - protein, 377 aa, Arabidopsis thaliana
  misc_feature: Useful for making plants with altered cell wall content and/or composition
MFTGITPFVTLNHFDYPQELENRFKSWLSSEMQKDFGYLADICFKHFGDRVKHWITINEPNQHISLAYRSGLFPPARCSMPYGNCTHGNSETEPFIAAHNMILAHAKAIQIYRTKYQREQKGIIGIVVQTSWFEPISDSIADKNAAERAQSFYSNWILDPVVYGKYPEEMVNLLGSALPKFSSNEMNSLMSYKSDFLGINHYTSYFIQDCLITACNSGDGASKSEGLALKLDRKGNVSIGELTDVNWQHIDPNGFRKMLNYLKNRYHNIPMYITENGFGQLQKPETTVEELLHDTKRIQYLSGYLDALKAAMRDGANVKGYFAWSLLDNFEWLYGYKVRFGLFHVDFTTLKRTPKQSATWYKNFIEQNVNIEDQIDK

SEQ ID NO: 14621 - protein, 535 aa, Arabidopsis thaliana
  misc_feature: Useful for making plants with altered cell wall content and/or composition
MKKSIVYEIMETKSSMYLSQFRLWLCFIITTLVSLSSSTRWYDDHISLKEIHAEETFHFPKNFLFGTASSAYQYEGAYLTDGKTLSNWDVFTNISGKIADGSHGKVAVDHYHRYPGDLDLMEDLGVNSYRLSLSWARILPKGRFGDVNMGGIDHYNRMINDILKTGIEPFVTLTHYDIPQELEYRYGSWLNPQIREDFEHYANICFRHFGDRVKFWSTFNEPNVQVILGYRTGTYPPSRCSKPFGNCSCGDSYIEPLVAAHNIILSHLAAVNLYRTKFQEQQRGQIGIVMNTIWFEPISDSLADRLAADRAQAFYLTWFLDPVVFGRYPREMREILGDDLPEFTKDDLKSSKNALDFIGINQYTSRYAKDCLHSVCEPGKGGSRAEGFVYANALKDGLRLGEPVGMEEMLMYATERYKNITLYVTENGFGENNTGVLLNDYQRVKFMSNYLDALKRAMRKGADVRGYFAWSLLDNFEWISGYTIRFGMYHVDFSTQERTPRLSASWYKNFIFQHRALSKDDWCLKQKEDTNFFLI

SEQ ID NO: 14622 - protein, 717 aa, Arabidopsis thaliana
  misc_feature: Useful for making plants with altered cell wall content and/or composition
MDQIEAMLCGGGEKTKVAVTTKTLADPLNWGLAADQMKGSHLDEVKKMVEEYRRPVVNLGGETLTIGQVAAISTVGGSVKVELAETSRAGVKASSDWVMESMNKGTDSYGVTTGFGATSHRRTKNGTALQTELIRFLNAGIFGNTKETCHTLPQSATRAAMLVRVNTLLQGYSGIRFEILEAITSLLNHNISPSLPLRGTITASGDLVPLSYIAGLLTGRPNSKATGPDGESLTAKEAFEKAGISTGFFDLQPKEGLALVNGTAVGSGMASMVLFEANVQAVLAEVLSAIFAEVMSGKPEFTDHLTHRLKHHPGQIEAAAIMEHILDGSSYMKLAQKVHEMDPLQKPKQDRYALRTSPQWLGPQIEVIRQATKSIEREINSVNDNPLIDVSRNKAIHGGNFQGTPIGVSMDNTRLAIAAIGKLMFAQFSELVNDFYNNGLPSNLTASSNPSLDYGFKGAEIAMASYCSELQYLANPVTSHVQSAEQHNQDVNSLGLISSRKTSEAVDILKLMSTTFLVGICQAVDLRHLEENLRQTVKNTVSQVAKKVLTTGINGELHPSRFCEKDLLKVVDREQVFTYVDDPCSATYPLMQRLRQVIVDHALSNGETEKNAVTSIFQKIGAFEEELKAVLPKEVEAARAAYGNGTAPIPNRIKECRSYPLYRFVREELGTKLLTGEKVVSPGEEFDKVFTAMCEGKLIDPLMDCLKEWNGAPIPIC

SEQ ID NO: 14623 - protein, 345 aa, Arabidopsis thaliana
  misc_feature: Useful for making plants with altered cell wall content and/or composition
MSSLRLRLCLLLLLPITISCVTVTLTDLPAFREAPAFRNGRECSKTTWIPSDHEHNPSIIHIAMTLDAIYLRGSVAGVFSVLQHASCPENIVFHFIATHRRSADLRRIISSTFPYLTYHIYHFDPNLVRSKISSSIRRALDQPLNYARIYLADLLPIAVRRVIYFDSDLVVVDDVAKLWRIDLRRHVVGAPEYCHANFTNYFTSRFWSSQGYKSALKDRKPCYFNTGVMVIDLGKWRERRVTVKLETWMRIQKRHRIYELGSLPPFLLVFAGDVEPVEHRWNQHGLGGDNLEGLCRNLHPGPVSLLHWSGKGKPWLRLDSRRPCPLDSLWAPYDLFRYSPLISDS

SEQ ID NO: 14624 - protein, 147 aa, Brassica napus
  misc_feature: Useful for making plants with modulated nitrogen use efficiency
MPHGTLEVVLVSAKGLEDSDFLNSMDPYVLLTCRTQDQKSNVASGQGTTPEWNETFIFNVSEGTTELKAKIFDTDVGTEDDPLGEATIPLEAVFLEGDIPPAAYNVVKDEEFKGEIWIALSFKPSENRSRGFEEESYGGWKNSEASY

SEQ ID NO: 14625 - protein, 362 aa, Arabidopsis thaliana
  misc_feature: Useful for making plants with altered cell wall content and/or composition
MAQLTNSLNYLFSVSLLLFVSFHCLCFRFSLVAACSNSTDDQQIQHHHHRKWVGPSGHKVITVSLNGHAQFRSVQDAVDSIPKNNNKSITIKIAPGFYREKVVVPATKPYITFKGAGRDVTAIEWHDRASDLGANGQQLRTYQTASVTVYANYFTARNISFTNTAPAPLPGMQGWQAVAFRISGDKAFFSGCGFYGAQDTLCDDAGRHYFKECYIEGSIDFIFGNGRSMYKDCELHSIASRFGSIAAHGRTCPEEKTGFAFVGCRVTGTGPLYVGRAMGQYSRIVYAYTYFDALVAHGGWDDWDHKSNKSKTAFFGVYNCYGPGAAATRGVSWARALDYESAHPFIAKSFVNGRHWIAPRDA

SEQ ID NO: 14626 - protein, 215 aa, Panicum virgatum
  misc_feature: Useful for making plants with altered carbohydrate content
MPLTGSVLRSSFLSWQNTAPAPMPGTQGGQAVAFRISGDKAFFFGCGFHGAQDTLCDDAGRHYFRDCYIEGSIDFVFGDARSLYKDCELRSTAERYGSVAAHGRRDPCERTGFAFVNCRVTGTGRLYVGRAMGQYSRIVYAYTYFDSVIAPGGWDDWDHTSNKSMTAFFGMYRNWGPGVDAVHGVPWARELDYFAARPFLGKSFVNGYHWLTPDV

SEQ ID NO: 14627 - protein, 170 aa, Arabidopsis thaliana
  misc_feature: Useful for making plants with modulated nitrogen use efficiency
MDQIFNKVGSYWLGQKANKQFDSVGNDLNSVSTSIEGGTKWLVNKIKGKMQKPLPELLKEYDLPIGIFPGDATNYEFDEETKKLTVLIPSICEVGYKDSSVLKFTTTVTGHLEKGKLTDVEGIKTKVMIWVKVTSISTDASKVYFTAGMKKSRSRDAYEVQRNGLRVDKF

SEQ ID NO: 14628 - protein, 482 aa, Panicum virgatum
  misc_feature: Useful for making plants with altered carbohydrate content
MASYRPEHPNPAARRPRPVVLLMLAFFALQLLIFLSFRAVRPPPAPASAADTAAAVPVLASAPAHRDGNASSCGGGLVYVYDLPAAFNEDLLRMCDKLAPMYPLCPYLANDGLGLPAGGTNLSSLLPRELLGSWYASDQFALEHIVHRRLLSHRCRTADPARAAAFFVPFYAGLAVGRHLWAANATGADRDRDCAALLSWLHAQPWYRRSRGWDHFIALGRITWDFRRTSDDAWGGSFLTMPGVANITRLVIERDPWDDIDVGVPYPTGFHPRAAADVRAWQRHVARRPRPMLFAFAGAPRSAIRGDFRALLLGECQAAGPAACGALDCAEGRCIRNNALVMDLFMGARFCLQPRGDSFTRRSLFDCIVAGAVPVLFWRRSAYRQYGWYLPVGDGREAEWSVFIDREKLRAGNLTVRGVLAAIPEPRVRLMRERVVEMIPRLVYAAADRGKGLGGGMEDAVDVMVDGMLRRVAEQRPRWRPT

SEQ ID NO: 14629 - protein, 437 aa, Panicum virgatum
  misc_feature: Useful for making plants with altered carbohydrate content
MAAAPHHHRGHFVLLVLSLAAAFAAAADSSHNITAVLDGRSEYTLYNSYLSETKVCDEINSEHTVTVLVLTNGAMSSLVANLSLADIKNALRMLTLLDYFDEKKLHSLDSGSELTTSLYQKTGQAAGNMGHVNITDLRGGKVAFASAAPGAKFQSTYTKRVDTEPSTLSVLEVSDPITFPGLFGSPSASSVNLTDILDKAGCKQFARLIVSSGVVKMYQAAMDKALTLLAPNDDAFKAKGLPDLTKLSSADLVTLLQYHALPQYAPKASLKVAKGDIPTLASTGAGKYGLSVVSSGDDVSLDTGLGKSRVASTVLDNTPTVILTVDKLLLPSELFGGAPSPAPAPGPAADVPVSAPAPETSAPAPSPKAAGKKKKKAKSPSHSPPAPPSDSPDLAPADAPEGDAADKADSKKNGAAAAAVNFAATVACIALAVAAFL

SEQ ID NO: 14630 - protein, 410 aa, Arabidopsis thaliana
  misc_feature: Useful for making plants with altered cell wall content and/or composition
MATSRAFTLFAFTLSLLTVASTVSGHNITQILSDTPEYSSFNNYLSQTKLADEINSRTTITVLVLNNGAMSSLAGKHPLSVVKNALSLLVLLDYYDPLKLHQLSKGTTLTTTLYQTTGHALGNLGFVNVTDLKGGKVGFGSAAPGSKLDSSYTKSVKQIPYNISVLEINAPIIAPGILTAPAPSSAGVSNITGLLEKAGCKTFANLLVSSGVIKTFESTVEKGLTVFAPSDEAFKARGVPDLTNLTQAEVVSLLEYHALAEYKPKGSLKTNKDAISTLATNGAGKYDLTTSTSGDEVILHTGVGPSRLADTVVDETPVVIFTVDNVLLPAELFGKSSSPAPAPEPVSAPTPTPAKSPSPVEAPSPTAASPPAPPVDESSPEGAPSDSPTSSENSNAKNAAFHVNAPALFT

SEQ ID NO: 14631 - protein, 349 aa, Glycine max
  misc_feature: Useful for making plants with modulated oxidative stress sensitivity
MAEKLVLVSDMASTMKQVPSNFIRPLGDRPNLQGVVQSSDVCIPLIDLQDLHGPNRSHIIQQIDQACQNYGFFQVTNHGVPEGVIEKIMKVTREFFGLPESEKLKSYSTDPFKASRLSTSFNVNSEKVSSWRDFLRLHCHPIEDYIKEWPSNPPSLREDVAEYCRKMRGVSLKLVEAISESLGLERDYINRVVGGKKGQEQQHLAMNYYPACPEPELTYGLPGHTDPTVITILLQDEVPGLQVLKDGKWVAVNPIPNTFVVNVGDQIQVISNDKYKSVLHRAVVNCNKDRISIPTFYFPSNDAIIGPAPQLIHHHHHPPQYNNFTYNEYYQNFWNRGLSKETCLDIFKA

SEQ ID NO: 14632 - protein, 257 aa, Panicum virgatum
  misc_feature: Useful for making plants with altered carbohydrate content
MAPPLLLVLLLLPSLAAGHQHPSSFGSSALSEWRSAKASYYAADPEDAIGGACGFGDLGKHGYGMATVGLSTALFERGAACGGCYEVKCVEDLKYCLPGTSIVVTATNFCAPNYGLPADAGGHCNPPNHHFLLPIQAFEKIALWKAGVMPIQYRRVKCLREGGVRFSVNGRRFFFTVLISNVGGAGDVRSVKIKGTESGWLSMGRNWGQVWHINCDMRGQPLSFELSSSDGKPLTSFNVVPKDWEYGKTYTGKQFLL

SEQ ID NO: 14633 - protein, 194 aa, Arabidopsis thaliana
  misc_feature: Useful for making plants with altered cell wall content and/or composition
MATVGLSETLFERGQICGACFELRCVDDLRWCIPGTSIILTATNFCAPNYGFDPDGGGHCNPPNKHFVLPIEAFEKIAIWKAGNMPVQYRRINCRKEGSMRFTVDGGGIFISVLITNVAGSGDIAAVKIKGSRTGWLPMGRNWGQNWHINADLRNQALSFEVTSSDRSTVTSYNVSPKNWNYGQTFEGKQFETP

SEQ ID NO: 14634 - protein, 394 aa, Zea mays
  misc_feature: Useful for biocontainment applications
MDPNDAFSAAHPFRWDLGPPAPAAPAPPPPPPPAPQLLPHAPLLSAPRELEDLVAGYGVRPSTVARISELGFTASTLLGMTERELDDMMAALAGLFRWDVLLGERFGLRAALRAERGRVMSLGGRFHTGSTLDAASQEVLSDERDAAASGGLAEGEAGRRMVTAGKKKGKKGVGARKGKKARRKKELRPLDVLDDENDGDEDGGGGGSDSTESSAGGSGGGERQREHPFVVTEPGEVARAKKNGLDYLFHLYEQCRVFLLQVQSLAKLGGHKSPTKVTNQVFRYAKKCGASYINKPKMRHYVHCYALHCLDEEASNALRRAYKARGENVGAWRQACYAPLVEIAARHGFDIDAVFSAHPRLTIWYVPTRLRQLCHQARGSHAHAAAGLPPPPMF

SEQ ID NO: 14635 - protein, 393 aa, Zea mays
  misc_feature: Useful for making plants with modulated biomass
DPNDAFSAAHPFRWDLGPPAPAAPAPPPPPPPAPQLLPHAPLLSAPRELEDLVAGYGVRPSTVARISELGFTASTLLGMTERELDDMMAALAGLFRWDVLLGERFGLRAALRAERGRVMSLGGRFHTGSTLDAASQEVLSDERDAAASGGLAEGEAGRRMVTTGKKKGKKGVGARKGKKARRKKELRPLDVLDDENDGDEDGGGGGSDSTESSAGGSGGGERQREHPFVVTEPGEVARAKKNGLDYLFHLYEQCRVFLLQVQSLAKLGGHKSPTKVTNQVFRYAKKCGASYINKPKMRHYVHCYALHCLDEDASNALRRAYKARGENVGAWRQACYAPLVEIAARHGFDIDAVFAAHPRLTIWYVPTRLRQLCHQARGSHAHAAAGLPPPPMF

SEQ ID NO: 14636 - protein, 390 aa, Zea mays
  misc_feature: Useful for making plants with modulated biomass
  misc_feature: Useful for making plants with modulated flowering time
DPNDAFSAAHPFRWDLGPPAHAAPAPAPPPPPLAPLLLPPHAPRELEDLVAGYGVRPSTVARISELGFTASTLLGMTERELDDMMAALAGLFRWDVLLGERFGLRAALRAERGRVMSLGARCFHAGSTLDAASQEALSDERDAAASGGGMAEGEAGRRMVTTTAGKKGKKGVVGTRKGKKARRKKELRPLNVLDDENDGDEYGGGSESTESSAGGSGERQREHPFVVTEPGEVARAKKNGLDYLFHLYEQCRVFLLQVQSIAKLGGHKSPTKVTNQVFRYANKCGASYINKPKMRHYVHCYALHCLDEEASNALRRAYKSRGENVGAWRQACYAPLVEIAARHGFDIDAVFAAHPRLAVWYVPTRLRQLCHQARGSHAHAAAGLPPPPMF

SEQ ID NO: 14637 - protein, 287 aa, Panicum virgatum
  misc_feature: Useful for making plants with altered carbohydrate content
MRSLAVAVAAMACLAAVAQAGNFYQDTEMTWGGGRGKVVDGGRGLDLTLDRTSGSGFQSKSEYLFGKIDMQIKLVPGNSAGTVTTFYLSSQGSTHDEIDFEFLGNVTGEPYTLHTNVFTQGQGQREQQFRLWFDPTTAYHTYSIVWNPQHIIFAVDGTPIRDFKNHEARGVAFPKSQPMRLYASLWNADDWATQGGRVKADWSHAPFVASFRGFRADACVWSGGRQQCPVGTMEAAAAGGGRGWWSQQLSDTSYRRMRWVQRKFMIYNYCTDAKRFPQGVPTECHLR

SEQ ID NO: 14638 - protein, 286 aa, Arabidopsis thaliana
  misc_feature: Useful for making plants with altered cell wall content and/or composition
MAMISYSTIVVALLASFMICSVSANFQRDVEITWGDGRGQITNNGDLLTLSLDKASGSGFQSKNEYLFGKIDMQIKLVAGNSAGTVTAYYLKSPGSTWDEIDFEFLGNLSGDPYTLHTNVFTQGKGDREQQFKLWFDPTSDFHTYSILWNPQRIIFSVDGTPIREFKNMESQGTLFPKNQPMRMYSSLWNAEEWATRGGLVKTDWSKAPFTASYRGFNEEACVVINGQSSCPNVSGQGSTGSWLSQELDSTGQEQMRWVQNNYMIYNYCTDAKRFPQGLPRECLAA

SEQ ID NO: 14639 - protein, 277 aa, Arabidopsis thaliana
  misc_feature: Useful for making plants with altered cell wall content and/or composition
LSLLFTLTVSTTTLFSPVFAGTFDTEFDITWGDGRGKVLNNGELLTLSLDRASGSGFQTKKEYLFGKIDMQLKLVPGNSAGTVTAYYLKSKGDTWDEIDFEFLGNLTGDPYTMHTNVYTQGKGDREQQFHLWFDPTADFHTYSVLWNPHHIVFMVDDIPVREFKNLQHMGIQYPKLQPMRLYSSLWNADQWATRGGLVKTDWSKAPFTASYRNFRADACVSSGGRSSCPAGSPRWFSQRLDLTAEDKMRVVQRKYMIYNYCTDTKRFPQGFPKECRH

SEQ ID NO: 14640 - protein, 289 aa, Arabidopsis thaliana
  misc_feature: Useful for making plants with altered cell wall content and/or composition
MGPSSSLTTIVATVLLVTLFGSAYASNFFDEFDLTWGDHRGKIFNGGNMLSLSLDQVSGSGFKSKKEYLVGRIDMQLKLVAGNSAGTVTAYYLSSQGATHDEIDFEFLGNETGKPYVLHTNVFAQGKGDREQQFYLWFDPTKNFHTYSIVWRPQHIIFLVDNLPIRVFNNAEKLGVPFPKSQPMRIYSSLWNADDWATRGGLVKTDWSKAPFTAYYRGFNAAACTASSGCDPKFKSSFGDGKLQVATELNAYGRRRLRWVQKYFMIYNYCSDLKRFPRGFPPECKKSRV

SEQ ID NO: 14641 - protein, 458 aa, Zea mays
  misc_feature: Useful for making plants with modulated biomass
  misc_feature: Useful for making plants with modulated flowering time
GYNVSSDELYHVVEASGLHNSLGGYLNDTRTLLELHKASTVSISEDESILDSIGSRSRTLLREQLESGGALRKPSLFKEVEHALDGPFYTTLDRLHHRWNIENFNIIEQHMLETPYLSNQHTSRDILALSIRDFSSSQFTYQQELQHLESWVKECRLDQLQFARQKLAYFYLSAAGTMFSPELSDARTLWAKNGVLTTIVDDFFDVAGSKEELENLVMLVEMWDEHHKVEFYSEQVEIIFSSIYDSVNQLGEKASLVQDRSITKHLVEIWLDLLKSMMTEVEWRLSKYVPTEKEYMINASLTFGLGPIVLPALYFVGPKISESIVKDPEYDELFKLMSTCGRLLNDVQTFEREYNEGKLNSVSLLVLHGGSMSISDAKRKLQKPIDTCRRDLLSLVLREESVVPRPCKELFWKMCKVCYFFYSTTDGFSSQVERAKEVDAVINEPLKLQGSHTLVSDV

SEQ ID NO: 14642 - protein, 363 aa, Arabidopsis thaliana
  misc_feature: Useful for making plants with altered cell wall content and/or composition
MERLSGEKEQSVEAFGWAARDSSGHLSPFVFSRRKTGEEEVRVKVLYCGICHSDLHCLKNEWHSSIYPLVPGHEIIGEVSEIGNKVSKFNLGDKVGVGCIVDSCRTCESCREDQENYCTKAIATYNGVHHDGTINYGGYSDHIVVDERYAVKIPHTLPLVSAAPLLCAGISMYSPMKYFGLTGPDKHVGIVGLGGLGHIGVRFAKAFGTKVTVVSSTTGKSKDALDTLGADGFLVSTDEDQMKAAMGTMDGIIDTVSASHSISPLIGLLKSNGKLVLLGATEKPFDISAFSLILGRKSIAGSGIGGMQETQEMIDFAAEHGIKAEIEIISMDYVNTAMDRLAKGDVRYRFVIDISNTLAATRS

SEQ ID NO: 14643 - protein, 122 aa, Arabidopsis thaliana
  misc_feature: Useful for making plants with modulated nitrogen use efficiency
MEKNSFKLSNPLEMRMAESTRIRAKYPERVPVIVEKAGQSDVPDIDKKKYLVPADLTIGQFVYVVRKRIKLGAEKAIFVFVKNTLPPTAALMSAIYEEHKDEDGFLYMTYSGENTFGGSFYC

SEQ ID NO: 14644 - protein, 473 aa, Arabidopsis thaliana
  misc_feature: Useful for making plants with altered alkaloid content
MDSVYKTDENFAADVAALLAPLPTPQLQILKFLSGSNVVYSNLISSKCLGVYANSEFDEDELILKDEILVGIQHSSNKVDCLVCSFCFRFIGSIEKQIGRKLYFKNLGVSGCCDDDSSEEDECVKYNGNEEQCGGSSSSHNTLPEGVVSSLMNGEMALPHTDKFPLPSPLSCPGGCQEAFYCSESCAAADWESSHSLLCTGERSESISREALGEFIKHANDTNDIFLLAAKAIAFTILRYRKLKAEHVDKKAKQSEPKQSLLLEAWKPVSIGYKRRWWDCIALPDDVDPTDEGAFRMQIKNLACTSLELLKIAIFDKECEARIPPMFSLEIYGNIIGMFELNNLDLVVASPVEDYFLYIDDLPDAEKEETEEITRPFLDALGDEYSDCCQGTAFFPLQSCMNHSCCPNAKAFKREEDRDGQAVIIALRRISKNEEVTISYIDEELPYKERQALLADYGFSCKCSKCLEDSSSI

SEQ ID NO: 14645 - protein, 99 aa, Arabidopsis thaliana
  misc_feature: Useful for making plants with modulated biomass
  misc_feature: Useful for making plants with modulated flowering time
MSGRKETVLDLAKFVDKGVQVKLTGGRQVTGTLKGYDQLLNLVLDEAVEFVRDHDDPLKTTDQTRRLGLIVCRGTAVMLVSPTDGTEEIANPFVTAEAV

SEQ ID NO: 14646 - protein, 89 aa, Arabidopsis thaliana
  misc_feature: Useful for making plants with modulated flowering time
  misc_feature: Useful for making plants with modulated time to senescence
MSGRKETVLDLAKFVDKGVQVKLTGGRQVTGTLKGYDQLLNLVLDEAVEFVRDHDDPLKTTDQTRRLGLIVCRGTGDACLTNRWHRRNR

SEQ ID NO: 14647 - protein, 571 aa, Arabidopsis thaliana
  misc_feature: Useful for making plants with altered cell wall content and/or composition
MGVDGELKKKKCIIAGVITALLVLMVVAVGITTSRNTSHSEKIVPVQIKTATTAVEAVCAPTDYKETCVNSLMKASPDSTQPLDLIKLGFNVTIRSIEDSIKKASVELTAKAANDKDTKGALELCEKLMNDATDDLKKCLDNFDGFSIPQIEDFVEDLRVWLSGSIAYQQTCMDTFEETNSKLSQDMQKIFKTSRELTSNGLAMITNISNLLGEFNVTGVTGDLGKYARKLLSAEDGIPSWVGPNTRRLMATKGGVKANVVVAHDGSGQYKTINEALNAVPKANQKPFVIYIKQGVYNEKVDVTKKMTHVTFIGDGPTKTKITGSLNYYIGKVKTYLTATVAINGDNFTAKNIGFENTAGPEGHQAVALRVSADLAVFYNCQIDGYQDTLYVHSHRQFFRDCTVSGTVDFIFGDGIVVLQNCNIVVRKPMKSQSCMITAQGRSDKRESTGLVLQNCHITGEPAYIPVKSINKAYLGRPWKEFSRTIIMGTTIDDVIDPAGWLPWNGDFALNTLYYAEYENNGPGSNQAQRVKWPGIKKLSPKQALRFTPARFLRGNLWIPPNRVPYMGNFQ

SEQ ID NO: 14648 - protein, 557 aa, Arabidopsis thaliana
  misc_feature: Useful for making plants with altered alkaloid content
MSARISFLKNPDPCNHLSDYKLRYGTDGYKSFNNLFRCFNDARIKIKLQGIDIPRCSYCSVYQKRLYICLICRSISCSSHILLHTQLNKGHDIAIDVERSELYCCACIDQVYDSEFDEVVVSKQLFGLGMSVKSGADVVAVRSNKKRRLDSQLIIGSNFLVSPRDRREKWTFPLGLRGLNNLGSTCFMNAVLQALVHAPPLRNFWLSGQHNRDLCPRRTMGLLCLPCDLDVIFSAMFSGDRTPYSPAHLLYSWWQHSTNLATYEQQDSHEFFISLLDRIHENEGKSKCLYQDNEECQCITHKAFSGLLRSDVTCTTCGSTSTTYDPFIDISLTLDSMNGFSPADCRKNRYSGGPSVNAIMPTLSGCLDFFTRSEKLGPDQKLNCQSCGEKRESSKQMSIRRLPLLLCLHVKRFEHSLTRKTSRKIDSYLQYPFRLNMSPYLSSSIIGKRFGNRIFAFDGEGEYDSSSSSSPSAEFEIFAVVTHKGMLESGHYVTYLRLKGLWYRCDDAWINEVEEEVVRGCECYMLFYAQETVIQKAHKELSYQVISMADAFPFADC

SEQ ID NO: 14649 - protein, 442 aa, Panicum virgatum
  misc_feature: Useful for making plants with altered carbohydrate content
MKLPLWPGLAPAAGPPDAAPEPAKPSLPAAWLLLHALFCATSMAVGFRFSRLIVYLLFLPTPPINPAAQLVSLVSPPVMLTAGNATATITTTTTTTTTVTTTTTVATEIGPHQHQHHHHGPVFVGRHPIRVRSWPHPDPNELLKAHRILAAVQNAQRSSKRRGAGPPRPVIAVTPTTTSVLQVPSLTSLAHTLRLVDAQLMWIVVEPGHRTDAVAAVLSRSNLDFLHITGPGDSTASLRLHALREIRAKRMDGIVVFADENSILRTELFDEAQKVSTVGAVPVGILGDDDGTSESFLQAPSCDAAGKLVGYHVSEETVLPANRGDMLMSSRLEWAGFVVNARALWDDAKERPEWVRDLGAIDDADARAASPLALVTDPGRVEPLASCAQAALAWSLRSDSLHEVKFPHEWKFDPPQLSTGSNEQSVKPETKQTTLASTEDQH

SEQ ID NO: 14650 - protein, 322 aa, Arabidopsis thaliana
  misc_feature: Useful for making plants with altered lignin content
MVMRKLQLPLSQTQKVRFERAIERLQSLSSSANSDASVIVTDSIPVNHDDAFLKGHGTSEVDGELLATVCGVVERVDKLVYVRTLRARYKPEVGDIVVGRVIEVAQKRWRVELNFNQDGVLMLSSMNMPDGIQRRRTSVDELNMRNIFVEHDVVCAEVRNFQHDGSLQLQARSQKYGKLEKGQLLKVDPYLVKRSKHHFHYVESLGIDLIIGCNGFIWVGEHVEVRDPMAIDDQKDEEMISSSSTGKEQSHIPLETRQTICRIGNAIRVLSNLGFTVTLEVIMETVNLSNSKNIDIHDMLGSEFHVVVAENEAERRRTKRKK

SEQ ID NO: 14651 - protein, 314 aa, Arabidopsis thaliana
  misc_feature: Useful for making plants with modulated nitrogen use efficiency
MESVVATWSREEEKAFENAIALHCVEEEITEDQWNKMSSMVPSKALEEVKKHYQILLEDVKAIENGQVPLPRYHHRKGLIVDEAAAAATSPANRDSHSSGSSEKKPNPGTSGISSSNGGRSGGSRAEQERRKGIPWTEEEHRLFLLGLDKFGKGDWRSISRNFVISRTPTQVASHAQKYFIRLNSMNRDRRRSSIHDITTVNNQAPAVTGGGQQPQVVKHRPAQPQPQPQPQPQQHHPPTMAGLGMYGGAPVGQPIIAPPDHMGSAVGTPVMLPPPMGTHHHHHHHHLGVAPYAVPAYPVPPLPQQHPAPSTMH

SEQ ID NO: 14652 - protein, 356 aa, Arabidopsis thaliana
  misc_feature: Useful for making plants with altered cell wall content and/or composition
MLGSRVVHQLYFLILTLILPFSAAYQVGVNYGTVANNLPPPHQVVNFIKTKTIINHVKIFDTNHDILAAFSGITGISLTVTVPNSDIISLSKLSNARSWLSDNLLPFLLTTSIRYIAVGNEVVATSDKTLITHLLPAMETLTLALHLANVSRILVSTPHSLGILSGSSEPPSSGKFRKGYDKAIFSPILDFHNRTKSPFMVNPYPYFGFGPETLNYALFNTNDVVYVDPVTKLNYTNMFDAQLDAVYSAMKRFGYGDVDIVVAETGWPSAGEPNQTGVGLDYAAAYNGNLIKHVNSGKGTPLMPNRVFETYVFSLFNENLKSSVSEQNFGLFKPDFTPVYDVGIMKTNKVYTLQLL

SEQ ID NO: 14653 - protein, 501 aa, Arabidopsis thaliana
  misc_feature: Useful for making plants with altered cell wall content and/or composition
MALYLSSSRLITFLSFILLLSNGFSSSSSRPSIHHRHHLDNHNYKDALSKSILFFEGQRSGKLPPNQRMTWRSNSGLSDGSALNVDLVGGYYDAGDNMKFGFPMAFTTTMLSWSLIEFGGLMKSELPNAKDAIRWATDFLLKATSHPDTIYVQVGDPNMDHACWERPEDMDTPRSVFKVDKNNPGSDIAGEIAAALAAASIVFRKCDPSYSNHLLQRAITVFTFADKYRGPYSAGLAPEVCPFYCSYSGYQDELLWGAAWLQKATNNPTYLNYIKANGQILGADEFDNMFSWDNKHVGARILLSKEFLIQKVKSLEEYKEHADSFICSVLPGASSSQYTPGGLLFKMGESNMQYVTSTSFLLLTYAKYLTSARTVAYCGGSVVTPARLRSIAKKQVDYLLGGNPLKMSYMVGYGLKYPRRIHHRGSSLPSVAVHPTRIQCHDGFSLFTSQSPNPNDLVGAVVGGPDQNDQFPDERSDYGRSEPATYINAPLVGALAYLARS

SEQ ID NO: 14654 - protein, 162 aa, Arabidopsis thaliana
  misc_feature: Useful for making plants with altered protein content
  misc_feature: Useful for making plants with modulated cold sensitivity
MRKIIGFRIGRRVSRWIFRKTRIQRSGYNRIHSTQQACMLMRPLAKLKSWGQRLKQSFRRRSTRRSAYIPVDHKKADPVPRGHLAIYVGQKDGDCHRVLVPIVYFNHPLFGELLREAEKEYGFCHEGGITIPCLYSDFERVKTRIASGSSSRVFPWGRHCRN

SEQ ID NO: 14655 - protein, 106 aa, Arabidopsis thaliana
  misc_feature: Useful for making plants with modulated biomass
MEIKEASKTQRERRGASSLKQMLMKRCSSFVKKSNEEDVPKKGYFAVYVGHFRDRHVIPITSLNHPTFKMMLQKSEEEFGFRQESGLTIPCDQNTFLTLLDSITSY

SEQ ID NO: 14656 - protein, 239 aa, Arabidopsis thaliana
  misc_feature: Useful for making plants with modulated biomass
MKQPKPILKYVLVSIFLTLPLILFFSIQLRTPEKELIRIRPGYTSYDYYIQRQLNKTLNPRFRTIWMTRDWDRKIKVFSRFFQDLKRQGLLSKDSKCLCLGARVGQEVEALKRVGVNDSVGMDLVPYPPLVVKGDFHHQPFDDETFDFEFSNVFDHALYPDKFVGEIERTLRPGGLCVLHVALSTRSDKYSANDLFSVEALVKLFRQSEVVHVRNVDGFGLDTEVVFRKKRDSSILVRS

SEQ ID NO: 14657 - protein, 278 aa, Arabidopsis thaliana
  misc_feature: Useful for making plants with altered cell wall content and/or composition
MSTGLALNRCSVSVCRTAVTLLNRPTVSVARSLKFSRRLIGNCSIAPADPYVVADDDKYGNKQVISLTPRLYDYVLSNVREPKILRQLREETSKMRGSQMQVSPDQAQLLAMLVQMLAAERCIEVGVYTGYSSLAVALVLPESGCLVACERDSNSLEVAKRYYELAGVSHKVNVKQGLAAESLKSMIQNGEGASYDFAFVDADKRMYQDYFELLLQLVRVGGVIVMDNVLWHGRVSDPMVNDAKTISIRNFNKKLMDDKRVSISMVPIGDGMTICRKR

SEQ ID NO: 14658 - protein, 361 aa, Panicum virgatum
  misc_feature: Useful for making plants with altered carbohydrate content
MGSTATDVAAAADEEACMYALQLASSSILPMTLKNAIELGLLEVLQKDPAAALAPEEVVARLPVTPTNPDAATMVDRILRLLASYDVVRCQMEEGKDGKYSRRYAAAPVCKWLTPNEDGVSMAALALMNQDKVLMESWYYLKDAVLEGGIPFNKAYGMTAFEYHGTDPRFNRVFNEGMKNHSVIITKKLLEFYTGFEGVGTLVDVGGGIGATLHAITSHYPRITGVNFDLPHVISEAPPFPGVQHVGGDMFKAVPAGDAILMKWILHDWSGAHCAVILKNCYDALPAGGKVIIVECILPVNPEATPKAQGVFHADLIMLAHNPGGKERYEREFEELAKGAGFTGFKATYIYANAWAIEFTK

SEQ ID NO: 14659 - protein, 363 aa, Arabidopsis thaliana
  misc_feature: Useful for making plants with altered cell wall content and/or composition
MGSTAETQLTPVQVTDDEAALFAMQLASASVLPMALKSALELDLLEIMAKNGSPMSPTEIASKLPTKNPEAPVMLDRILRLLTSYSVLTCSNRKLSGDGVERIYGLGPVCKYLTKNEDGVSIAALCLMNQDKVLMESWYHLKDAILDGGIPFNKAYGMSAFEYHGTDPRFNKVFNNGMSNHSTITMKKILETYKGFEGLTSLVDVGGGIGATLKMIVSKYPNLKGINFDLPHVIEDAPSHPGIEHVGGDMFVSVPKGDAIFMKWICHDWSDEHCVKFLKNCYESLPEDGKVILAECILPETPDSSLSTKQVVHVDCIMLAHNPGGKERTEKEFEALAKASGFKGIKVVCDAFGVNLIELLKKL

SEQ ID NO: 14660 - protein, 317 aa, Zea mays
  misc_feature: Useful for making plants with altered alkaloid content
MEFIDPWDSQSRARVVHSGANSTSFSSSTAKAPLSLRHAASCAAAAVALLAAAFYLLPTYQILSSLLIWIASSLLLAPFAPLSATGGDISVGRGRVVPAPEPAPEPTPEPTPAPRRGRRQNPVPTPTKPSDPGTPPVQSAASLHPLQKATTAGGAVVDGGEREEDAGEWTDQELELLRRQMVKHPAGEPQRWEKIAAVFGGRRTPENVIRAAKSGAPAAGGSSFEQFLRKRKPLDPRAEVADTADDAGGAESADAAWSAGDDRALLNALKEFPKDTAMRWEKVAASVPGKTKAACMKRITELKRDFRSTKTASEAAP

SEQ ID NO: 14661 - protein, 154 aa, Arabidopsis thaliana
  misc_feature: Useful for making plants with modulated oxidative stress sensitivity
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGGSTSTTDSKFNN

SEQ ID NO: 14662 - protein, 732 aa, Arabidopsis thaliana
  misc_feature: Useful for making plants with modulated biomass
MSNQKKRNFQIEAFKHRVVVDPKYADKTWQILERAIHQIYNQDASGLSFEELYRNAYNMVLHKFGEKLYTGFIATMTSHLKEKSKLIEAAQGGSFLEELNKKWNEHNKALEMIRDILMYMDRTYIESTKKTHVHPMGLNLWRDNVVHFTKIHTRLLNTLLDLVQKERIGEVIDRGLMRNVIKMFMDLGESVYQEDFEKPFLDASSEFYKVESQEFIESCDCGDYLKKSEKRLTEEIERVAHYLDAKSEEKITSVVEKEMIANHMQRLVHMENSGLVNMLLNDKYEDLGRMYNLFRRVTNGLVTVRDVMTSHLREMGKQLVTDPEKSKDPVEFVQRLLDERDKYDKIINTAFGNDKTFQNALNSSFEYFINLNARSPEFISLFVDDKLRKGLKGITDVDVEVILDKVMMLFRYLQEKDVFEKYYKQHLAKRLLSGKTVSDDAERSLIVKLKTECGYQFTSKLEGMFTDMKTSEDTMRGFYGSHPELSEGPTLIVQVLTTGSWPTQPAVPCNLPAEVSVLCEKFRSYYLGTHTGRRLSWQTNMGTADIKAIFGKGQKHELNVSTFQMCVLMLFNNSDRLSYKEIEQATEIPAADLKRCLQSLACVKGKNVIKKEPMSKDIGEEDLFVVNDKFTSKFYKVKIGTVVAQKETEPEKQETRQRVEEDRKPQIEAAIVRIMKSRKILDHNNIIAEVTKQLQPRFLANPTEIKKRIESLIERDFLERDSTDRKLYRYLA

SEQ ID NO: 14663 - protein, 581 aa, Arabidopsis thaliana
  misc_feature: Useful for making plants with modulated flowering time
MNSMNNWLGFSLSPHDQNHHRTDVDSSTTRTAVDVAGGYCFDLAAPSDESSAVQTSFLSPFGVTLEAFTRDNNSHSRDWDINGGACNNINNNEQNGPKLENFLGRTTTIYNTNETVVDGNGDCGGGDGGGGGSLGLSMIKTWLSNHSVANANHQDNGNGARGLSLSMNSSTSDSNNYNNNDDVVQEKTIVDVVETTPKKTIESFGQRTSIYRGVTRHRWTGRYEAHLWDNSCKREGQTRKGRQGGYDKEEKAARAYDLAALKYWGTTTTTNFPLSEYEKEVEEMKHMTRQEYVASLRRKSSGFSRGASIYRGVTRHHQHGRWQARIGRVAGNKDLYLGTFGTQEEAAEAYDIAAIKFRGLSAVTNFDMNRYNVKAILESPSLPIGSSAKRLKDVNNPVPAMMISNNVSESANNVSGWQNTAFQHHQGMDLSLLQQQQERYVGYYNGGNLSTESTRVCFKQEEEQQHFLRNSPSHMTNVDHHSSTSDDSVTVCGNVVSYGGYQGFAIPVGTSVNYDPFTAAEIAYNARNHYYYAQHQQQQQIQQSPGGDFPVAISNNHSSNMYFHGEGGGEGAPTFSVWNDT

SEQ ID NO: 14664 - protein, 541 aa, Arabidopsis thaliana
  misc_feature: Useful for making plants with modulated light quality sensitivity
  misc_feature: Useful for making plants with modulated low light sensitivity
MFTSGNVTARVFERQIRTPPPGASVNRARHFYENLVPSYTLYDVESPDHCFRKFTEDGLFLISFSRNHQELIVYRPSWLTYSTTDDSTTTLPPLPRRASKFDSFFTQLYSVNLASSNELICKDFFLYHQTRRFGLFATSTAQIHDSSSPSNDAVPGVPSIDKITFVLLRLDDGVVLDERVFLHDFVNLAHNMGVFLYDDLLAILSLRYQRIHLLQIRDSGHLVDARAIGYFCREDDELFLNSSSQAMMSQDKSKQQSLSGSKEDDTGENGLRHSLSQPSGSNSFLSGVKQRLLSFIFREIWNEESDNRVQSLKKKFYFHFQDYVDLIIWKVQFLDRQHLLIKFGSVDGGVTRSADHHPAFFAVYNMETTDIVAFYQNSAEDLYQLFEQFSDHFTVSSSTPFMNFVTSHSNNVYALEQLKYTKNKSNSFSQFVKKMLLSLPFSCQSQSPSPYFDQSLFRFDEKLISAADRHRQSSDNPIKFISRRQPQTLKFKIKPGPECGTADGRSKKICSFLFHPHLPLAISIQQTLFMPPSVVNIHFRR

SEQ ID NO: 14665 - protein, 492 aa, Panicum virgatum
  misc_feature: Useful for making plants with altered carbohydrate content
MAAAAAAVRAAAVAVLSVAVLCGAAQAIGVNWGTQLSHPLPASTVVRLLQDNGFDKVKLFDAEDAILGALKGSGIQVMVGIPNDMLADLAAGGKAAEDWVAKNVSGHVRDGVDIRYVAVGNEPFLETFNGTYLNTTFPAMQNIQAALVKAGLADKVKVTVPLNADVYQSPTGKPSDGDFRGDIHGLMLTIVQFLASTGAPFVANVYPFISLYTDPNFPLDYAFFQGSSSPVVDGGVTYQNTFDANHDTLVAALRRNGFGNVSVVVGEVGWPTDGDANANLDYARRFNQGFLAHIAGGQGTPLRPGPVDAYLFSLIDEDRKSIQPGNFERHWGIFNYDGTPKYALSLAGGGNGSAALTLKPARGVQYLEKRWCVLKPSADLADQKVGDSVGYACGLADCTALGYKTSCGGLDARGNVSYAFNSYYQTMDQDDRACDFRGLAAATSVDPTAGTCRFIVQIDVGAAAAISSARGVAGGVASSALAALVLMSSMLL

SEQ ID NO: 14666 - protein, 477 aa, Arabidopsis thaliana
  misc_feature: Useful for making plants with altered cell wall content and/or composition
MGWGSVLLLLAVALLCQRASSIGANWGTQASHPLPPDIVVRMLRENGIQKVKLFDAEYDTLRALGKSGIEVMVGIPNEMLATLASSLKAAEKWVAKNVSTHISTDNVNIRYVAVGNEPFLSTYNGSYLSTTFPALRNIQIAIIKAGLQNQVKVTCPLNADVYDSSTTFPSGGDFRANIRDLMITIVKFLSENGGPFTVNIYPYISLYTNPDFPVDYAFFDGNAQPLNDGGTFYYNMFDANYDTLVHALEKNGFGNMPIIIGEIGWPTDGDSNANLDYAKKFNQGFMAHISGGKGTPRRPGPIDAYLFSLIDEDAKSVQPGYFERHWGIFTFDGLPKYALNLGTTNTGALIQAKGVRYLERKWCVMKPNVRLDDPQVAPAVSYACSLGDCTSLGVGTSCANLDGKQNISYAFNSYYQIQDQLDTACKFPNISEVTKTDPSTGTCRFPIMIEPYYGGAAREHGFFFPLLMVAAIAVSIF

SEQ ID NO: 14667 - protein, 130 aa, Arabidopsis thaliana
  misc_feature: Useful for making plants with altered cell wall content and/or composition
MGGDPTQISFATKQTGSNLCLTVSQSHPPPVDTWTSDSKISNRNRTRPVLSLKCPISTQVIFSIKFASFGTPKGTCGSFTQGHCNSSRSLSLVQKACIGLRSCNVEVSTRVFGEPCRGVVKSLAVEASCS

SEQ ID NO: 14668 - protein, 120 aa, Arabidopsis thaliana
  misc_feature: Useful for making plants with altered cell wall content and/or composition
MSPFKIFFFTTLLVAAFSVSAADFNTDVNVAWGNGRGKILNNGQLLTLSLDKSSGSGFQSKTEYLFGKIDMQIKLVPGNSAGTVTTFYLKSEGSTWDEIDFEFLGNMSGDPYTLHTNVYT

SEQ ID NO: 14669 - protein, 283 aa, Panicum virgatum
  misc_feature: Useful for making plants with altered carbohydrate content
MRSLAVAVAAMACLAAVARAGNFYQDTEMTWGGGRGKVVDGGRGLDLTLDRTSGSGFQSKSEYLFGKIDMQIKLVPGNSAGTVTTFYLSSQGSTHDEIDFEFLGNVTGEPYTLHTNVFTQGQGQREQQFRLWFDPTTAYHTYSIVWNPQHIIFAVDGTPIRDFKNHEAHGVAFPKSQPMRLYASLWNADDWATQGGRVKADWSHAPFVASFRGFRADACVWSGGRQQCPVGTMEAAARGWWSQQLSDTSYRRMRWVQRKFMIYNYCTDAKRFPQGVPAECHLR

SEQ ID NO: 14670 - protein, 355 aa, Arabidopsis thaliana
  misc_feature: Useful for making plants with altered cell wall content and/or composition
MKNLFNLFLMFFFAMPILSLSENPTNFSESCEDGSGETGSSFGIGFDLVLDFGLYRNSCPEAESIVYSWVETTVLEDPRMAASLLRLHFHDCFVNARNEYYEPECVFVFDLHYALQGCDASVLLDDTEGLVGEKTAPPNLNSLRGFEVIDSIKSDIESVCPETVSCADILAMAARDSVVVSGGPRWEVEVGRKDSRTASKQAATNGLPSPNSTVSTLISTFQNLGLSQTDMVALSARLQPLQTGQPANHGDNLEFLESLQQLCSTVGPSVGITQLDLVTPSTFDNQYYVNLLSGEGLLPSDQALAVQDPGTRAIVETYATDQSVFFEDFKNAMVKMGGIPGGSNSEIRKNCRMIN

SEQ ID NO: 14671 - protein, 479 aa, Arabidopsis thaliana
  misc_feature: Useful for making plants with altered cell wall content and/or composition
MGKLLVLMLVGMFLAFESLEALEYGDALNKSILFFEGQRSGKLPTNQRVKWRADSALSDGSLANVNLIGGYYDAGDNVKFVWPMSFTTTLLSWAAIEYQNEISSVNQLGYLRSTIKWGTDFILRAHTSPNMLYTQVGDGNSDHSCWERPEDMDTSRTLYSISSSSPGSEAAGEAAAALAAASLVFKSVDSTYSSTLLNHAKTLFEFADKYRGSYQASCPFYCSYSGYQDELLWAAAWLYKATGDKIYINYVISNKDWSQAVNEFSWDNKFVGAQALLVSEFYNGANDLAKFKSDVESFVCAMMPGSSSQQIKPTPGGLLFIRDSSNLQYVTTATTVLFHYSKTLTKAGVGSIQCGSTKFTVSQIRNFAKSQVDYILGNNPMKMSYMVGFGTKYPTQPHHRGSSLPSIQSKPEKIDCNGGYSYYNSDTPNPNVHIGAIVGGPNSSDQYSDKKSDYSHAEPTTYINAAFIGPVAALISSSG

SEQ ID NO: 14672 - protein, 136 aa, Arabidopsis thaliana
  misc_feature: Useful for making plants with modulated oxidative stress sensitivity
MVNKQGQTRLAQYYEWLTLEERRALEGEIVRKCLARNDQQCSFVEHRNYKIVYRRYASLFFMVGVDDDENELAILEFIHLLVETMDKHFGNVCELDIMFHLEKAHFMLEEMVMNGCIVETSKANILSPIQLMDKAH

SEQ ID NO: 14673 - protein, 461 aa, Arabidopsis thaliana
  misc_feature: Useful for making plants with altered cell wall content and/or composition
MIKMSEKSLLSSKFLFYTITVSTLLFIVSSLVFLQRHDSSFTSSLVRKLILPRTDIKNEEFGLIDTKCDRDRDVLKVFMYDLPSEFHFGILNWHKKGSEIWPNVNNISTIPSYPGGLNRQHSVEYWLTLDLLASETPEIKRPCSSAAIRVKNSNEADIVFVPFFASLSYNRKSKLRGNETSSDDRLLQERLVEFLKSQDEWKRFDGKDHLIVAHHPNSLLYARNFLGSAMFVLSDFGRYSSAIANLEKDIIAPYVHVVKTISNNESASFEKRPVLAYFQGAIYRKDGGTIRQELYNLLKDEKDVHFAFGTVRGNGTKQTGKGMASSKFCLNIAGDTPSSNRLFDAIVSHCVPVIISDQIELPFEDTLDYSGFSVFVHASEAVKKEFLVNILRGITEDQWKKKWGRLKEVAGCFEYRFPSQVGDSVNMIWSAVSHKLSSLQFDVHRKNRYRRSEMFDRNGSS

SEQ ID NO: 14674 - protein, 364 aa, Panicum virgatum
  misc_feature: Useful for making plants with altered carbohydrate content
MTVVDAVSAGAGDAAAAVPQPAGNGQTVCVTGAAGYIASWLVKLLLEKGYTVKGTVRNPDDPKNAHLKALDGAAERLILCKADLLDYDAICRAVEGCHGVFHTASPVTDDPEQMVEPAVRGTEYVISAAAEAGTVRRVVFTSSIGAVTMDPNRGPDVVVDESCWSDLDFCKKTRNWYCYGKAVAEQAAWEAARQRGVDLVVVNPVLVVGPLLQPTVNASIAHILKYLDGSARTFANAVQAYVDVRDVAAAHLRVFESPAASGRHLCAERVLHREDVVRILAKLFPEYPVPTRCSDEVNPRKQAYKFTNQKLRDLGLEFRPVSQSLYDTVKSLQEKGHLPVLADEQAPEAAPGAEAQQGGIAIRA

SEQ ID NO: 14675 - protein, 208 aa, Arabidopsis thaliana
  misc_feature: Useful for making plants with modulated nitrogen use efficiency
MLRTIFLLSLLFALSNASVQDFCVANLKRAETPAGYPCIRPIHVKATDFVFSGLGTPGNTTNIINAAVTPAFAAQFPGLNGLGLSTARLDLAPKGVIPMHTHPGASEVLFVLTGSITAGFVSSANAVYVQTLKPGQVMVFPQGLLHFQINAGKSSASAVVTFNSANPGLQILDFALFANSLPTELVVGTTFLDATTVKKLKGVLGGTG

SEQ ID NO: 14676 - protein, 419 aa, Glycine max
  misc_feature: Useful for making plants with modulated cold sensitivity
MARAVLKENDTVFANRDVPAAGRAASYGGSDIVWTPYGPEWRMLRKVCVAKMLSHATLDTVYDLRREEVRKTVSYLHDRVGSAVNIGEQVFLTVINVITNMLWGGVVEGAERESMGAEFRELVAEMTQLLGKPNVSDFFPGLARFDLQGVEKQMNALVPRFDGIFERMIGERKKVELEGAERMDFLQFLLKLKEEGGDAKTPLTITHVKALLMDMVVGGTDTSSNTIEFAMAEMMHNPEIMKRVQEELEVVVGKDNTVEESHIHKLSYLQAVMKETLRLHPVLPLLVPHCPSETTIVGGYTIPKGSRVFVNVWAIHRDPSIWKKSLEFDPTRFLDAKLDFSGNDFNYFPFGSGRRICAGIAMAEKTVLHFLATLVHLFDWTVPQGEKLEVSEKFGIVLKKKIPLVAIPTPRLSNPDLYQ

SEQ ID NO: 14677 - protein, 532 aa, Arabidopsis thaliana
  misc_feature: Useful for making plants with modulated biomass
  misc_feature: Useful for making plants with modulated flowering time
MEEVVVVVADPPPKITTVVEYEEELEDDDDDLSLSSDSDIAEALDWLDGKDDDELIGGGFSLHARRPNAHGGHGSRPNSSALQPISNKAQKLTSHVRASPLEGWEGRVKVGMSNSVTTAIRGSLRDTEIGRSRNTDKADRATVEQALDPRTRMVLFRMLNRGVFNDVNGCISTGKEANVYHATKSDGSELAIKVYKTSVLVFKDRDRYVQGDYRFRYGYCRHNPRKMVKTWAEKEQRNLKRLHAAGIRCPAVILLRLHVLVMEFIGRDGWAAPRLKDAALSLDKLRECYLELIIQMRVLYQKCKLVHGDLSEYNILYFEGHLYIIDVSQSVDLDHPLALNFLREDCDHVSDFFKKHGVAVMTIRELFDFIVDPTISDENVDSYLEEVQRKVIERGEISVEDEIADSVFMKSYIPKSLDAVNNPEADVAKITSGQDTGDMLYQTITGLKDALPKVDEQQIEVNAEEEEEEEEEGSGEESEEESEEELGPEDKKAARKEHKKKVKEEKRESRKTKTPKSVKKRKKKVSKPHKTR

SEQ ID NO: 14678 - protein, 486 aa, Panicum virgatum
  misc_feature: Useful for making plants with altered carbohydrate content
MPPSGITAVDAAAKGMKLERYASGGALLLRRATSAKLVSASSHLLFRATVLATLALVFLFTLHYPSLLSRSFHLSAGGDAAHPSSASHRSLLMSSSSSAAASYGGAAWEKEMRRSARPSRDGGISVLVTGAAGFVGTHCSLALKARGDGVVGLDNFNSYYDPSLKRARQALLASRGVVVLDADINDGLLLEKLFDVAAFTHVLHLAAQAGVRYAMEAPQTYVASNVAGLVSVFEVAAKHADPQPAIVWASSSSVYGLNTDAPFSEDHRTDRPASLYAATKKAGEAIAHTYNHIYGLSITGLRFFTVYGPWGRPDMAYFFFARSIVAGEPITLFRAADGSDARRDFTYIDDVVKGCLGALDTAGKSTGSKSGKKSGPAPLRVYNLGNTSPVPVTRMVAILEKLLGKKSNKRIVTMPSNGDVPFTHANVSHAAHDFGYRPTTSLEAGLRHFVDWFVEYYKLDTKIVKGARSSAAAKPAKKKKAAAASS

SEQ ID NO: 14679 - protein, 476 aa, Arabidopsis thaliana
  misc_feature: Useful for making plants with altered cell wall content and/or composition
MTPFALFLFTLLALSSSCCSAIGPQNNRTVLALASRIGINYGKLGNNLPFPYQSINLIKTIKAGHVKLYDADPETLKLLSTTNLYVTIMVPNNQIISIGADQAAADNWVATNVLPFHPQTRIRFVLVGNEVLSYSSDQDKQIWANLVPAMRKVVNSLRARGIHNIKVGTPLAMDALRSSFPPSSGTFREDIAVPVMLPLLKFLNGTNSFFFLDVYPYFPWSTDPVNNHLDFALFESNSTYTDPQTGLVYTNLLDQMLDSVIFAMTKLGYPNISLAISETGWPNDGDIHETGANIVNAATYNRNLIKKMTANPPLGTPARRGAPIPTFLFSLFNENQKPGSGTERHWGILNPDGTPIYDIDFSGRRSFSGFDSLPKPSNNVPFKGNVWCVAVDGADEAELGQALNFACGRSNATCAALAPGGECYAPVTVTWHASYAFSSYWAQFRNQSSQCYFNGLARETTTNPGNERCKFPSVTL

SEQ ID NO: 14680 - protein, 401 aa, Arabidopsis thaliana [sequence omitted]

SEQ ID NO: 14681 - protein, 232 aa, Arabidopsis thaliana
  misc_feature: Useful for making plants with altered cell wall content and/or composition
MAKDEAKGLLKSEELYKYILETSVYPREPEVLRELRNITHNHPQAGMATAPDAGQLMGMLLNLVNARKTIEVGVFTGYSLLLTALTLPEDGKVIAIDMNRDSYEIGLPVIKKAGVEHKIDFKESEALPALDELLNNKVNEGGFDFAFVDADKLNYWNYHERLIRLIKVGGIIVYDNTLWGGSVAEPDSSTPEWRIEVKKATLELNKKLSADQRVQISQAALGDGITICRRLY

SEQ ID NO: 14682 - protein, 482 aa, Panicum virgatum
  misc_feature: Useful for making plants with altered carbohydrate content
METPAPPPPPQQMHFLFVTSPLQGHINPVRRLAARVMAANPDARVTFSTAVSGHRRMFPSLARPDDEAVDAAGVLHVPFSDGFDDGFSSAAPGAGAAYRARAAAAGRATLSAAVSRLAARGTPVTRVVYTFLVPWAPDVARAHGVPAALFWIQPAAVLAVYYHYFHGHATALAACANGAGAAATSLPGLPPLEAGALPSAVAITSPEHKHYLLLDLLRDLFLSLDEHKPMVLVNTFDALESDALRAVPQFEVAAVGPVVPDDASSSPSSALDLLHPQDAKVPYMEWLDAKPARSVVYVSFGSVLSMSRRQEEEMRRGLEATSRPYLWVARTAADGGASSDGDPDPDSGSARGLVVAWCDQVRVLAHPAVGCFVTHCGWNSALESVTRGVPMVAAPQWTDQPTVAWMVEARAGAGVRAGADGEGVVERGELRRCVEEVMGGGGEAIRARCDRWRELAREAVAPGGTSERNLRAFASGAAVDGA

SEQ ID NO: 14683 - protein, 392 aa, Arabidopsis thaliana
  misc_feature: Useful for making plants with altered cell wall content and/or composition
MSIVCTFFLFLLNTSFAFAFAIPKPPIVRRLSTTVTSNSTASSCSANGNPIDECWRCDENWKDNRKNLADCAVGFGRDSIGGRAGEFYTVTDSGDDNPLNPTPGTLRYAATQDQPLWIIFDRDMVIQLKQDLQVASYKTIDGRGNNVQIAYGPCLTLYKVSNIIINNLYIHDCVPVKRNALSSLGGYSDGDGISIFESRDIWIDHCTLEKCYDGLIDAVNGSTDITISNSYMLNHNEVMLLGHSDEYSGDRDMRVTIAFNYFGEGLVQRMPRCRHGYFHIVNNIYRDWKMYAIGGSANPTIFSQGNVFIASNNQFTKEVTKRESADGDEEWKEWNWKSEGDEMVNGAFFTPSGKEDSPSYAKFSSMVARPASLLKTTHPSVGVLSCEIDQAC

SEQ ID NO: 14684 - protein, 457 aa, Arabidopsis thaliana
  misc_feature: Useful for making plants with altered cell wall content and/or composition
MGQDGSPAHKRPSGSGGGLPTTTLTNGGGRGGRGGLLPRGRQMQKTFNNIKITILCGFVTILVLRGTIGVGNLGSSSADAVNQNIIEETNRILAEIRSDSDPTDLDEPQEGDMNPNATYVLGPKITDWDSQRKVWLNQNPEFPSTVNGKARILLLTGSPPKPCDNPIGDHYLLKSVKNKIDYCRLHGIEIVYNMAHLDKELAGYWAKLPMIRRLMLSHPEVEWIWWMDSDALFTDILFQIPLARYQKHNLVIHGYPDLLFDQKSWIALNTGSFLLRNCQWSLDLLDAWAPMGPKGPIRDEAGKVLTAYLKGRPAFEADDQSALIYLLLSQKDTWMEKVFVENQYYLHGFWEGLVDRYEEMIEKYHPGLGDERWPFVTHFVGCKPCGSYADYAVERCLKSMERAFNFADNQVLKLYGFSHRGLLSPKIKRIRNETVSPLEFVDKFDIRRTPVETKPQN

SEQ ID NO: 14685 - protein, 265 aa, Arabidopsis thaliana
  misc_feature: Useful for biocontainment applications
MATTNSLHHHHHSSPSYTHHRNNLHCQSHFGPTSLSLKQPTSAATFSLICSASSTSSSTTAVSAVSTTNASATTAETATIFDVLENHLVNQNFRQADEETRRLLIQISGEAAVKRGYVFFSEVKTISPEDLQAIDNLWIKHSDGRFGYSVQRKIWLKVKKDFTRFFVKVEWMKLLDTEVVQYNYRAFPDEFKWELNDETPLGHLPLTNALRGTQLLKCVLSHPAFATADDNSGETEDELNRGVAVAKEQAGVGADKRVFKTNYSF

SEQ ID NO: 14686 - protein, 442 aa, Arabidopsis thaliana
  misc_feature: Useful for making plants with modulated nitrogen use efficiency
MLKIKRVPTVVSNYQKDDGAEDPVGCGRNCLGACCLNGARLPLYACKNLVKSGEKLVISHEAIEPPVAFLESLVLGEWEDRFQRGLFRYDVTACETKVIPGKYGFVAQLNEGRHLKKRPTEFRVDKVLQSFDGSKFNFTKVGQEELLFQFEAGEDAQVQFFPCMPIDPENSPSVVAINVSPIEYGHVLLIPRVLDCLPQRIDHKSLLLAVHMAAEAANPYFRLGYNSLGAFATINHLHFQAYYLAMPFPLEKAPTKKITTTVSGVKISELLSYPVRSLLFEGGSSMQELSDTVSDCCVCLQNNNIPFNILISDCGRQIFLMPQCYAEKQALGEVSPEVLETQVNPAVWEISGHMVLKRKEDYEGASEDNAWRLLAEASLSEERFKEVTALAFEAIGCSNQEEDLEGTIVHQQNSSGNVNQKSNRTHGGPITNGTAAECLVLQ

SEQ ID NO: 14687 - protein, 507 aa, Arabidopsis thaliana
  misc_feature: Useful for making plants with altered cell wall content and/or composition
MRTKYFSLLVFIIVLASNEVIAKKHSSTPKLRRSDFPKDFIFGAATSAYQVEGAAHEDGRGPSIWDTFSEKYPEKIKDGTNGSIASDSYHLYKEDVGLLHQIGFGAYRFSISWSRILPRGNLKGGINQAGIDYYNNLINELLSKGIKPFATIFHWDTPQSLEDAYGGFFGAEIVNDFRDYADICFKNFGDRVKHWMTLNEPLTVVQQGYVAGVMAPGRCSKFTNPNCTAGNGATEPYIVGHNLILAHGEAVKVYREKYKASQKGQVGIALNAGWNLPYTESAEDRLAAARAMAFTFDYFMEPLVTGKYPVDMVNNVKDGRLPTFTAKQSKMLKGSYDFIGINYYSSSYAKDVPCSSENVTLFSDPCASVTGEREGVPIGPKAASDWLLIYPKGIRDLLLYAKYKFKDPVMYITENGRDEASTGKIDLKDSERIDYYAQHLKMVQDAISIGANVKGFFAWSLLDNFEWATGYSVRFGLVYVDFNDGRKRYPKKSAKWFRKLLSEKKRN

SEQ ID NO: 14688 - protein, 1181 aa, Arabidopsis thaliana
  misc_feature: Useful for making plants with altered cell wall content and/or composition
MVKSAASQSPSPVTITVTPCKGSGDRSLGLTSPIPRASVITNQNSPLSSRATRRTSISSGNRRSNGDEGRYCSMSVEDLTAETTNSECVLSYTVHIPPTPDHQTVFASQESEEDEMLKGNSNQKSFLSGTIFTGGFKSVTRGHVIDCSMDRADPEKKSGQICWLKGCDEKVVHGRCECGFRICRDCYFDCITSGGGNCPGCKEPYRDINDDPETEEEDEEDEAKPLPQMGESKLDKRLSVVKSFKAQNQAGDFDHTRWLFETKGTYGYGNAVWPKDGYGIGSGGGGNGYETPPEFGERSKRPLTRKVSVSAAIISPYRLLIALRLVALGLFLTWRVRHPNREAMWLWGMSTTCELWFALSWLLDQLPKLCPVNRLTDLGVLKERFESPNLRNPKGRSDLPGIDVFVSTADPEKEPPLVTANTILSILAVDYPVEKLACYLSDDGGALLTFEALAQTASFASTWVPFCRKHNIEPRNPEAYFGQKRNFLKNKVRLDFVRERRRVKREYDEFKVRINSLPEAIRRRSDAYNVHEELRAKKKQMEMMMGNNPQETVIVPKATWMSDGSHWPGTWSSGETDNSRGDHAGIIQAMLAPPNAEPVYGAEADAENLIDTTDVDIRLPMLVYVSREKRPGYDHNKKAGAMNALVRTSAIMSNGPFILNLDCDHYIYNSMALREGMCFMLDRGGDRICYVQFPQRFEGIDPNDRYANHNTVFFDVSMRALDGLQGPMYVGTGCIFRRTALYGFSPPRATEHHGWLGRRKVKISLRRPKAMMKKDDEVSLPINGEYNEEENDDGDIESLLLPKRFGNSNSFVASIPVAEYQGRLIQDLQGKGKNSRPAGSLAVPREPLDAATVAEAISVISCFYEDKTEWGKRVGWIYGSVTEDVVTGYRMHNRGWRSIYCVTKRDAFRGTAPINLTDRLHQVLRWATGSVEIFFSRNNAIFATRRMKFLQRVAYFNVGMYPFTSLFLIVYCILPAISLFSGQFIVQSLDITFLIYLLSITLTLCMLSLLEIKWSGITLHEWWRNEQFWVIGGTSAHPAAVLQGLLKVIAGVDISFTLTSKSSAPEDGDDEFADLYVVKWSFLMVPPLTIMMVNMIAIAVGLARTLYSPFPQWSKLVGGVFFSFWVLCHLYPFAKGLMGRRGRVPTIVFVWSGLLSIIVSLLWVYINPPSGKQDYMQFQFP

SEQ ID NO: 14689 - protein, 195 aa, Arabidopsis thaliana
  misc_feature: Useful for making plants with modulated nitrogen use efficiency
MSSSSPSGSGSDLTERRGIPAAKFIQDVETYLSQSGLDPNSALAFHQERLQQYKVVEMKLLAQQRDLQAKIPDIEKCLEVVATLEAKKGTGEALLADFEVSEGIYSRACIEDTDSVCLWLGANVMLEYSCEEASALLKNNLENAKASLEVLVADLQFLRDQVTVTQVTIARVYNWDVHQRRVKQVTPTAIAVADS

SEQ ID NO: 14690 - protein, 720 aa, Arabidopsis thaliana
  misc_feature: Useful for making plants with altered cell wall content and/or composition
MAMEKSSSKYRTQFWYVAMASFLLWLVLLYLFSSSAKTVHNHERLFRQENIIDLPVENVPQNHEPDEAPVVNVVSEDISVDNSSLPVSVDSPPDDQMSEDKKVVTDLVEELEKERVENEKKRVDSVVIGRSSKARRGHREPRKARSSGRLEAEKKRVRRNDADESNAENSDENHQALDKEPNFFEAKKDVEPKKALVDDNDDDLETKRGKELPNDSSSNVVEDDNDDDLETKKGKDNISKSEPKTQRNFVLNKNNTSKAKNRVISKRNQPSRVGKVMLRPRETRSNDPCKGKYVYMHEVPALFNEELLKNCWTLSRWTDMCELTSNFGLGPRLPNMEGVSGWYATNQFTLEVIFHNRMKQYKCLTKDSSLASAVYVPYYPGLDLMRFLWGPFPFMRDAAALDLMKWLRESQEWKRMDGRDHFMVAGRTTWDFMRTPENESDWGNRLMILPEVRNMTMLLIESSPWNYHGFAVPYPTYFHPSTYAEIIQWQMRMRRINRRYLFSFVGAPRPNLGDSIRTEIMDQCKASKRKCKLLECISGSQKCYKPDQIMKFFLSSTFCLQPPGDSYTRRSTFDSILAGCIPVFFHPGSAYAQYIWHLPKDIAKYSVFIPEKNVKEGKVSIENVLSRIPRTKVFAMREQVIRLIPRLMYFHPSSKSEDTGRFEDAFDVAVEGVLERVEGLRKRIEEGKEEIFDFPEQYSWKYNVFGNVERHEWDPYFDRP

SEQ ID NO: 14691 - protein, 1584 aa, Arabidopsis thaliana
  misc_feature: Useful for making plants with modulated drought sensitivity
MASFIDLFAGDITTQLLKLLALVANTVYSCKGIAERLITMIRDVQPTIREIQYSGAELSNHHQTQLGVFYEILEKARKLCEKVLRCNRWNLKHVYHANKMKDLEKQISRFLNSQILLFVLAEVCHLRVNGDRIERNMDRLLTERNDSLSFPETMMEIETVSDPEIQTVLELGKKKVKEMMFKFTDTHLFGISGMSGSGKTTLAIELSKDDDVRGLFKNKVLFLTVSRSPNFENLESCIREFLYDGVHQRKLVILDDVWTRESLDRLMSKIRGSTTLVVSRSKLADPRTTYNVELLKKDEAMSLLCLCAFEQKSPPSPFNKYLVKQVVDECKGLPLSLKVLGASLKNKPERYWEGVVKRLLRGEAADETHESRVFAHMEESLENLDPKIRDCFLDMGAFPEDKKIPLDLLTSVWVERHDIDEETAFSFVLRLADKNLLTIVNNPRFGDVHIGYYDVFVTQHDVLRDLALHMSNRVDVNRRERLLMPKTEPVLPREWEKNKDEPFDAKIVSLHTGKTSLTLNEFGEMDEMNWFDMDLPKAEVLILNFSSDNYVLPPFIGKMSRLRVLVIINNGMSPARLHGFSIFANLAKLRSLWLKRVHVPELTSCTIPLKNLHKIHLIFCKVKNSFVQTSFDISKIFPSLSDLTIDHCDDLLELKSIFGITSLNSLSITNCPRILELPKNLSNVQSLERLRLYACPELISLPVEVCELPCLKYVDISQCVSLVSLPEKFGKLGSLEKIDMRECSLLGLPSSVAALVSLRHVICDEETSSMWEMVKKVVPELCIEVAKKCFTVDWLDDMASFIDLFAGDITTQLLKLLALVANTVYSCKGIAERLITMIRDVQPTIREIQYSGAELSNHHQTQLGVFYEILEKARKLCEKVLRCNRWNLKHVYHANKMKDLEKQISRFLNSQILLFVLAEVCHLRVNGDRIERNMDRLLTERNDSLSFPETMMEIETVSDPEIQTVLELGKKKVKEMMFKFTDTHLFGISGMSGSGKTTLAIELSKDDDVRGLFKNKVLFLTVSRSPNFENLESCIREFLYDGVHQRKLVILDDVWTRESLDRLMSKIRGSTTLVVSRSKLADPRTTYNVELLKKDEAMSLLCLCAFEQKSPPSPFNKYLVKQVVDECKGLPLSLKVLGASLKNKPERYWEGVVKRLLRGEAADETHESRVFAHMEESLENLDPKIRDCFLDMGAFPEDKKIPLDLLTSVWVERHDIDEETAFSFVLRLADKNLLTIVNNPRFGDVHIGYYDVFVTQHDVLRDLALHMSNRVDVNRRERLLMPKTEPVLPREWEKNKDEPFDAKIVSLHTGEMDEMNWFDMDLPKAEVLILNFSSDNYVLPPFIGKMSRLRVLVIINNGMSPARLHGFSIFANLAKLRSLWLKRVHVPELTSCTIPLKNLHKIHLIFCKVKNSFVQTSFDISKIFPSLSDLTIDHCDDLLELKSIFGITSLNSLSITNCPRILELPKNLSNVQSLERLRLYACPELISLPVEVCELPCLKYVDISQCVSLVSLPEKFGKLGSLEKIDMRECSLLGLPSSVAALVSLRHVICDEETSSMWEMVKKVVPELCIEVAKKCFTVDWLDD

SEQ ID NO: 14692 - protein, 787 aa, Arabidopsis thaliana
  misc_feature: Useful for making plants with modulated water use efficiency
MASFIDLFAGDITTQLLKLLALVANTVYSCKGIAERLITMIRDVQPTIREIQYSGAELSNHHQTQLGVFYEILEKARKLCEKVLRCNRWNLKHVYHANKMKDLEKQISRFLNSQILLFVLAEVCHLRVNGDRIERNMDRLLTERNDSLSFPETMMEIETVSDPEIQTVLELGKKKVKEMMFKFTDTHLFGISGMSGSGKTTLAIELSKDDDVRGLFKNKVLFLTVSRSPNFENLESCIREFLYDGVHQRKLVILDDVWTRESLDRLMSKIRGSTTLVVSRSKLADPRTTYNVELLKKDEAMSLLCLCAFEQKSPPSPFNKYLVKQVVDECKGLPLSLKVLGASLKNKPERYWEGVVKRLLRGEAADETHESRVFAHMEESLENLDPKIRDCFLDMGAFPEDKKIPLDLLTSVWVERHDIDEETAFSFVLRLADKNLLTIVNNPRFGDVHIGYYDVFVTQHDVLRDLALHMSNRVDVNRRERLLMPKTEPVLPREWEKNKDEPFDAKIVSLHTGEMDEMNWFDMDLPKAEVLILNFSSDNYVLPPFIGKMSRLRVLVIINNGMSPARLHGFSIFANLAKLRSLWLKRVHVPELTSCTIPLKNLHKIHLIFCKVKNSFVQTSFDISKIFPSLSDLTIDHCDDLLELKSIFGITSLNSLSITNCPRILELPKNLSNVQSLERLRLYACPELISLPVEVCELPCLKYVDISQCVSLVSLPEKFGKLGSLEKIDMRECSLLGLPSSVAALVSLRHVICDEETSSMWEMVKKVVPELCIEVAKKCFTVDWLDD

SEQ ID NO: 14693 - protein, 577 aa, Arabidopsis thaliana
  misc_feature: Useful for making plants with modulated flowering time
MAEAEDQQNFVAHNGDQVPDQGSDELHNGLPYQVHDETLVHQPYEVEDPILEPQQYEVPDPTLEPQQYEVPDQTLEPQQYEVDDQLEYHQYQLQDQANEDVQDHSQDDLQYQPQNQEQFQLQDEAHDQAQYQAQGDVQDHNGDEVQDKVEDEEGIPEHLESLQKSEPEEDATVGGEEKRWPGWPGETVFRMLVPAQKVGSIIGRKGDVIKKIVEETRARIKILDGPPGTTERAVMVSGKEEPESSLPPSMDGLLRVHMRIVDGLDGEASQAPPPSKVSTRLLVPASQAGSLIGKQGGTVKAIQEASACIVRVLGSEDLPVFALQDDRVVEVVGEPTSVHRALELIASHLRKFLVDRSIIPFFENQMQKPTRQMDHMPPPHQSWGPPQGHAPSVGGGGYGHNPPPYMQPPPRHDSYYPPPEMRQPPMEKQPHQGISAYGREPPMNVHVSSAPPMVAQQVTQQMQIPLSYADAVIGTSGSNISYTRRLSGATVTIQETRGVPGEMTVEVSGTGSQVQTAVQLIQNFMAEAGAPAPAQPQTVAPEQQGYNPYATHGSVYAAAPTNPPGGYATDYSSGYGY

SEQ ID NO: 14694 - protein, 338 aa, Arabidopsis thaliana
  misc_feature: Useful for making plants with altered tocopherol content
MASLMLNGAITFPKGLGSPGSNLHARSIPRPTLLSVTRTSTPRLSVATRCSSSSVSSSRPSAQPRFIQHKKEAYWFYRFLSIVYDHVINPGHWTEDMRDDALEPADLSHPDMRVVDVGGGTGFTTLGIVKTVKAKNVTILDQSPHQLAKAKQKEPLKECKIVEGDAEDLPFPTDYADRYVSAGSIEYWPDPQRGIREAYRVLKIGGKACLIGPVYPTFWLSRFFSDVWMLFPKEEEYIEWFKNAGFKDVQLKRIGPKWYRGVRRHGLIMGYSVTGVKPASGDSPLQLGPKEEDVEKPVNNPFSFLGRFLLGTLAAAWFVLIPIYMWIKDQIVPKDQPI

SEQ ID NO: 14695 - protein, 185 aa, Arabidopsis thaliana
  misc_feature: Useful for making plants with modulated nitrogen use efficiency
MRTSNHLIGLVNFLTFLLSIPILGGGIWLSSRANSTDCLRFLQWPLIVIGISIMVVSLAGFAGACYRNKFLMWLYLVVMLLIIAALIGFIIFAYAVTDKGSGRTVLNRGYLDYYLEDYSGWLKDRVSDDSYWGKISSCLRDSGACRKIEEILMVYLKLLICSSLEDLALLSPVVASHQQIAVFHM

SEQ ID NO: 14696 - protein, 150 aa, Glycine max
  misc_feature: Useful for biocontainment applications
MASPIQQQQRSTTTSSGSEGGDPHIIDERKRKRMLSNRESARRSRMRKQKQLEDLTDEVSRLQSANKKLAENIEAKEEACVETEAANSILRAQTMELADRLRFLNSILEIAEEVEGLSVEIPEIPDPLLKPWQIPHPIQPIMATANMFLR

SEQ ID NO: 14697 - protein, 254 aa, Zea mays
  misc_feature: Useful for making plants with modulated nitrogen use efficiency
MSGEAAAVGGGEGEANGIPPNVTIYINNLNEKIKLEELKKSLTAVFSQFGKILDVLAFKTLKHKGQAWVVFEDVASATEALKRMQGFPFYDKTMRIQYAKTKSDIIAKADGTFVPRERRKRTDEKSEKKQKREHHHDAGASQIGMGVTAYPGVYGAPQLTQIPIAGGQRVMMPEIIVPNNILFVQNLPHETTPMMLQMLFCQYPGFKEVRMIEAKPGIAFVEYGDETQVTAAMNNLQSFKITKENQMVITYAKK

SEQ ID NO: 14698 - protein, 464 aa, Panicum virgatum
  misc_feature: Useful for making plants with altered carbohydrate content
MTTTKHHFLIVTYPAQGHITPARHLARRFASACPGARVTICAPVSAFRRMFPGAAAVAGEERGGDGDDAVAYVAYSDGYDGGFDSAADSYARYMERARAAGERSLAAVLRRLRAGGRPVTCAVYTLLLPWVAGVAREHSVAATAVFWIQPATALAAYYHYFRGHRDAVVAAAASGDPGAEVRLPGLPPLRVRDLPSFLAITDEDNPFAFVLPEFRELMDALERGENDSSRPPTTYVLANTFDALEHDALASLRPHVDVFAVGPVLSFLHEADDAKRTLSPPRDVFDHDRNGYLSWLDSKPAKSVVYISFGSSSVMSRNQVAEISDAMARIKRPFLWVLRKDNCKDSEDDDAAIKSLTAAAAGDAVAGTVVEWCDQARVLSHPSVACFVTHGGWNSTLEGVACGVPLVVAPQYSDQGTSAWLAAERAGAGVRAAAREADGVVEAAELARCVGAATSGAVASRAAA

SEQ ID NO: 14699 - protein, 425 aa, Panicum virgatum
  misc_feature: Useful for making plants with altered carbohydrate content
MSFVVTKSSPPALVLPSKPTPAGDIPLTSTDKSRLFFSFTSFHVFERPIHEPAQTIRRALSQALVYYYPVAGRVAVGTGGQGGVHLACTGEGVAFVSATASCTLQDVACLDAPPVIPLAELALQYGGCCRISDPLLLMQVTEFACGGYIVAVSWNHGIADAFGLAQLLQAVGELARGLPSPTVVPIRYDESLPDIPQLLSAVLKQAPAGFEFKHNDFAYSDVTVPWSFINRVKGEFRRSHAGGQPCTTFEVVTAAIWQCRTRAINTSPDVPVPLVFAANVRKHIGSKDGYYGNCVSTQLVQATSGTVANGAIVDVVRLIKDTKERITESLRRNAPELELHAELIDAMFGYNMLNVSSWGGIGLDAVDFGGGRPARVVPNMERTLAPSCFPCLPCSRNDHGGANLVAFCVAEEHVQEFNAELARLR

SEQ ID NO: 14700 - protein, 298 aa, Arabidopsis thaliana
  misc_feature: Useful for making plants with modulated biomass
MAEEKKAPISVWTTVKPFVNGGASGMLATCVIQPIDMIKVRIQLGQGSAASITTNMLKNEGVGAFYKGLSAGLLRQATYTTARLGSFKLLTAKAIESNDGKPLPLYQKALCGLTAGAIGACVGSPADLALIRMQADNTLPLAQRRNYTNAFHALTRISADEGVLALWKGCGPTVVRAMALNMGMLASYDQSAEYMRDNLGFGEMSTVVGASAVSGFCAAACSLPFDFVKTQIQKMQPDAQGKYPYTGSLDCAMKTLKEGGPLKFYSGFPVYCVRIAPHVMMTWIFLNQITKFQKKIGM

SEQ ID NO: 14701 - protein, 850 aa, Arabidopsis thaliana
  misc_feature: Useful for making plants with altered cell wall content and/or composition
MAMISFSFPSPAKLPIKSQPSVSNRINVADRLILRHLNAGDLRGAVSALDLMARDGIRPMDSVTFSSLLKSCIRARDFRLGKLVHARLIEFDIEPDSVLYNSLISLYSKSGDSAKAEDVFETMRRFGKRDVVSWSAMMACYGNNGRELDAIKVFVEFLELGLVPNDYCYTAVIRACSNSDFVGVGRVTLGFLMKTGHFESDVCVGCSLIDMFVKGENSFENAYKVFDKMSELNVVTWTLMITRCMQMGFPREAIRFFLDMVLSGFESDKFTLSSVFSACAELENLSLGKQLHSWAIRSGLVDDVECSLVDMYAKCSADGSVDDCRKVFDRMEDHSVMSWTALITGYMKNCNLATEAINLFSEMITQGHVEPNHFTFSSAFKACGNLSDPRVGKQVLGQAFKRGLASNSSVANSVISMFVKSDRMEDAQRAFESLSEKNLVSYNTFLDGTCRNLNFEQAFKLLSEITERELGVSAFTFASLLSGVANVGSIRKGEQIHSQVVKLGLSCNQPVCNALISMYSKCGSIDTASRVFNFMENRNVISWTSMITGFAKHGFAIRVLETFNQMIEEGVKPNEVTYVAILSACSHVGLVSEGWRHFNSMYEDHKIKPKMEHYACMVDLLCRAGLLTDAFEFINTMPFQADVLVWRTFLGACRVHSNTELGKLAARKILELDPNEPAAYIQLSNIYACAGKWEESTEMRRKMKERNLVKEGGCSWIEVGDKIHKFYVGDTAHPNAHQIYDELDRLITEIKRCGYVPDTDLVLHKLEEENDEAEKERLLYQHSEKIAVAFGLISTSKSRPVRVFKNLRVCGDCHNAMKYISTVSGREIVLRDLNRFHHFKDGKCSCNDYW

SEQ ID NO: 14702 - protein, 620 aa, Arabidopsis thaliana
  misc_feature: Useful for making plants with altered cell wall content and/or composition
MEKFAPVAALLLLLLCFPVAFSGHDYGQALSKSLLFFEAQRSGVLPRNQRVTWRSHSGLTDGKSSGVNLVGGYYDAGDNVKFGLPMAFTVTMMAWSVIEYGNQLQANGELGNSIDAIKWGTDYFIKAHPEPNVLYGEVGDGNTDHYCWQRPEEMTTDRKAYRIDPSNPGSDLAGETAAAMAAASIVFRRSNPVYSRLLLTHAYQLFDFADKYRGKYDSSITVAQKYYRSVSGYNDELLWAAAWLYQASNNQFYLDYLGRNGDAMGGTGWSMTEFGWDVKYAGVQTLVAKFLMQGKAGRHAPVFRKYQEKADSFMCSLLGKSSRNIQKTPGGLIFRQRWNNMQFVTSASFLTTVYSDYLTSSRSNLRCAAGNVAPSQLLSFAKSQVDYILGDNPRATSYMVGYGNNFPQRVHHRGSSIVSVKVDRTFVTCRGGYATWFSRKGSDPNLLTGAIVGGPDAYDNFADRRDNYEQTEPATYNNAPLLGVLARLSSGHSGYSQFLPVVPAPVVRRPMPIRRPKVTTPVRASGPVAIVQKITSSWVSKGRTYYRYSTTVINKSSRPLKSLNLSIKNLYGPIWGLSRSGNSFGLPSWMHSLPSGKSLEFVYIHSTTPANVAVSSYTLA

SEQ ID NO: 14703 - protein, 477 aa, Arabidopsis thaliana
  misc_feature: Useful for making plants with altered cell wall content and/or composition
MEKTFALITIFLAFAFSGKCSDVFSRCDFPEGFVFGSSTSAYQWEGAVAEDGRKPSVWDRFCHSHNNQGNGDITCDGYHKYKEDVKLMVDTNLDAFRFSISWSRLIPNRRGPVNQKGLQFYKNLIQELVNHGIEPYVTLHHFDHPQYLEDEYEGWLNHMIVEDFTAYADVCFREFGNHVKFWTTINEGNIFSIGGYNDGDSPPGRCSIPGQNCLLGNSSTEPYIVGHNLLLAHASVSRLYKQNYKDKQGGSIGFSILTIGFSPSTSSKDDAIATQRANDFFNGWMLGPLIYGDYPDTMKRIVGSRMPVFSEEESEQVKGSSDYIGINHYLAASITNSKLKPSISGNPDFYSDMNQSYGNPPVYVLENGRPINRDSQLKEKDTPRIEFLQAYIGGVLKSIRNGSDTRGYFVWSLMDLYEIKGGYDVGYGLYSVNFSDPHRKRSPKLSAHWYSDFLKGKTAFLGSQGITELQSNLSPYS

SEQ ID NO: 14704 - protein, 507 aa, Arabidopsis thaliana
  misc_feature: Useful for making plants with altered cell wall content and/or composition
MELTLSLLTIFLLFFALSGRCSDKNDFPEGFIFGSATSAYQWEGAFDEDGRKPSVWDTFLHTRNLSNGDITSDGYHKYKEDVKLMVETGLDAFRFSISWSRLIPNGRGPVNPKGLQFYKNFIQELVSHGIEPHVTLFHYDHPQYLEDEYGGWINRRIIQDFTAYANVCFREFGHHVKFWTTINEANIFTIGGYNDGITPPGRCSSPGRNCSSGNSSTEPYIVGHNLLLAHASASRLYKQKYKDMQGGSVGFSLFSLGFTPSTSSKDDDIAVQRAKDFYFGWMLEPFIFGDYPDEMKRTVGSRLPVFSKEESEQVKGSSDFIGIIHYLAASVTSIKIKPSISGNPDFYSDMGVSMTWTVLGNFSAFEYAVAPWAMESVLEYIKQSYGNPPIYILENGTPMKQDLQLQQKDTPRIEYLHAYIAAVLKSIRNGSDTRGYFIWSFMDLYELVKGYEFSFGLYSVNFSDPHRTRSPKLSAHWYSAFLKGNTTFLGSQGIMQMQSNFSSSASS

SEQ ID NO: 14705 - protein, 508 aa, Arabidopsis thaliana
  misc_feature: Useful for making plants with altered cell wall content and/or composition
MKLYSLLSVFLVILLATSDSDAFTRNNFPKDFLFGAATSAYQWEGAVAEDGRTPSVWDTFSHTYNRGNLGNGDITSDGYHKYKEDVKLMAEMGLESFRFSISWSRLIPNGRGLINPKGLLFYKNLIKELISHGIEPHVTLYHYDLPQSLEDEYGGWINRKIIEDFTAYADVCFREFGEDVKLWTTINEATIFAIGSYDQGISPPGHCSPNKFINCTSGNSSTEPYLAGHNILLAHASASKLYKLKYKSTQKGSIGLSIFAFGLSPYTNSKDDEIATQRAKAFFYGWMLKPLVFGDYPDEMKRTVGSRLPVFSEEESEQLKGSSDFIGIIHYTTFYVTNKPSPSIFPSMNEGFFKDMGVYMISAANSSFLLWEATPWGLEGILEYIKQSYNNPPIYILENGMPMGRDSTLQDTQRIEFIQAYIGAMLNAIKNGSDTRGYFVWSMIDLYELLSGYTTSFGMYYVNFSDPGRKRTPKLSASWYTGFLNGTIDVATQDTIQLQSNISGSSSL

SEQ ID NO: 14706 - protein, 285 aa, Arabidopsis thaliana
  misc_feature: Useful for biocontainment applications
METLLSPRALSPPLNPKPLSLHQTKPTSHSLSLSKPTTFSGPKHLSTRFTKPESRNWLIDAKQGLAALALSLTLTFSPVGTALASEFNILNDGPPKETYVVDDAGVLSRVTKSDLKKLLSDLEYRKKLRLNFITVRKLTSKADAFEYADQVLEKWYPSIEEGNNKGIVVLITSQKEGAITGGPAFIEAVGENILDATVSENLPVLATDEKYNEAVYSSAKRLVAAIDGQPDPGGPTVKDSKRESNFKTKEETDEKRGQFSLVVGGLLVIAFVVPMAQYFAYVSRK

SEQ ID NO: 14707 - protein, 569 aa, Arabidopsis thaliana
  misc_feature: Useful for making plants with altered cell wall content and/or composition
MSMHFRNKAWIILAILCFSSLIHSTEAVVTYDHKALIINGQRRILISGSIHYPRSTPEMWPDLIKKAKEGGLDVIQTYVFWNGHEPSPGNYYFQDRYDLVKFTKLVHQAGLYLDLRIGPYVCAEWNFGGFPVWLKYVPGMVFRTDNEPFKIAMQKFTKKIVDMMKEEKLFETQGGPIILSQIENEYGPMQWEMGAAGKAYSKWTAEMALGLSTGVPWIMSKQEDAPYPIIDTCNGFYCEGFKPNSDNKPKLWTENWTGWFTEFGGAIPNRPVEDIAFSVARFIQNGGSFMNYYMYYGGTNFDRTAGVFIATSYDYDAPIDEYGLLREPKYSHLKELHKVIKLCEPALVSVDPTITSLGDKQEIHVFKSKTSCAAFLSNYDTSSAARVMFRGFPYDLPPWSVSILPDCKTEYYNTAKIRAPTILMKMIPTSTKFSWESYNEGSPSSNEAGTFVKDGLVEQISMTRDKTDYFWYFTDITIGSDESFLKTGDNPLLTIFSAGHALHVFVNGLLAGTSYGALSNSKLTFSQNIKLSVGINKLALLSTAVGLPNAGVHYETWNTGILGPVTLKG

SEQ ID NO: 14708 - protein, 478 aa, Arabidopsis thaliana
  misc_feature: Useful for making plants with modulated biomass
MNRLFSLFSIALIAFLCLHHHVLASSSSDFEGFDAEDDDVSEDSTELHHSLRPPLLTQSESTVLDLDPSPDSDSTPASKSDPPTQTVKPSSSISFDYWDEDEFEGLPEDEKSTESPVFSDDASSPADPQTPDLESASETPDTDIPKKMQSYTVEIVCVSILIGYAINYFTGKRENENLALAWASKFGLKDTIFEKNFSLLGVGEGEDSPLLLKEATNVFKFYASGRRYCHGLLATLELKSRHDLISRLFNSVVPCKDEISFEVYMNDEAMDHIVFAMARKKAAKTMHKELGDLQRFGGMVPSPGGRKWVTEELAVVSESKEVAGDMITDVVLDQVFGDKSFEKFGKYFISMHFSDQHPGKHRKMLLFKFALPDIKHMDDMVRLIALIPYYIDLIGRYKLSSQARNKTDGARQKAAQEAYKELENVRQEALQRKKAEKKKILEEAQAKLSSEALRKKEAKERARQMKKSMPKVKMSRGH

SEQ ID NO: 14709 - protein, 387 aa, Panicum virgatum
  misc_feature: Useful for making plants with altered carbohydrate content
MAPAGLHAVAVRVLLLSLLAVSAIDVVSAATAAPLKFGINYGQIANNLPHPAQVSGLLQSLNVNRVKLYDADPAVLTAFAGTGVEFIVGNEDLQNLTDARKARAWVAQHVQPFIPSTRITCITVGNEVLSGKDTVAMQNLLPAMQAMHQAVSDLGLAGQVNVSTAHSVNILASSYPPSSGVFREELAQYIQPILNFHAEVRSPFLINAYPFFAYKASPGSVSLPYVLFEPNPGVVDPNTNLTYDNMLYAQIDAVYAAMKAMGHTDLTVRISETGWPSKGDGDEVGATVANAAAYNGNLMKRIAMGQGTPLKPDVPIDVFVFALFNEDMKPGPASERNYGLFYPNDTPVYNLGFNGASFSPSPTFSSSSKPTTTFLMAVVVLLAGFFL

SEQ ID NO: 14710 - protein, 159 aa, Arabidopsis thaliana
  misc_feature: Useful for making plants with altered lignin content
  misc_feature: Useful for making plants with modulated biomass
MGKARTVGVGMDYSPTSKLALRWAAENLLEDGDTVILIHVQPQNADHTRKILFEETGSPLIPLEEFREVNLSKQYGLAYDPEVLDVLDTLSRAKKVKVVAKVYWGDPREKLCDAVENLKLDSIVLGSRGLGSLKRILLGSVSNHVVTNATCPVTVVKAN

SEQ ID NO: 14711 - protein, 201 aa, Arabidopsis thaliana
  misc_feature: Useful for making plants with altered alkaloid content
MGKARTVGVGMDYSPTSKLALRWAAENLLEDGDTVILIHVQPQNADHTRKILFEETGSPLIPLEEFREVNLSKQYGLAYDPEVLDVLDTLSRAKKVKVVAKVYWGDPREKLCDAVENLKLDSIVLGSRGLGSLKRPNHNGFMIIMFDHSLVGLVSLDHDQSGLINMAEMGSSKSICWIRRNQERDSRWSFSDLLLDDHPLD

SEQ ID NO: 14712 - protein, 418 aa, Panicum virgatum
  misc_feature: Useful for making plants with altered carbohydrate content
MRPVLAIAILATTAAAVLFLGSEAQEVKQDHHAERISGSAGDVLEDDPVGRLKVYVYDLPARYNTALLEKDPRCLTHMFATEVFVHRSLLSSAVRTLDPEEADWFFVPVYTTCDLTASGHPMPFDSPRMMRSAIRLVAERWPHWNRSEGADHFLVTPHDFGACFHFKEDKAVARGILPLLRRATLVQTFGQRRHACLKGGSITVPPYAPPARMEARRLPPGTPRSVFVYFRGLFYDAGNDPEGGHYARGARASVWENFRSNPLFDISTERPATYYEDMQRAVFCLCPLGWAPWSPRLVEAVVFGCIPVVIADDIVLPFADAIPWADIGVFVAEEDVPRLDTILTSIPAEVVLRKQRLLATPAMKRAVLFSQPSQPGDAFHQILNGLARKLPHGDGVFLRPGQTVLNWTAGPPGDLKPW

SEQ ID NO: 14713 - protein, 225 aa, Glycine max
  misc_feature: Useful for making plants with altered alkaloid content
  misc_feature (131)..(131): Xaa is any aa, unknown, or other
MNLDELLQNVWTAEASKSSVVVGVESENMSSSSSSLQRQASLTLARALSGKTVDDVWREIQQGQKKKYGEDVRSQEGEMTLGETTLEDFLVQAGLFAEASISPAVGLDAMDSLATQGFQQKTGLLSSSPSXGSLSDTRLGRKRDASDAYEKTLERRLRRKIKNRESAARSRARKQAYHNELVGKVSRLEEENVKLKKEKEFEERLLPDPLPERKYQLRRHNSAFF

SEQ ID NO: 14714 - protein, 372 aa, Panicum virgatum
  misc_feature: Useful for making plants with altered carbohydrate content
MRPGHEGLIRDCSPDVVVSDILFHWNASIADSVGVPCVTFHVIGAFPMLALFSLIGAGATDGVLTLPEYMGPDIQIPVTELPEEVRSRRRPEDVRAEGAKLSSAHNSCFGLVVNTFFDLEDRYCDMYVRHMKRTYFVGPVSLPPPSQLAAGDDGSGCIEWLDRKPARSVVYLCFGSLAHVSKPQLRELALGLEASGKPFLWVVRSEAWVPPEGWEERVGDRGMVVTRWAPQTAILAHPAVGAFVTHCGWNSVLETVVAGVPVLTWPMVFEQFITERFVTKVLKIGERLWPEGAGVRSTRYEEHELIPSEAVAQAVGRFMEPGGVGDAARSRVKELSAKAHAAMEEGGSSHGDLRRLIDDLIQERTAGAGTTV

SEQ ID NO: 14715 - protein, 261 aa, Arabidopsis thaliana
  misc_feature: Useful for making plants with altered lignin content
MEDIHNLDIEKSDRSIWLMKCPVVVDKAWHKIAASSSSSFASSDSPPDMAKIVREVDPLRDDSPPEFKMYMVGAEYGNMPKCYALNMFTDFVPMGGFSDVNQGCAAAEGKVDHKFDMKPYGETIEEYARLCRERTSKAMVKNRQIQVIDNDRGVHMRPMPGMLGLVSSNSKEKRKPPPVKQTEVKRTRRDRGELEAIMFKLFEGQPNWTLKQLVQETDQPAQFLKEILNELCVYNKRGSNQGTYELKPEYKKSAEDDTGGQ

SEQ ID NO: 14716 - protein, 697 aa, Arabidopsis thaliana
  misc_feature: Useful for making plants with altered cell wall content and/or composition
MAMTSWPSTGRQRRHQLASMLLLVLVVVGIYVPVFALLPSLSYTPQSLPSAIPQDEKMISRKFYIKDDNFWKDGNRFQIIGGDLHYFRVLPEYWEDRLLRANALGLNTIQVYVPWNLHEPKPGKMVFEGIGDLVSFLKLCEKLDFLVMLRAGPYICGEWDLGGFPAWLLAVKPRLQLRTSDPVYLKLVERWWDVLLPKVFPLLYSNGGPVIMVQIENEYGSYGNDKAYLRKLVSMARGHLGDDIIVYTTDGGTKETLDKGTVPVADVYSAVDFSTGDDPWPIFKLQKKFNAPGRSPPLSSEFYTGWLTHWGEKITKTDAEFTAASLEKILSRNGSAVLYMVHGGTNFGFYNGANTGSEESDYKPDLTSYDYDAPIKESGDIDNPKFQALQRVIKKYNASPHPISPSNKQRKAYGSIKMQMTTSLFDLVRMTDPADVITSANPISMESVGQMFGFLLYESSYIAKKSGNTLRIPKVHDRAQVFVSCLSQDVDVGVLRYIGTTERWNNQPISLPTIECTTNTSLFILVENMGRVNYGPYIFDDKGILSSVYLDGQILHGWKMIPIPFHNLNQEPNLTFEMQHTKNRSKKFELTNDVGRKEPALFAGEFSINSEEEIKDTYLSFNGWGKGVAFVNEFNIGRYWPSVGPQCNLYVPAPLLKRGKNTLVVFELESPHLELSLEAVDHQDFTCGSNVSKVNQL

SEQ ID NO: 14717 - protein, 293 aa, Arabidopsis thaliana
  misc_feature: Useful for making plants with altered alkaloid content
  misc_feature: Useful for making plants with altered terpenoid content
MAATSEHTILQFVSPSSTASATTSVLTARIHPLVIFNVCDCFVRRPDSAERVIGTLLGSILPDGTVDIRNSYAVPHNESSDQVAVDIDYHHNMLASHLKVNSKETIVGWYSTGAGVNGGSSLIHDFYAREVPNPIHLTVDTGFTNGEGTIKAFVSSNLSLGDRQLVAHFQEIPVDLRMVDAERVGFDVLKATSVDKLPNDLEGMELTMERLLTLINDVYKYVDSVVGGQIAPDNNIGRFIADAVASLPKLPPQVFDNLVNDSLQDQLLLLYLSSITRTQLSLAEKLNTAAQML

SEQ ID NO: 14718 - protein, 207 aa, Pennisetum glaucum
  misc_feature: Useful for making plants with modulated water use efficiency
MATRRRMLLKVIILGDSGVGKTSLMNQYVNKKFSNQYKATIGADFLTKEVQIDDRLFTLQIWDTAGQERFQSLGVAFYRGADCCVLVYDVNVTKSFEKLNNWREEFLLQASPSDPENFPFVLLGNKIDVDGGNSRTISEKKAKAWCASKGNIPYFETSAKEGFNVEAAFECIARNAIKNEPEDDMYLPDTIDVGGAGRQQRSSGCEC

SEQ ID NO: 14719 - protein, 434 aa, Arabidopsis thaliana
  misc_feature: Useful for making plants with modulated drought sensitivity
MEEVSPAIAGPFRPFSETQMDFTGIRLGKGYCNNQYSNQDSENGDLMVSLPETSSCSVSGSHGSESRKVLISRINSPNLNMKESAAADIVVVDISAGDEINGSDITSEKKMISRTESRSLFEFKSVPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKPRRKLKSKPLN

SEQ ID NO: 14720 - protein, 266 aa, Panicum virgatum
  misc_feature: Useful for making plants with altered carbohydrate content
MAASPRLAILLALLAASSALAAAQKAKVKPAPGPAGAADAAPPTDVNKALKDDQFSEFKQLLHDTRVDTQINAQLTDSYNGLTIFAPTNAAFDKLKAGVLNGLSPQDQIQLVLYCVLPRFYSLSMLGTLNGKVNTQGSGHDGPYKYDIKRAGNNVNVSTGVNSMLLGSPVSKDFPLAVYPVDKVPLPYELFGPKPPTPAPAPAPAPAKSKTKKKHKKATGIAEPPVADDSTASDGDKKSAAAPAAGVARWVAALGVLGAAVLGGLF

SEQ ID NO: 14721 - protein, 273 aa, Arabidopsis thaliana
  misc_feature: Useful for making plants with modulated nitrogen use efficiency
MSLRKTLTAVNQSSLPPDSLISAGNLTVSEVSGSSSRIRFRPRKIRKVSSDPSPRIIITASPPLSTKSTVDIALRHLQSSDELLGALITTHNDPPVFDSSNTPFLSLARSILYQQLATKAAKCIYDRFISLFNGGEAGVFPESVISLSAVDLRKIGVSGRKASYLHDLADKYNNGVLSDELILKMSDEELIDRLTLVKGIGVWTVHMFMIFSLHRPDVLPVGDLGVRKGVKDLYGLKNLPGPLQMEQLCEKWRPYRSVGSWYMWRLIESRKTK

SEQ ID NO: 14722 - protein, 2024 aa, Arabidopsis thaliana
  misc_feature: Useful for making plants with modulated low light sensitivity
MACYCVNYLLVSFSVLILFSLCDRDILKSELICEDDSVKSTAAAEEISELLLHFLSSLEVQKKKKASKLLQDIQTLEDDIKEAERRYSSNVSLVRSHGAIEKRVQSSPLDEHCTTSSALFVPTANTDRLMSNIRQLEDAYFFMRSQINLSSSAATARSDKTLKDRDRCSENQNENQDMSTKGKSSDQLEVFFEGLCKFARYSKFETCGTIRSGDLLNSASVVCSLSFDPDEEHIAAAGISKKIKIFDFNAFMNESVGVHYPLVEMVNKSKLSCVCWNSYIKNYLASTDYDGVVQIWDAGTGQGFSQYTEHQKRAWSVDFSPSDPTKFVSGSDDCSVKLWSINEKRSLGTIWSPANVCCVQFSSYSNHLLAFGSADYKVYCYDLRYVKTPWCTLAGHEKAVSYVKFMDSETIVSASTDNSLKLWNLNKTNSSGLSPGACSLTYKGHTNQKNFVGLSVLDGYIACGSETNEVYSYYKSLPMPMTSYKFGSVDPISGNEYFDDNGQFVSSVCWRKKSNMLVAANSTGNMKLLKLVMPVMERVAEETVATNNIQLKARVDDVPCNKLDARHNDMVIQSETANSDCPGSSAHRNVDLTKPPPPEEAAGAKLSVEELTLGNYRIVQGSNNTNVDSPRAGKFEHLYRLARGSAFRAGDGDLDSQPRDMDQMLSRIRQQLAGAPSERQNLKPFMSRRSDQNLEAFSERLRAAGENSIMNAPALISEGVQMKTPVSSSNFSQLLLKRAMKGKGVVGKNQETPPEFVSDQDLGSKEKKLDISKSPTPHDVLPLKSSPKGNGMVSHGDGNHSKSSIGISLREFLRSSYAKREKRHGLCLFRQLVELVDSAHSKRLFLLDLRPSLFTLVPSKKLRYIGNFGKNDLESDVDEDLNRRRPVVEESSSGGRDSKKRKMDLHLNSPGNQLQATSTGRPFKRKSPVIDLNMVDARNPDSCELQQQDYIKNLSVSSVSRKQSMSTWLEEQWYTCPEEINGEDIGEKSNIYALGVLLFELLCHCESGEMHAAMMADLRHRILPPTFLSKYPKEAGFCLWLLHPEPSSRPSARDILKSELICEDDSVKSTAAAEEISELLLHFLSSLEVQKKKKASKLLQDIQTLEDDIKEAERRYSSNVSLVRSHGAIEKRVQSSPLDEHCTTSSALFVPTANTDRLMSNIRQLEDAYFFMRSQINLSSSAATARSDKTLKDRDRCSENQNENQDMSTKGKSSDQLEVFFEGLCKFARYSKFETCGTIRSGDLLNSASVVCSLSFDPDEEHIAAAGISKKIKIFDFNAFMNESVGVHYPLVEMVNKSKLSCVCWNSYIKNYLASTDYDGVVQIWDAGTGQGFSQYTEHQKRAWSVDFSPSDPTKFVSGSDDCSVKLWSINEKRSLGTIWSPANVCCVQFSSYSNHLLAFGSADYKVYCYDLRYVKTPWCTLAGHEKAVSYVKFMDSETIVSASTDNSLKLWNLNKTNSSGLSPGACSLTYKGHTNQKNFVGLSVLDGYIACGSETNEVYSYYKSLPMPMTSYKFGSVDPISGNEYFDDNGQFVSSVCWRKKSNMLVAANSTGNMKLLKLVMPVMERVAEETVATNNIQLKARVDDVPCNKLDARHNDMVIQSETANSDCPGSSAHRNVDLTKPPPPEEAAGAKLSVEELTLGNYRIVQGSNNTNVDSPRAGKFEHLYRLARGSAFRAGDGDLDSQPRDMDQMLSRIRQQLAGAPSERQNLKPFMSRRSDQNLEAFSERLRAAGENSIMNAPALISEGVQMKTPVSSSNFSQLLLKRAMKGKGVVGKNQETPPEFVSDQDLGSKEKKLDISKSPTPHDVLPLKSSPKGNGMVSHGDGNHSKSSIGISLREFLRSSYAKREKRHGLCLFRQLVELVDSAHSKRLFLLDLRPSLFTLVPSKKLRYIGNFGKNDLESDVDEDLNRRRPVVEESSSGGNQLQATSTGRPFKRKSPVIDLNMVDARNPDSCELQQQDYIKNLSVSSVSRKQSMSTWLEEQWYTCPEEINGEDIGEKSNIYALGVLLFEVWTNTQFYCCG

SEQ ID NO: 14723 - protein, 1029 aa, Arabidopsis thaliana
  misc_feature: Useful for making plants with modulated light quality sensitivity
MPVMERVAEETVATNNIQLKARVDDVPCNKLDARHNDMVIQSETANSDCPGSSAHRNVDLTKPPPPEEAAGAKLSVEELTLGNYRIVQGSNNTNVDSPRAGKFEHLYRLARGSAFRAGDGDLDSQPRDMDQMLSRIRQQLAGAPSERQNLKPFMSRRSDQNLEAFSERLRAAGENSIMNAPALISEGVQMKTPVSSSNFSQLLLKRAMKGKGVVGKNQETPPEFVSDQDLGSKEKKLDISKSPTPHDVLPLKSSPKGNGMVSHGDGNHSKSSIGISLREFLRSSYAKREKRHGLCLFRQLVELVDSAHSKRLFLLDLRPSLFTLVPSKKLRYIGNFGKNDLESDVDEDLNRRRPVVEESSSGGRDSKKRKMDLHLNSPGNQLQATSTGRPFKRKSPVIDLNMVDARNPDSCELQQQDYIKNLSVSSVSRKQSMSTWLEEQWYTCPEEINGEDIGEKSNIYALGVLLFELLCHCESGEMHAAMMADLRHRILPPTFLSKYPKEAGFCLWLLHPEPSSRPSARDILKSELICEDDSVKSTAAAEEISELLLHFLSSLEVQKKKKASKLLQDIQTLEDDIKEAERRYSSNVSLVRSHGAIEKRVQSSPLDEHCTTSSALFVPTANTDRLMSNIRQLEDAYFFMRSQINLSSSAATARSDKTLKDRDRCSENQNENQDMSTKGKSSDQLEVFFEGLCKFARYSKFETCGTIRSGDLLNSASVVCSLSFDPDEEHIAAAGISKKIKIFDFNAFMNESVGVHYPLVEMVNKSKLSCVCWNSYIKNYLASTDYDGVVQIWDAGTGQGFSQYTEHQKRAWSVDFSPSDPTKFVSGSDDCSVKLWSINEKRSLGTIWSPANVCCVQFSSYSNHLLAFGSADYKVYCYDLRYVKTPWCTLAGHEKAVSYVKFMDSETIVSASTDNSLKLWNLNKTNSSGLSPGACSLTYKGHTNQKNFVGLSVLDGYIACGSETNEVYSYYKSLPMPMTSYKFGSVDPISGNEYFDDNGQFVSSVCWRKKSNMLVAANSTGNMKLLKLV

SEQ ID NO: 14724 - protein, 167 aa, Arabidopsis thaliana
  misc_feature: Useful for making plants with modulated nitrogen use efficiency
MASVTSATVAIPSFTGLKASTIKSSATVRIQTAAVASPKLTVKSSLKNFGVAAVAAAASIALAGNAMAIEVLLGGGDGSLAFIPNDFSIAKGEKIVFKNNAGYPHNVVFDEDEIPSGVDVAKISMDEQDLLNGAGETYEVALTEPGTYSFYCAPHQGAGMVGKVTVN

SEQ ID NO: 14725 - protein, 313 aa, Arabidopsis thaliana
  misc_feature: Useful for making plants with modulated light quality sensitivity
MPVRVVESNTPAQAFSGTQNVSNQQKEEAWRVNVQIQGIDLEHGYLCGTMEALNVPMADTPVITFWEGEIVDGKNYTFYTGKWEATREDDMRHWSKFPSFSPLQRWKEQYFVNVGTDCGLTIAGFYYVCFSCSDGSISGFYYDPNSSFHHMIISSSKNVLKMEEVEVSKKRKFQTDQSDELSLLPLSKHTCFANVACSENTNGNSEIDTEYSMSSYVNSTTSMECNNDIEMKEESSGSCGEDKMISFESHLDYIYGTQNLEDFSEKVIENILYLDEQEEEEEDAKGCSSNAAKFVLSSGRWTVNQGKENRILV

SEQ ID NO: 14726 - protein, 730 aa, Arabidopsis thaliana
  misc_feature: Useful for making plants with modulated low light sensitivity
MPVRVVESNTPAQAFSGTQNVSNQQKEEAWRVNVQIQGIDLEHGYLCGTMEALNVPMADTPVITFWEGEIVDGKNYTFYTGKWEATREDDMRHWSKFPSFSPLQRWKEQYFVNVGTDCGLTIAGFYYVCFSCSDGSISGFYYDPNSSFHHMIISSSKNVLKMEEVEVSKKRKFQTDQSDELSLLPLSKHTCFANVACSENTNGNSEIDTEYSMSSYVNSTTSMECNNDIEMKEESSGSCGEDKMISFESHLDYIYGTQNLEDFSEKVIENILYLDEQEEEEEDAKGCSSNAAKFVLSSGRWTVNQGKENRILVMPVRVVESNTPAQVSGTDPGNRSPLPPSSLLGAGQAFSGTQNVSNQQKEEAWRVNVQIQGIDLEHGYLCGTMEALNVPMADTPVITFWEGEIVDGKNYTFYTGKWEATREDDMRHWSKFPSFSPLQGQVESDGGRQLDLNNYPYIFMRWKEQYFVNVGTDCGLTIAGFYYVCFSCSDGSISGFYYDPNSSPFQKLELKTVNEGRSGFSFSSYELQMPEVEVDNNNEKPSEINSFHHMIISSSKNVLKMEEVEVSKKRKFQTDQSDELSLLPLSKHTCFANVACSENTNGNSEIDTEYSMSSYVNSTTSMECNNDIEMKEESSGSCGEDKMISFESHLDYIYGTQNLEDFSEKVIENILYLDEQEEEEEDAKGCSSNAAKFVLSSGRWTVNQDDSTLHETKKPTIDQEFEQYFSTLML

SEQ ID NO: 14727 - protein, 491 aa, Panicum virgatum
  misc_feature: Useful for making plants with altered carbohydrate content
MASPMLNASPLLQLARSVWCVLLLAASSTVSGRHHSAPAASRTGQSMYISPNCRAHTASLADFGAVGDGTTSNTAAFRSAVDHLSQYSGEGGGGAMLYVPAGKWLTGPFNLTSHFTLFLHSDAVILGSTDISEWPVIDPLPSYGRGRDKVGGRYASLIGGSNLTDVVVTGENGTINGQGAVWWSKFRSNKLKYTRGYLIEVLWSDTVVVSNVTLLNSPAWNIHPVYSSNIVVQGVTILAPTRSPNTDGINPDSCSHVRIEDCYVVSGDDCVAIKSGWDEYGIRVGMPSQHIVVRRLTCVSPTSAVIALGSEMSGGIRDVRAEDIAAVDSESGVRIKTAVGRGAFVRDVFVRRMTLQTMKWVFWMTGNYKSHPDDGFDPGAVPVVEGISYQDVVATGVYKAAARLEGIQGAPFRGICLANVTAELDKSKKYPWTCADVEGVSANVSPPPCEALQQGGVDGACPFPTDTLPIDQLVLQQCAYDVPAPASPGKY

SEQ ID NO: 14728 - protein, 476 aa, Arabidopsis thaliana
  misc_feature: Useful for making plants with altered cell wall content and/or composition
MKNILACIVTIITLSNLITISQGRRVSQSFETFEYTAIICRSHSASITEYGGVGDGKTLNTKAFQSAVDHLSQYSSEGGAQLFVPAGKWLTGSFNLTSHFTLFLHKDAILLAAQDLNEYPILKALPSYGRGRDAAGGRFASLIFGTNLSDVIITGNNGTIDGQGSFWWQKFHGGKLKYTRPYLIELMFSDTIQISNLTFLDSPSWNIHPVYSSNIIVKGVTIIAPVKSPNTDGINPDSCTNTRIEDCYIISGDDCIAVKSGWDEYGISFGMPTKHLVIRRLTCISPYSAAIALGSEMSGGIEDVRAEDITAYQTESGVRIKTAVGRGAFVKNIYVKGMNLHTMKWVFWMTGNYKAHADSHYDPHALPEITGINYRDIVAENVSMAGRLEGISGDPFTGICISNATISMAAKHKKAIWMCSDVEGVTSGVDPKPCDLLDGQESETTKKKMIDGGCDFPTDVLEIDNVELKTCSYQMS

SEQ ID NO: 14729 - protein, 257 aa, Arabidopsis thaliana
  misc_feature: Useful for making plants with altered cell wall content and/or composition
MDQNLYRKCLVILSMMAMIGTSMATYAGTPWRTASATFYGDDTGSATMGGACGYGNMYDSGYGVATTALSTALFNEGYACGQCFQLKCVSSPNCYYGSPATVVTATNICPPNYGQASNNGGWCNPPRVHFDLTKPAFMKIANWKAGIIPVSYRRVACKKIGGIRFKFEGNGYWLLVYVMNVGGPGDIKTMAVKGSRTGWINMSHNWGASYQAFSSLYGQSLSFRLTSYTTRQTIYAYNAAPASWSAGKTYQSKANFN

SEQ ID NO: 14730 - protein, 216 aa, Arabidopsis thaliana
  misc_feature: Useful for making plants with modulated salt sensitivity
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 14731 - protein, 216 aa, Arabidopsis thaliana; identical to SEQ ID NO: 14730
  misc_feature: Useful for making plants with modulated nitrogen use efficiency

SEQ ID NO: 14732 - protein, 289 aa, Arabidopsis thaliana
  misc_feature: Useful for making plants with altered cell wall content and/or composition
MLDFLRETGSRLMINVYPFFAYEGNSDVIPLDYALLRENPGMVDSGNGLRYFNLFDAQIDAVFAAMSALKYDDIEIIVTETGWPSKGDENEVGATLANAASYNGNLIRRILTRGGTPLRPKADLTVYLFALFNENKKLGPTSERNYGLFFPDEKKVYDIPFTTEGLKHYRDGGHTPVTGGDQVTKPPMSGGVSKSLNGYTWCVANGDAGEERLQGGLDYACGEGGADCRPIQPGANCYSPDTLEAHASFAFNSYYQKKGRAGGSCYFGGAAYVVSQPPKYGRCEFPTGY

SEQ ID NO: 14733 - protein, 475 aa, Arabidopsis thaliana
  misc_feature: Useful for making plants with altered cell wall content and/or composition
METARLFKLVCVICIASLIPTIRANVADETDEYWVNKANEARKHTLMAYHPDPYEIVDHFHERHYDNSTDVEGTEEEKAVASEEEDVIEMISSPTNSTRRSLTGRGKGKGKGKWSKLTGPCTASNPIDKCWRCQPDWARRRKKLVHCVRGFGYRTTGGKRGRIYVVTSPRDDDMVNPRPGTLRHAVIQKEPLWIVFKHDMSIRLSQELMITSDKTIDARGANVHIAYGAGITMQYVHNIIIHGLHVHHIVKSSGGLIRDSINHFGHRGEADGDGISIFGATNIWLDHISMSKCQDGLIDAIMGSTAITISNSHFTHHNDVMLLGAQNNNMDDKKMQVTVAYNHFGKGLVQRMPRVRWGFVHVVNNDYTHWELYAIGGSQGPTILSHGNRFIAPPHKQHYREVTKRDYASESEWKNWNWRSEKDVFMNNAYFRQSGNPHFKCSHSRQQMIKPKNGMAVSKLTKYAGALDCRVGKAC

SEQ ID NO: 14734 - protein, 693 aa, Arabidopsis thaliana
  misc_feature: Useful for making plants with modulated biomass
  misc_feature: Useful for making plants with modulated light quality response
MASTTLSDLPDVILSTISSLVSDSRARNSLSLVSHKFLALERSTRSHLTIRGNARDLSLVPDCFRSISHLDLSFLSPWGHTLLASLPIDHQNLLALRLKFCFPFVESLNVYTRSPSSLELLLPQWPRIRHIKLLRWHQRASQIPTGGDFVPIFEHCGGFLESLDLSNFYHWTEDLPPVLLRYADVAARLTRLDLLTASFTEGYKSSEIVSITKSCPNLKTFRVACTFDPRYFEFVGDETLSAVATSSPKLTLLHMVDTASLANPRAIPGTEAGDSAVTAGTLIEVFSGLPNLEELVLDVGKDVKHSGVALEALNSKCKKLRVLKLGQFQGVCSATEWRRLDGVALCGGLQSLSIKNSGDLTDMGLVAIGRGCCKLTTFEIQGCENVTVDGLRTMVSLRSKTLTDVRISCCKNLDTAASLKAIEPICDRIKRLHIDCVWSGSEDEEVEGRVETSEADHEEEDDGYERSQKRCKYSFEEEHCSTSDVNGFCSEDRVWEKLEYLSLWINVGEFLTPLPMTGLDDCPNLEEIRIKIEGDCRGKRRPAEPEFGLSCLALYPKLSKMQLDCGDTIGFALTAPPMQMDLSLWERFFLTGIGSLSLSELDYWPPQDRDVNQRSLSLPGAGLLQECLTLRKLFIHGTAHEHFMNFLLRIPNLRDVQLRADYYPAPENDMSTEMRVGSCSRFEDQLNSRNIID

SEQ ID NO: 14735 - protein, 153 aa, Arabidopsis thaliana
  misc_feature: Useful for making plants with altered alkaloid content
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 14736 - protein, 355 aa, Panicum virgatum
  misc_feature: Useful for making plants with altered carbohydrate content
METLASAMRRENRRFKAPSAGAASAGAGVASGRVPLVMAFLSCLAWLYVAGRLWQDAQTRAILSGLLEKNSGNLPKVLSVEDKLRNLGCKEIGRKIVEAEMDLTKAKSEGYLWGNRTAAVDSEKKQQLLAVIGVYTGFGSRLKRNTFRGSWMPRGDALKKLEEKGVVIRFVIGRSANRGDTLDRNIDDENRRTNDFLILESHEEAAEELPSKAKIFFSAAVEAWDAEFYVKVEDNINLDLAGLIEMLEGRRGNQGLYMGCMKSGVVVSEEGQQWYEPEWWKFGDSKTYFRHASGSLFILSNNLARYININSASLQSYAHDDISVGSWMMGVNATYVDDDQLCCGSSRQEKVCSNA

SEQ ID NO: 14737 - protein, 1933 aa, Arabidopsis thaliana
  misc_feature: Useful for making plants with altered cell wall content and/or composition
MASTSSGGRGEDGRPPQMQPVRSMSRKMTRAGTMMIEHPNEDERPIDSELVPSSLASIAPILRVANDIDQDNARVAYLCRFHAFEKAHRMDPTSSGRGVRQFKTYLLHKLEEEEEITEHMLAKSDPREIQLYYQTFYENNIQDGEGKKTPEEMAKLYQIATVLYDVLKTVVPQARIDDKTLRYAKEVERKKEQYEHYNILPLYALGAKTAVMELPEIKAAILAVCNVDNLPRPRFHSASANLDEVDRERGRSFNDILEWLALVFGFQRGNVANQREHLILLLANIDVRKRDLENYVEIKPSTVRKLMEKYFKNYNSWCKYLRCDSYLRFPAGCDKQQLSLLYIGLYLLIWGEASNVRFMPECLCYIFHNMANEVHGILFGNVYPVTGDTYEAGAPDEEAFLRNVITPIYQVLRKEVRRNKNGKASHSKWRNYDDLNEYFWDKRCFRLKWPMNFKADFFIHTDEISQVPNQRHDQVSHGKRKPKTNFVEARTFWNLYRSFDRMWMFLVLSLQTMIIVAWHPSGSILAIFTEDVFRNVLTIFITSAFLNLLQATLDLVLSFGAWKSLKFSQIMRYITKFLMAAMWAIMLPITYSKSVQNPTGLIKFFSSWVGSWLHRSLYDYAIALYVLPNILAAVFFLLPPLRRIMERSNMRIVTLIMWWAQPKLYIGRGMHEEMFALFKYTFFWVMLLLSKLAFSYYVEILPLVNPTKLIWDMHVVNYEWHEFFPNATHNIGVIIAIWGPIVLVYFMDTQIWYAIFSTLFGGIYGAFSHLGEIRTLGMLRSRFKVVPSAFCSKLTPLPLGHAKRKHLDETVDEKDIARFSQMWNKFIHTMRDEDLISDRERDLLLVPSSSGDVTVVQWPPFLLASKIPIALDMAKDFKGKEDVDLFKKIKSEYYMHYAVVEAYETVRDIIYGLLQDESDKRIVREICYEVDISIQQHRFLSEFRMTGMPLLSDKLEKFLKILLSDYEEDDYKSQIINVLQDIIEIITQDVMVNGHEILERAHLQSGDIESDKKEQRFEKIDLSLTQNISWREKVVRLLLLLTVKESAINIPQSLEARRRMTFFANSLFMNMPDAPRVRDMLSFSVLTPYYKEDVLYSEEELNKENEDGITILFYLQRIYPEEWSNYCERVNDLKRNLSEKDKAEQLRQWVSYRGQTLSRTVRGMMYYRVALELQCFQEYTEENATNGGYLPSESNEDDRKAFSDRARALADLKFTYVVSCQVYGNQKKSSESRDRSCYNNILQLMLKYPSLRVAYIDEREETVNGKSQKVFYSVLLKGCDKLDEEIYRIKLPGPPTEIGEGKPENQNHAIIFTRGEALQTIDMNQDNYFEECFKMRNVLQEFDEGRRGKRNPTILGLREHIFTGSVSSLAWFMSNQETSFVTIGQRVLANPLRVRFHYGHPDIFDRIFHITRGGISKASKIINLSEDIFAGYNSTLRGGYVTHHEYIQAGKGRDVGMNQISFFEAKVANGNGEQTLSRDVYRLGRRFDFYRMLSFYFTTVGFYFSSMITVLTVYVFLYGRLYLVLSGLEKNILQSASVHESNALEQALAAQSVFQLGFLMVLPMVMEIGLEKGFRTALGDFIIMQLQLASVFFTFQLGTKAHYFGRTILHGGSKYRATGRGFVVFHAKFAENYRLYSRSHFVKGLELVILLVVYQVYGTSYRSSSTYMYITFSMWFLVTSWLFAPFIFNPSGFEWQKTVDDWTDWKRWMGNRGGIGIVLDKSWESWWDIEQEHLKHTNLRGRVLEILLALRFLLYQYGIVYHLNIARRHTTFLVYGLSWAILLSVLLVLKMVSMGRRKFGTDFQVMFRILKALLFLGFLSVMTVLFVVCGLTISDLFASILAFLPTGWAILLIGQALRSVFKGLGFWDSVKELGRAYEYIMGLVIFTPIAVLSWFPFVSEFQTRLLFNQAFSRGLQISMILAGKKDKETPSTK

SEQ ID NO: 14738 - protein, 590 aa, Panicum virgatum
  misc_feature: Useful for making plants with altered carbohydrate content
MAAAVSPPLLLAVLLLTTAGTTQCHGHKRHHHQTDGTRRPSKAAAEKSRPPAATAHHTICQKTPHSASCLAAVASHLDAVAGASGKAAEASAVSVQLLPPDVLSVVLASLRGAASALSSLSPAISTLSVRAAFPTGAPLRRGAAQDCQELHAASLSSLSRAASLLAAPGDGGGLPAARAHLAAALANKATCLDGLAGASSGPGVAGLLASFDDAYEHVSNSLALVARGGVPSAAGFANAVAKAIHNRRLLQDDDNGDGEDDSGNNGDGDSGNADQRTAKVITVAQDGTGDFRTVGEAVAAAPNNSRARTEIRVKAGTYSENVEVPPYKTNIALVGEGREKTIITGSRSAAGGWTTFRTATFGVSGEGFLARDVTFRNTAGAAAGQAVALRVNADLAAAYRCGVEAHQDALYAHSFRQFYRECAVAGTVDVVFGDAAAVLQGCALLARAPLPGQDVVLTAQGRGDPNEDTGIAVLNCTVDAAAAPLPAGTRTFLGRPWGAYARAAVMDSYLGPIVDREGWAEWPGAEPGRGDTVFFGEYGNGGPGAGTEGRVRWAGVRQMDYDEAAQFAVENFIYGNEWLGATSFPYDDDV

SEQ ID NO: 14739 - protein, 561 aa, Arabidopsis thaliana
  misc_feature: Useful for making plants with altered cell wall content and/or composition
MSSPYGKVDEREHVRLEARRKTRKNIAIIAVSLVILAGIVIGAVFGTMAHKKSPETVETNNNGDSISVSVKAVCDVTLHKEKCFETLGSAPNASSLNPEELFRYAVKITIAEVSKAINAFSSSLGDEKNNITMNACAELLDLTIDNLNNTLTSSSNGDVTVPELVDDLRTWLSSAGTYQRTCVETLAPDMRPFGESHLKNSTELTSNALAIITWLGKIADSFKLRRRLLTTADVEVDFHAGRRLLQSTDLRKVADIVVAKDGSGKYRTIKRALQDVPEKSEKRTIIYVKKGVYFENVKVEKKMWNVIVVGDGESKSIVSGRLNVIDGTPTFKTATFAVFGKGFMARDMGFINTAGPSKHQAVALMVSADLTAFYRCTMNAYQDTLYVHAQRQFYRECTIIGTVDFIFGNSASVLQSCRILPRRPMKGQQNTITAQGRTDPNMNTGISIHRCNISPLGDLTDVMTFLGRPWKNFSTTVIMDSYLHGFIDRKGWLPWTGDSAPDTIFYGEYKNTGPGASTKNRVKWKGLRFLSTKEANRFTVKPFIDGGRWLPATKVPFRSGL

SEQ ID NO: 14740 - protein, 152 aa, Arabidopsis thaliana
  misc_feature: Useful for making plants with modulated nitrogen use efficiency
MEREDLYAVLDLNNECTQGDLRLSYKNLVLKWHPDRFLEEIEKDEAKMKFQSIQRAYSVLSDSNKRLLYDVGAYDSDDDETGMADFINEMVTLMAQTQSTGDENLEEFEELFQELLKDDVNQFKTRSSSSSCSQFSGTSTLVHCDDLSNSND

SEQ ID NO: 14741 - protein, 517 aa, Panicum virgatum
  misc_feature: Useful for making plants with altered carbohydrate content
MSSQGQAAAPLARGDAGDDAAGGTKASAHFVFVPLNERGHLIPAADTALLLATHGAVCTIVGPPSATSKVRQTVESAQQFGLPVRLVDFPLDYAAAGLPEGADDADRIEPRYMMNFYRALALLRAPIERYLRAHDPYPTCVVSDIFNPWASELAAGLGVPRLSFFSMCAFSVLCQHNVERFHAYDGVEDSNAPVVVPGIDREVVVTRAQAPGFLRGIPIPEWVELADYIERARAEADGVIMNTFLEMEPEYVAGYAEARGRKVWTVGPVSLYHQGAATLASRGDSAPAIGAAECLRWLDGREPGSVVYVSFGSIAQAGPKQLVELALGLEASGHPFIWVVRNAGGYDEAVRAVLGEMEARVAGRGLLVRGWAPQAVILSHAAVGGFVTHCGWNSTLEAITAGLPVVTWPHFTDQFLNEKMAVEVLGIGVSVGVKEPLAFQAANKEILVGRDVVEKAVRDIMGAGEEADGRRQRARELAAKARAAVQEGGSSHANLLDLVKRFQKQGAAAPSDKSSAA

SEQ ID NO: 14742 - protein, 500 aa, Panicum virgatum
  misc_feature: Useful for making plants with altered carbohydrate content
MGSQGQPAPGARGDDDDSGGRAAHFVFVPLMAQGHLIPAVDTALLLATHGAVCTIAATPATAVRVRATVDSARRSGLQVRLVEFPLDYAAAGMPDGADNADNVPVEHMWSYFRALPLLSAPIESYLRAHAPFPTCVVSDFCHPWTTVLAANLGVPRLSFFSMCAFYLLCQHNVERFKAFEGVAGDDEPVVVPGLEKRFVVTRAQTPGFFRQLAAWQEFADYIERAMAEADGVIMNTFEEMEPEYVAGYAAARKMKVWTVGPVSTYHHKRDATLAARGYAAAAIDAGECLRWLDGKEPGSVVYVSFGSVARAGGKQAVELGLGLEASGHPFIWVVRNADEYEESVREFLGELEARVAGHGLLVRGWAPQVLILSHAAVGGFVTHCGWNSTLEAITAGLPVVTWPHFTDQFLNEKMAVDVLGIGVSVGVTEPLMYQAVEKEIVVGRGAVEAAVRSVMGAGEEAEERRRRALALAAKARAAMQEGGSSHGNLLDLVKRFKAVS

SEQ ID NO: 14743 - protein, 287 aa, Arabidopsis thaliana
  misc_feature: Useful for making plants with modulated biomass
MSQTSYYRSPFGDTTYTKVFVGGLAWETPTDEMRRYFEQFGEILEAVIITDKNTGKSKGYGFVTFRESDSATRAVADPNPVIDGRKANCNIASFGRPRPSPPRGRGQTGSPSQYQSGGPSTYTGMAAPLPPAAAPQLMYPSYGYTYNPDQFGYHQALYNTQLQQAQYYQQQQQLYGGGATSPSSSGATIMPSPYYYGYSLQAPRVPYQHHHHLPQPYNPQQHHHQRFSSPSFLVYPSNSSFAPPLQGVLSSSTESEAVPQQVPAAEGEATTTAPEITTSNTKEPISS

SEQ ID NO: 14744 - protein, 561 aa, Arabidopsis thaliana
  misc_feature: Useful for making plants with altered cell wall content and/or composition
MAVAFRGGRGGVGSGQSTGLRSFFSYRIFISALFSFLFLATFSVVLNSSRHQPHQDHTLPSMGNAYMQRTFLALQSDPLKTRLDLIHKQAIDHLTLVNAYAAYARKLKLDASKQLKLFEDLAINFSDLQSKPGLKSAVSDNGNALEEDSFRQLEKEVKDKVKTARMMIVESKESYDTQLKIQKLKDTIFAVQEQLTKAKKNGAVASLISAKSVPKSLHCLAMRLVGERISNPEKYKDAPPDPAAEDPTLYHYAIFSDNVIAVSVVVRSVVMNAEEPWKHVFHVVTDRMNLAAMKVWFKMRPLDRGAHVEIKSVEDFKFLNSSYAPVLRQLESAKLQKFYFENQAENATKDSHNLKFKNPKYLSMLNHLRFYLPEMYPKLNKILFLDDDVVVQKDVTGLWKINLDGKVNGAVETCFGSFHRYGQYLNFSHPLIKENFNPSACAWAFGMNIFDLNAWRREKCTDQYHYWQNLNEDRTLWKLGTLPPGLITFYSKTKSLDKSWHVLGLGYNPGVSMDEIRNAGVIHYNGNMKPWLDIAMNQYKSLWTKYVDNEMEFVQMCNFGL

SEQ ID NO: 14745 - protein, 528 aa, Panicum virgatum
  misc_feature: Useful for making plants with altered carbohydrate content
MAAAAGSPWRSAGPVASLALLLLLATAAAPAAAGGGSTAVNGNRLRAEQIRKQASDAAASAAALAAASRRLHLDRARHLRLLSSLHRNLTNTLRALSLAADADPSASDPAANASSPRQLDLQAKDLIRAARAAIAESKPLFDPQLKIQRLKDAIFAQNELLARAKKRGAFASLIAAKSIPKPLHCLAVRLTAERIATPEQYADPVPPPRALEDPALFHYAIFSDNVLAASCVVRSAVANSNDPSKHVFHVVTDRMNLGAMQVIIHRMDLKGAHYEVKAFEDYKFLNSSYVPVLRQLESANLQKFYFENKLENATKDASNMKFRNPKYLSMLNHLRFYLPEMYPKLHRILFLDDDVVVQRDLTGLWKIDMDGKVNGAVETCFGSFHRYWQYMNFSHPLIKAKFSPNACGWAYGMNFFDLDSWRREKCTEQYHYWQNQNENRTLWKLGTLPPGLITFYSTTKPLDKSWHVLGLGYNPSISMEEIRNAAVVHFNGNMKPWLDIGMNQFRHLWTKYVDYDDEYIRQCNFAPP

SEQ ID NO: 14746 - protein, 304 aa, Arabidopsis thaliana
  misc_feature: Useful for making plants with modulated biomass
MAIISEVEEESSSSRPMIFPFRATLSSANPLGFLEKVFDFLGEQSDFLKKPSAEDEIVVAVRAAKEKLKKAEKKKAEKESVKPVEKKAEKEIVKLVEKKVEKESVKPTMAASSAEPIEVEKPKDEEEKKESGPIVPNKGNGTDLENYSWIQNLQEVTVNIPVPTGTKARTVVCEIKKNRLKVGLKGQDPIVDGELYRSVKPDDCYWNIEDQKVISILLTKSDQMEWWKCCVKGEPEIDTQKVEPETSKLGDLDPETRSTVEKMMFDQRQKQMGLPTSEELQKQEILKKFMSEHPEMDFSNAKFN

SEQ ID NO: 14747 - protein, 292 aa, Arabidopsis thaliana
  misc_feature: Useful for making plants with altered cell wall content and/or composition
MEYLSIFGFVSVLYLIIRVDARAYEVNGIDQSKVGFDDNYVVTWGQNNVLKLNQGKEVQLSLDHSSGSGFESKNHYESGFFQIRIKVPPKDTSGVVTAFYLTSKGNTHDEVDFEFLGNKEGKLAVQTNVFTNGKGNREQKLALWFDPSKDFHTYAILWNPYQIVLYVDNIPVRVFKNTTSQGMNYPSKPMQVVVSLWNGENWATDGGKSKINWSLAPFKANFQGFNNSGCFTNAEKNACGSSAYWWNTGSYSKLSDSEQKAYTNVRQKYMNYDYCSDKVRFHVPPSECKWNN

SEQ ID NO: 14748 - protein, 329 aa, Arabidopsis thaliana
  misc_feature: Useful for making plants with altered cell wall content and/or composition
MKTMTQLNIAVVVVVTVLIGMLRSSEAQLQMNFYAKSCPNAEKIISDHIQNHIHNGPSLAAPLIRMHFHDCFVRGCDGSVLINSTSGNAERDAPPNLTLRGFGFVERIKALLEKVCPKTVSCADIIALTARDAVVATGGPSWSVPTGRRDGRISNKTEATNNIPPPTSNFTTLQRLFKNQGLNLKDLVLLSGAHTIGVSHCSSMNTRLYNFSTTVKQDPSLDSQYAANLKANKCKSLNDNSTILEMDPGSSRSFDLSYYRLVLKRRGLFQSDSALTTNSATLKVINDLVNGSEKKFFKAFAKSMEKMGRVKVKTGSAGVIRTRCSVAGS

SEQ ID NO: 14749 - protein, 582 aa, Oryza sativa subsp. japonica
  misc_feature: Useful for making plants with modulated phosphate use efficiency
  misc_feature (126)..(126): Xaa is any aa, unknown, or other
MAPRIRVLAALDQARTQYYHFKAIVIAGMGLFTDSYDLFCISPVMKIFGRVYYAPSGSVDGSGSGPGVTPPAVVSATVGVALLGAVAGNVVFGALGDRVGRRRVYGACLLLMVCSSVGSGLSVCRXRRCALASLCFFRFLLGVGVGGDYPLSATIMSEFANRGTRGAFIAAVFSMQGFGILVSSAVTMAVAAAFDHYTGYPAPLDTPECADLAWRIILMAGAVPAALTYYWRMSMPETARYTALVERDVVKATNDIGRVLADLDLAAVAEEEVAAAALSPPPVTTPPPPRPSYGLFSRRFVRQHGRDLFACAAAWFLLDIPYYSSTLFQSQIYRPWFPPAAKVNAFQEAFNVAKFQAVIAVASTIPGYFAAMLLIERAGRRRLQMAGFLLMAVFLFALAGPYDGYWRDHAKTAGYIVLYSLTFFSANLGPNTTTFILPAELFPARFRSTCHGLSGAAGKLGALVGSIGFLWASQQKDGAAAGHLPGIGMMYALFVLGGICLLGLALTYAFTPETMTRSLEENESSVQAQSQVGDGGSDAGNGSDGLRFHELNVLMEAATKSPVSMASSHLSMSPILPHRMSL

SEQ ID NO: 14750 - protein, 1036 aa, Arabidopsis thaliana
  misc_feature: Useful for making plants with altered cell wall content and/or composition
MASSPPKKTLNSQSSSLSRPPQAVKFGRRTSSGRIVSLSRDDDMDVSGDYSGQNDYINYTVLMPPTPDNQPAGSSGSTSESKGDANRGGGGGDGPKMGNKLERRLSVMKSNNKSMLLRSQTGDFDHNRWLFESKGKYGIGNAFWSEEDDTYDGGVSKSDFLDKPWKPLTRKVQIPAKILSPYRLLIVIRLVIVFFFLWWRITNPNEDAMWLWGLSIVCEIWFAFSWILDILPKLNPINRATDLAALHDKFEQPSPSNPTGRSDLPGVDVFVSTADPEKEPPLVTANTLLSILAVDYPIEKLSAYISDDGGAILTFEAMAEAVRFAEYWVPFCRKHDIEPRNPDSYFSIKKDPTKNKKRQDFVKDRRWIKREYDEFKVRINGLPEQIKKRAEQFNMREELKEKRIAREKNGGVLPPDGVEVVKATWMADGTHWPGTWFEPKPDHSKGDHAGILQIMSKVPDLEPVMGGPNEGALDFTGIDIRVPMFAYVSREKRPGFDHNKKAGAMNGMVRASAILSNGAFILNLDCDHYIYNSKAIKEGMCFMMDRGGDRICYIQFPQRFEGIDPSDRYANHNTVFFDGNMRALDGLQGPVYVGTGCMFRRYALYGFNPPRANEYSGVFGQEKAPAMHVRTQSQASQTSQASDLESDTQPLNDDPDLGLPKKFGNSTMFTDTIPVAEYQGRPLADHMSVKNGRPPGALLLPRPPLDAPTVAEAIAVISCWYEDNTEWGDRIGWIYGSVTEDVVTGYRMHNRGWRSVYCITKRDAFRGTAPINLTDRLHQVLRWATGSVEIFFSKNNAMFATRRLKFLQRVAYLNVGIYPFTSIFLVVYCFLPALCLFSGKFIVQSLDIHFLSYLLCITVTLTLISLLEVKWSGIGLEEWWRNEQFWLIGGTSAHLAAVVQGLLKVIAGIEISFTLTSKASGEDEDDIFADLYIVKWTGLFIMPLTIIIVNLVAIVIGASRTIYSVIPQWGKLMGGIFFSLWVLTHMYPFAKGLMGRRGKVPTIVYVWSGLVSITVSLLWITISPPDDVSGSGGISV

SEQ ID NO: 14751 - protein, 408 aa, Arabidopsis thaliana
  misc_feature: Useful for making plants with altered cell wall content and/or composition
MSNMFSRIAMTNSIVLLLFSLTFLEHGLLFQRVSSLGINYGQVGDNLPPPDKVLQLLSSLHINKTRIYDTNPRVLTSFANSNIELFVTVENEMLPSLVDPQQALQWVTTRIKPYFPATKIGGIAVGNELYTDDDSSLIGYLMPAMMSIHGALVQTGLDKYIQVSTPNSLSVLQESYPPSAGCFRPEVAGVMTQLLGFLRNTNSPFWINAYPYFAYKDSPTKIPLDYVLFNPNPGMVDPYTKYRYDNMLYAQVDAVIFAMARLGFKDIEVGVSETGWPSKGDGDEVGATVANAAVYNKNILRRQLQNEGTPLRPNLSFDVYLFALFNEDLKPGPTSERNYGLYQPDETMTYNVGLLSSSSLTSTSTTSSTSIISLTSSASTALKKGKQRLMYWTCVYLLAIHMLIRRSY

SEQ ID NO: 14752 - protein, 148 aa, Arabidopsis thaliana
  misc_feature: Useful for making plants with altered alkaloid content
  misc_feature: Useful for making plants with modulated drought sensitivity
  misc_feature: Useful for making plants with modulated heat sensitivity
MPSRYPEAVTQDWEPVVLHKSKQKSQDLRDPKAVNAALRNGVAVQTVKKFDAGSNKKGKSTAVPVINTKKLEEETEPAAMDRVKAEVRLMIQKARLEKKMSQADLAKQINERTQVVQEYENGKAVPNQAVLAKMEKVLGVKLRGKIGK

SEQ ID NO: 14753 - protein, 142 aa, Glycine max
  misc_feature: Useful for making plants with altered lignin content
MSGVGPLSQDWEPVVLRKKAPTAAAKKDEKAVNAARRSGAEIETLKKYNAGTNKAASSSTSLNTKRLDDDTENLAHEKVPTELKKAIMQARMDKKLTQAQLAQLINEKPQVIQEYESGKAIPNQQIIGKLERALGAKLRGKK

SEQ ID NO: 14754 - protein, 441 aa, Oryza sativa subsp. japonica
  misc_feature: Useful for making plants with modulated biomass
MLRSLHSSSSSDTDNNSGGCKNNGGGGGEAAAAVEGGGDQRAVAAAAPSTRDLLLACADLLQRGDLPAARRAAEIVLAAAASPRGDAADRLAYHFARALALRVDAKAGHGHVVVGGGAARPASSGAYLAFNQIAPFLRFAHLTANQAILEAVDGARRVHILDLDAVHGVQWPPLLQAIAERADPALGPPEVRVTGAGADRDTLLRTGNRLRAFARSIHLPFHFTPLLLSCATTAPHHVAGTSTGAAAAASTAAAATGLEFHPDETLAVNCVMFLHNLAGHDELAAFLKWVKAMSPAVVTIAEREAGGGGGGGDHIDDLPRRVGVAMDHYSAVFEALEATVPPGSRERLAVEQEVLGREIEAAVGPSGGRWWRGIERWGGAARAAGFAARPLSAFAVSQARLLLRLHYPSEGYLVQEARGACFLGWQTRPLLSVSAWQPSSS

SEQ ID NO: 14755 - protein, 256 aa, Arabidopsis thaliana
  misc_feature: Useful for making plants with altered cell wall content and/or composition
MDSGLQQLALCLFFILCRLFQATAEDDWKIATATLSRDRDGSSSVATGGACGYGDLRQSSFAGYSAGLSGKLFNRGSSCGACLEVRCVNHIRWCLQGSPSVVVTATDFCPPNSGLSSDYGGWCNFPKEHLELSHAAFTGIAETRAEMIPIQYRRVKCGRRGGLRFSLSGSSHFFQVLISNVGLDGEVVGVKVKGHTTAWIPMARNWGQNWHSSLDLIGQSLSFEVTLKGGKTIASYDVAPPYWRFGMTYQGKQFHS

SEQ ID NO: 14756 - protein, 393 aa, Arabidopsis thaliana
  misc_feature: Useful for making plants with altered tocopherol content
MESLLSSSSLVSAAGGFCWKKQNLKLHSLSEIRVLRCDSSKVVAKPKFRNNLVRPDGQGSSLLLYPKHKSRFRVNATAGQPEAFDSNSKQKSFRDSLDAFYRFSRPHTVIGTVLSILSVSFLAVEKVSDISPLLFTGILEAVVAALMMNIYIVGLNQLSDVEIDKVNKPYLPLASGEYSVNTGIAIVASFSIMSFWLGWIVGSWPLFWALFVSFMLGTAYSINLPLLRWKRFALVAAMCILAVRAIIVQIAFYLHIQTHVFGRPILFTRPLIFATAFMSFFSVVIALFKDIPDIEGDKIFGIRSFSVTLGQKRVFWTCVTLLQMAYAVAILVGATSPFIWSKVISVVGHVILATTLWARAKSVDLSSKTEITSCYMFIWKLFYAEYLLLPFLK

SEQ ID NO: 14757 - protein, 338 aa, Panicum virgatum
  misc_feature: Useful for making plants with altered carbohydrate content
MPSHGAPQQVANDGTSSFLADKSAKVFLAGHKGMLGSAVHRRLAALGFTNVVGRTRAELDLTCEAAVRKFFDAERPRYVILAAGKVGGLHASSAAPVDFMTENLRITTNVLAAARLCGTVRKLLFLATSAIYPADAPQPIPESALLAGPPAPGNEWYAIPKIVGIKMCQAYRAELGMDAIVAAPNNLYGPREPFPSESSHVIPALIRRFHRAKAAGAPEVAVWGSGLQLREFTHADDAADAIVLLMDRYSGAEHVNVGSGREVTVRELAEMVREVVGYEGRVVWDTSRPDGVMRRLLDSSKMREMGWEPKVELRDGLKKLYEGYLGSSVVSNFETVNR

SEQ ID NO: 14758 - protein, 429 aa, Oryza sativa
  misc_feature: Useful for biocontainment applications
MMNPRRLPPLPSSTSSASAADDMDPRVWRRLPQPLVDRILACLPTPSFLRLRAACRRFYHLLFSSPFLHSHLLLSPHLPFFAFVVPAAGHLLLLDPTATASWSRLPLPLPPVAGGPAAFSPAAASAGLLAFLSDASGHKTLLLANPITRLLAALPISPTPRLSPTVGLAAGPTSIIAVVAGDDLVSPFAVKNISADTFVADAASVPPSGFWAPSSLLPRLSSLDPRAGMAFASGRFYCMSSSPFAVLVFDVAENVWSKVQPPMRRFLRSPALVELGGGREGAARVALVSAVEKSRLSVPRSVRLWTLRGGGGGGGGGAWTEVARMPPEVHAQFAAAEGGRGFECAAHGDYVVLAPRGPVAQAPTSALVFDSRRDEWRWAPPCPYVVVAHHGGAGAAGFRVFAYEPRLATPAIGLLDATAPVALHGMHDG

SEQ ID NO: 14759 - protein, 530 aa, Panicum virgatum
  misc_feature: Useful for making plants with altered carbohydrate content
MMKSLLPQSQLRRSSARPSGAAAAAGGDGAAADGGGALARAPASGTFWFLLHALCCLISLFLGFRFSRLLFFLLFSTTALYHSTTSSSSAAVLRATTTTTTTTTTTTTTTNIFTLSFAAANPPPSNPANRTALEAASAADKGATSGNPQSHVVVGRHGIRIRPWPHPDPVEVMRAHQIMERVQEEQRRWYGVKEPRQVLVVTPTYSRAFQALHLTGLLHSLRNVPYPLTWIVVEAGGTTNATASLLGRSGLTFVHVPFPDHMPHDWADRHATENRMRLHALRVIRERKMDGVVVFADDSNVHSMELFDEVQKVQWMGAVSVGILAHTGAADQPHLSEEDKQNMPLPVQGPACNSSGHLAGWHTFNSLPFSGKTATVVGEAAPVLPRGLEWAGFVLNSRMLWKEAKGKPDWVKDLDAVGENGEEIENPLTLLNDPSSVEPLGNCGKKVLLWWLRVEARADSKFPQGWVIEPPLDILVPAKRTPWPETTTELPSELLDDKQDQEDRRLSRANKSSRPRSTTKRKGDLQGQVN

SEQ ID NO: 14760 - protein, 192 aa, Panicum virgatum
  misc_feature: Useful for making plants with altered carbohydrate content
MMRDTAAVAVAAPRYRGVRKRPWGRFAAEIRDPAKRARVWLGTFDSAEAAARAYDVAARTLRGPLARTNFPCAASRLPLPSQHQGCGGGGLVAPAPAAPTCSSGSTVESSSGPRGAPRAAVAAVAPRIRRRSVKPRPAAPDADCHSDCASSASVVDDGDDASTVRSRAPFDLNVPAPVDDDHALELCTELRL

SEQ ID NO: 14761 - protein, 181 aa, Arabidopsis thaliana
  misc_feature: Useful for making plants with altered lignin content
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEARRRLRRWRNRYMRLRDIRELHR

SEQ ID NO: 14762 - protein, 318 aa, Panicum virgatum
  misc_feature: Useful for making plants with altered carbohydrate content
MASRKLGLFVAAVVSAAAFVPPSAVAQLRTDYYASVCPNLESIVRGSVRQSMAQSQISAPAALRLFFHDCAITGCDASIMIVNSNGDDEWRHSDNQSLKREGFQTVLSAKAAVDGDPQCRNKVSCADILALAARESVVQSGGPYYQVELGRYDGRVSTRGSVVLPHVNFNLDQLNAFFSGLGFNQTEMVALLGAHTLGAADCPFFQYRIGSDPSMDQGLASQLRATCGANPGGGFAFLDPSPGGFDNAFYRNLQGGRGLLGTDQVLYSDQRSRGAVDAYAANQGTFFADFVAAVTKLGRIGVKTAATGEIRRDCRFPN

SEQ ID NO: 14763 - protein, 325 aa, Arabidopsis thaliana
  misc_feature: Useful for making plants with altered cell wall content and/or composition
MEKNTSQTIFSNFFLLLLLSSCVSAQLRTGFYQNSCPNVETIVRNAVRQKFQQTFVTAPATLRLFFHDCFVRGCDASIMIASPSERDHPDDMSLAGDGFDTVVKAKQAVDSNPNCRNKVSCADILALATREVVVLTGGPSYPVELGRRDGRISTKASVQSQLPQPEFNLNQLNGMFSRHGLSQTDMIALSGAHTIGFAHCGKMSKRIYNFSPTTRIDPSINRGYVVQLKQMCPIGVDVRIAINMDPTSPRTFDNAYFKNLQQGKGLFTSDQILFTDQRSRSTVNSFANSEGAFRQAFITAITKLGRVGVLTGNAGEIRRDCSRVN

SEQ ID NO: 14764 - protein, 293 aa, Panicum virgatum
  misc_feature: Useful for making plants with altered carbohydrate content
MARRVSLLLLGALAACSAAAAASFDQEFDITWGDGRGKIQDGGRLLTLTLDRTSGSGFQSRHEYLFGKIDMQLKLVPGNSAGTVTAYYLSSQGSAHDEIDFEFLGNVSGEPYTLHTNVFTQGQGQRKQQFRLWFDPTTDFHTYSILWNPKHIIFMVDDLPIRDFRNLESKGIAFPKSQPMRLYSSLWNADDWATQGGRVKTDWSHAPFSASYRGFRADACVTVAGGRTRCGAAVGTEGAAGAAAPAGDWYNQELDLTLQQRMRWVQRKYMIYNYCTDPKRYQQGLPAECSMQQ

SEQ ID NO: 14765 - protein, 178 aa, Arabidopsis thaliana
  misc_feature: Useful for making plants with modulated cold sensitivity
MEAKKSNKIREIVKLQQLLKKWRKQAIASKAANNNNEDNNSSGGGSKSIKFLKRTLSFTDVTAVPKGYLAVSVGLEKKRYTIPTEYLSHQAFYVLLREAEEEFGFQQAGVLRIPCEVSVFESILKIMEEKNEGYLVTPITAKQECKFNAAADDKTSYQHPSDCPKTPSHQPHNSPMCR

SEQ ID NO: 14766 - protein, 450 aa, Panicum virgatum
  misc_feature: Useful for making plants with altered carbohydrate content
MKPAARSKKGRGAFCNLPLLLLIGAIQFLVIYSPAIDRYMVMITKGKPGFPSLLLDGRRGFKLVVEEFVPEPRVACDFADPRSDVCELEGAIRIRGSTSEVFVVAPGGAGAGMNATQWTIQPYTRKGEARVMRGIAELTVRVVGAGEAPACTVRHDVPAVVYSNGGYCGNYYHDFNDNIIPLFITSRHLGGEVQLLVAQKQRWWFDKYREIVDGLTNYEAVDLGGDGGEVRCFRRTTLGLRSHKELSIDPRRAPRNLSMVDFKRFLMWRYALPREHAIRTEEDEGAARPRLLIIARRSRRRFVNLPEIVALAEEVGFEVTTSDVMSPPKQNKKGALAAAGDEGHARMADASALVNSFDAMVAVHGSGLTNLVFLPMNAVVVQVVPLGRMEGLAMDEYGVPPRDMNMRYLQYNIHKQSWSLVKDIYLGQQDVRLDLRRFRPVLEKAIRLLR

SEQ ID NO: 14767 - protein, 1939 aa, Arabidopsis thaliana
  misc_feature: Useful for making plants with altered cell wall content and/or composition
MAQSSTSHDSGPQGLMRRPSRSAATTVSIEVFDHEVVPASLGTIAPILRVAAEIEHERPRVAYLCRFYAFEKAHRLDPSSGGRGVRQFKTLLFQRLERDNASSLASRVKKTDGREVESFYQQYYEHYVRALDQGDQADRAQLGKAYQTAGVLFEVLMAVNKSEKVEAVAPEIIAAARDVQEKNEIYAPYNILPLDSAGASQSVMQLEEVKAAVAALGNTRGLNWPSGFEQHRKKTGNLDLLDWLRAMFGFQANNVRNQREHLVCLFADNHIRLTPKPEPLNKLDDRAVDTVMSKLFKNYKNWCKFLGRKHSLRLPQAAQDIQQRKILYMGLYLLIWGEAANIRFMPECLCYIFHNMAYELHGLLAGNVSIVTGENIKPSYGGDDEAFLRKVITPIYRVVQTEANKNANGKAAHSDWSNYDDLNEYFWTPDCFSLGWPMRDDGDLFKSTRDTTQGKKGSFRKAGRTGKSNFTETRTFWHIYHSFDRLWTFYLLALQAMIILAFERVELREILRKDVLYALSSIFITAAFLRFLQSVLDVILNFPGFHRWKFTDVLRNILKIVVSLAWCVVLPLCYAQSVSFAPGKLKQWLSFLPQVKGVPPLYIMAVALYLLPNVLAAIMFIFPMLRRWIENSDWHIFRLLLWWSQPRIYVGRGMHESQIALIKYTIFWLLLFCCKFAFSYFLQVKLLVKPTNAIMSIRHVKYKWHEFFPNAEHNYGAVVSLWLPVILVYFMDTQIWYAIFSTICGGVIGAFDRLGEIRTLGMLRSRFQSLPGAFNTYLVPSDKTRRRGFSLSKRFAEVTAARRTEAAKFSQLWNEIISSFREEDLISDREMDLLLVPYTSDPSLKLIQWPPFLLASKIPIALDMAAQFRTRDSDLWKRICADEYMKCAVIECYESFKHVLHTLVIGENEKRIIGIIIKEVESNISKNSFLSNFRMAPLPALCSKFVELVGILVSEQHPCLIIGIDLRLKNADPAKRDTVVLLLQDMLEVVTRDMMQNENRELVELGHTNKESGRQLFAGTDAKPAILFPPVATAQWHEQISRLHLLLTVKESAMDVPTNLEAQRRIAFFTNSLFMDMPRAPRVRNMLSFSVLTPYYSEETVYSKNDLEMENEDGVSVVYYLQKIFPDEWTNFLERLDCKDETSVLESEENILQLRHWVSLRGQTLFRTVRGMMYYRRALKLQAFLDMANETEILAGYKAISEPTEEDKKSQRSLYTQLEAVADLKFTYVATCQNYGNQKRSGDRRATDILNLMVNNPSLRVAYIDEVEEREGGKVQKVFYSVLIKAVDNLDQEIYRIKLPGPAKIGEGKPENQNHALIFTRGEALQAIDMNQDHYLEEALKMRNLLEEFNEDHGVRAPTILGFREHIFTGSVSSLAWFMSNQETSFVTIGQRVLASPLKVRFHYGHPDVFDRIFHITRGGISKASRGINLSEDIFAGFNSTLRRGNVTHHEYIQVGKGRDVGLNQISLFEAKVACGNGEQTLSRDLYRLGHRFDFFRMMSCYFTTVGFYISSMIVVLTVYAFLYGRLYLSLSGVEEAIVKFAAAKGDSSLKAAMASQSVVQLGLLMTLPMVMEIGLERGFRTALSDLIIMQLQLAPVFFTFSLGTKVHYYGRTILHGGSKYRATGRGFVVKHEKFAENYRMYSRSHFVKGMELMVLLICYRIYGKAAEDSVGYALVMGSTWFLVGSWLFAPFFFNPSGFEWQKIVDDWDDWNKWISSRGGIGVPANKSWESWWEEEQEHLLHSGFFGKFWEIFLSLRYFIYQYGIVYQLNLTKESRMGKQHSIIVYGLSWLVIVAVMIVLKIVSMGRKKFSADFQLMFRLLKLFLFIGSVVIVGMLFHFLKLTVGDIMQSLLAFLPTGWALLQISQVARPLMKTVGMWGSVKALARGYEYIMGVVIFMPVTVLAWFPFVSEFQTRLLFNQAFSRGLQIQRILAGGKKQK

SEQ ID NO: 14768 - protein, 144 aa, Arabidopsis thaliana
  misc_feature: Useful for making plants with altered cell wall content and/or composition
MASEDESIEQKAAARKEALKALRAAQELSETKEDGEDEAVEEDGPAMKFRNYVPQAKELQDGKLAPPELPKFEDPIVALPPAVEKKEDPFVNIAPKKPNWDLRRDVQKKLDKLERRTQKAMHKLMEEQEKEREMAEADGNTIES

SEQ ID NO: 14769 - protein, 190 aa, Zea mays
  misc_feature: Useful for making plants with altered alkaloid content
MIRTATVRARLLLSRSYVAQAKAASRWPLVRWKASHLGSVRSFYQMDITRQYKNKILTARGCHSSPESQELAMKSCVPCNSKDLGPMSEDSAKKLLEQVNGWELITEGGVLKLHRTWKVKNFVKGLEFFQLVAAIAEEEGHHPDLHLVGWNNVKIDVWTHSVRGLTSNDFILAAKINHLTLDGIIRKKAK

SEQ ID NO: 14770 - DNA, 1140 bp, Sorghum bicolor
  misc_feature: Ceres ANNOT ID no. 8631464
  misc_feature: Encodes the peptide sequence at SEQ ID NO 14771
atggtgcagcaggcgtcgcttggtgagccgctgctgctccagccgccgccgccgtccctggtgttcgacgccgcccgtctgagcggtctgtccgacatcccgcagcaatttctgtggcccgccgacgagagccccaccccggacgccgccgaggagctggccgtgccgctcatcgacctctccggggacgccgccgaggtggtccgccaggtgcgccgcgcctgcgacctgcacggcttcttccaggtggtgaaccacggcatcgacgacgcgctcctgcaggaggcgcaccgctgcatggacgccttcttcacgctccccatgtccgacaagcagcgcgcgcagcgccgtcagggggacagctgcggatacgccagcagcttcacgggccgcttcgcgtccaagctgccatggaaggagacgctgtcgttccgctactccgacgaccagggcgacggcgacgtcgtcgtggactacttcgtcgacaagctgggcgatgcgtaccgtcaccacggggaggtgtacggccgctactgctccgagatgagccggctgtcgctggagctgatggaggtgctcggggagagcctcggcgtgggccgccgccacttccgccgcttcttccaggggaacgactccatcatgcgcctcaactactacccgccgtgccagcggccctacgacacgctgggcaccggaccgcattgcgaccccacctccctcaccatcctccaccaggacgacgtcggaggcctccaggtgttcgacgccgccaccggccccggcaccggccgctggcgctccatcaggccccacccgggcgccttcgtcgtcaacatcggcgacaccttcatggcgctctccaacggacgctacaggagctgcctgcaccgcgccgtcgtcaacagccgggtgccccgccgctcgctcgccttcttcctgtgcccggagatggacaaggtggtgcgcccgcccgccgagctggtggacgacgccaacccgagggcgtacccggacttcacgtggcggacgctgctcgacttcaccatgaggcactacaggtccgacatgaggacgctcgaggcattctccaactggctcaaccatggcggacacctctcatcaccacctcctccatga

SEQ ID NO: 14771 - protein, 379 aa, Sorghum bicolor
  misc_feature: Useful for making plants with modulated biotic stress sensitivity
  misc_feature: Useful for making plants with modulated flowering time
  misc_feature: Functional homolog of the protein sequence given in SEQ ID NO 14066
  misc_feature: Useful for making plants with modulated biomass
  misc_feature: Functional homolog of the protein sequence given in SEQ ID NO 14067
  misc_feature: Ceres ANNOT ID no. 8631464
  misc_feature (28)..(353): SWISSPROT Homolog: EC 1.14.11.15 Gibberellin 3-beta-dioxygenase
  misc_feature (211)..(316): Pfam ID: 2OG-FeII_Oxy Pfam Description: 2OG-Fe(II) oxygenase superfamily
MVQQASLGEPLLLQPPPPSLVFDAARLSGLSDIPQQFLWPADESPTPDAAEELAVPLIDLSGDAAEVVRQVRRACDLHGFFQVVNHGIDDALLQEAHRCMDAFFTLPMSDKQRAQRRQGDSCGYASSFTGRFASKLPWKETLSFRYSDDQGDGDVVVDYFVDKLGDAYRHHGEVYGRYCSEMSRLSLELMEVLGESLGVGRRHFRRFFQGNDSIMRLNYYPPCQRPYDTLGTGPHCDPTSLTILHQDDVGGLQVFDAATGPGTGRWRSIRPHPGAFVVNIGDTFMALSNGRYRSCLHRAVVNSRVPRRSLAFFLCPEMDKVVRPPAELVDDANPRAYPDFTWRTLLDFTMRHYRSDMRTLEAFSNWLNHGGHLSSPPPP

SEQ ID NO: 14772 - DNA, 1023 bp, Sorghum bicolor
  misc_feature: Ceres ANNOT ID no. 8631513
  misc_feature: Encodes the peptide sequence at SEQ ID NO 14773
atggcgtctagctgctggcagcggcatctggttctggtcgtcgtcgtcgtcgtcgtcgtcgtcatgatggtgatcatggacatggcgacggcacttgcagcggcgctggatcaggacgaccccgtcgccgtcgtcggcgtggggttctcgcctctgttcggggaggccaacatgcatggagcgctgtccaacggcgacgtgttcgacaagacgcacgacgaactggacttggaattcctaggcaaccggcggcgccacgagtggcgtctccagaccaacgtgtacggcaacggcagcacggaccgcgggcgcgaggagcggtacctgatgcccttcgacccgacggcggcggcgcaccgcttctccatcctctggtcctcccgcgccgtcatcttctacgtggacggcgtggccatccgcgaggtaccccgctcggccgccatggcgggggactacccgtccaagcccatggccgtgtacgccaccatctgggacggatccacctgggccaccgacaacggccggtacaaggtgaactaccgccggggtcccttcacggccgagttctcgggactggtgatccgcggttgccccgccgtcggcaacggcggcggcgaccacgtggcgatgctgcggctgcagctgggagccgctaacaaccacgaccgggacgcctgcgccggcgctgagttcgagctcatgacggccgactgcgccatcatgacgccgcggaagcgggcggacatgcggcggtggcgccggcgccagatgctctacacggtgtgctacgacaccaaccggtacccggcggcgttccccgagtgcgacgtggacgccgcggaggcggagcggcagatgttctgggagtggggcgagtccaaggtcgtccgcggccgcgcgcggccgttccgggggcaagcgccgccagcaggtcgcggccgggaccactacgacgacgccggcgccgcggctggtgtcactgcagcaggccgactgattgatctccacctccaactccactga

SEQ ID NO: 14773 - protein, 340 aa, Sorghum bicolor
  misc_feature: Useful for making plants with altered carbohydrate content
  misc_feature: Functional homolog of the protein sequence given in SEQ ID NO 14068
  misc_feature: Useful for making plants with altered cell wall content and/or composition
  misc_feature: Functional homolog of the protein sequence given in SEQ ID NO 14069
  misc_feature: Ceres ANNOT ID no. 8631513
  misc_feature (63)..(208): SWISSPROT Homolog: EC 2.4.1.207 Xyloglucan:xyloglucosyl transferase
  misc_feature (11)..(182): Pfam ID: Glyco_hydro_16 Pfam Description: Glycosyl hydrolases family 16
  misc_feature (226)..(275): Pfam ID: XET_C Pfam Description: Xyloglucan endo-transglycosylase (XET) C-terminus
MASSCWQRHLVLVVVVVVVVVMMVIMDMATALAAALDQDDPVAVVGVGFSPLFGEANMHGALSNGDVFDKTHDELDLEFLGNRRRHEWRLQTNVYGNGSTDRGREERYLMPFDPTAAAHRFSILWSSRAVIFYVDGVAIREVPRSAAMAGDYPSKPMAVYATIWDGSTWATDNGRYKVNYRRGPFTAEFSGLVIRGCPAVGNGGGDHVAMLRLQLGAANNHDRDACAGAEFELMTADCAIMTPRKRADMRRWRRRQMLYTVCYDTNRYPAAFPECDVDAAEAERQMFWEWGESKVVRGRARPFRGQAPPAGRGRDHYDDAGAAAGVTAAGRLIDLHLQLH

SEQ ID NO: 14774 - DNA, 1584 bp, Sorghum bicolor
  misc_feature: Ceres ANNOT ID no. 8631517
  misc_feature: Encodes the peptide sequence at SEQ ID NO 14775
atgcagggcggtgtcgtggcccacgccgccgccgccgcggcggccgcgtcgacggtgaccactgcggtggcgcctccggtgccggcgcacgcggcggtggtgggaaacggcggcgggccggcggccgccgcgccgccgccaccgttccttatgaagacgtacgagatggtggacgacccggccaccgacgacgtcgtgtcctggggccccgggaacaacagcttcatcgtctggaacacgcccgagttcgccagggacctcctgcccaagtacttcaagcacagcaacttctcatcattcgtcaggcagctcaacacctacgggtttagaaaggttgatccagacagatgggaatttgcaaatgagggttttcttagaggacaaaaacatctgctgaagactatcaacagaaggaaaccatccttgcaggggaacagccaaccacagcaacctcagttgcagaatgctcctgtgccttcctgtgtagaggtgggcaagtttgggttggaggaagagatagaacggctgaaaagggataagaatgttcttatgcaagagcttgtcaggctgagacagcaacagcaaacaactgaccatcagcttcagactttgggcaagcgtcttcaagggatggagtcacggcagcaacagatgatgtctttcctggctaaggcaatgcaaagtcctggtttcctagcacagtttgtacagcaaaacgagaatagtagaagaagaatagtagctgcgaacaagaaaaggcggctacccaagcaagatggtggcctagactctgaaagtgctgctgcttcgttagacggtcaaattatcaagtatcaacctttgatcaacgaagcagccaaagcaatgctaaggaagatcctaaagctagattcttcgcataggtttgaatctatgggcaattcagataataataattttctgctggagaattatatgccagctgctcaagcttttgagagctcttcgtcaacaagaaattctggggtcacccttgcagaggttccagctaactcgggcttgccctatgtcagcgcaagctctggactgtcagctatctgttctccttcagtggctcctgaaatccagtgcccagttgtgctggacaacaagttgtctaaccaagtgcccaacatgagtgctgtgcctcctgtttcaaaccctataacagcaggctcaagtgacatcagcattccggaattctcagatctggcggacttggtaaacgaagactctgtcaatattcctggaggggcctttgagatgcctggtcctgagtttcccctgccagaaggtgatgacagtgtccccatcgagactgatgagaccatgtacaacaatgacgagactcagagccttccaggcatcatcgactccttctgggagcagttcctggtaggcagccctctatccgccgataatgatgaagttgattcaggcggactagatgcaaggggttcaccacaggagaatgggtggagcaaagtggggaacatctccaatcttacagaacagatgggccttctatcatcaacaaatcaccgggactcagggaatgggctgtaa

SEQ ID NO: 14775 - protein, 527 aa, Sorghum bicolor
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: The sequence is a functional homolog of SEQ ID NO 2203 in the 10/666,642 US patent application
  misc_feature: The sequence is a functional homolog of SEQ ID NO 2205 in the 10/666,642 US patent application
  misc_feature: The sequence is a functional homolog of SEQ ID NO 2207 in the 10/666,642 US patent application
  misc_feature: The sequence is a functional homolog of SEQ ID NO 142 in the 10/666,642 US patent application
  misc_feature: Useful for making plants with modulated heat sensitivity
  misc_feature: The sequence is a functional homolog of SEQ ID NO 1418 in the 10/666,642 US patent application
  misc_feature: Useful for making plants with modulated biomass
  misc_feature: Functional homolog of the protein sequence given in SEQ ID NO 13700
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: The sequence is a functional homolog of SEQ ID NO 1686 in the 10/412,699 US patent application
  misc_feature: The sequence is a functional homolog of SEQ ID NO 1687 in the 10/412,699 US patent application
  misc_feature: Ceres ANNOT ID no. 8631517
  misc_feature: Up-regulated in root tissues in response to salicylic acid treatment
  misc_feature (47)..(222): Pfam ID: HSF_DNA-bind Pfam Description: HSF-type DNA-binding
MQGGVVAHAAAAAAAASTVTTAVAPPVPAHAAVVGNGGGPAAAAPPPPFLMKTYEMVDDPATDDVVSWGPGNNSFIVWNTPEFARDLLPKYFKHSNFSSFVRQLNTYGFRKVDPDRWEFANEGFLRGQKHLLKTINRRKPSLQGNSQPQQPQLQNAPVPSCVEVGKFGLEEEIERLKRDKNVLMQELVRLRQQQQTTDHQLQTLGKRLQGMESRQQQMMSFLAKAMQSPGFLAQFVQQNENSRRRIVAANKKRRLPKQDGGLDSESAAASLDGQIIKYQPLINEAAKAMLRKILKLDSSHRFESMGNSDNNNFLLENYMPAAQAFESSSSTRNSGVTLAEVPANSGLPYVSASSGLSAICSPSVAPEIQCPVVLDNKLSNQVPNMSAVPPVSNPITAGSSDISIPEFSDLADLVNEDSVNIPGGAFEMPGPEFPLPEGDDSVPIETDETMYNNDETQSLPGIIDSFWEQFLVGSPLSADNDEVDSGGLDARGSPQENGWSKVGNISNLTEQMGLLSSTNHRDSGNGL

SEQ ID NO: 14776 - DNA, 1056 bp, Sorghum bicolor
  misc_feature: Ceres ANNOT ID no. 8631564
  misc_feature: Up-regulated in root tissues in response to salicylic acid treatment
  misc_feature: Encodes the peptide sequence at SEQ ID NO 14777
atggctgcgcaagaggagaagactgctactgctgtcaccacagaggagcctgcaccggcggcggagcctcagcctaagccagctgcggcggcgcgcagggcagggccgtcggcgtcggccaaccccttcgacttctccaccatgatgaaccttctcaatgaccctagcatcaaggaaatggcggagcagatcgccaaggacccggcgttcacggagatggcggagcagctgcagaagacggtggtgtccccgcggcagcggcagcagcagcaggcggcttcggcggcggcggcggcgcagctggacccgcagaagtacgtggcgacgatgcagcagctgatgcagaacccgcagttcgtggccatggcggagcggctgggcagcgcgctgatgcaggatcccgccgtgtccaccatgctggggggcctcaccaacccggcgcacaaggagcagctggaggcccgcgtcgcgcgcatgaaggatgatcccgacctcaagcccatcctcgacgagatcgagtccggcggccccgccgccatgatgaagtactggaacgaccccgaggctctgcagaagttcggccgcgcgatgggtgtcggcggcggcccgtccggcgaggccggcggcgcggagcacgccgaggcggaggacgacgccggggaggaaggcgagtacgaggacgagtccatcgtccaccacacggcgagcatcggcgacgtcgagggcctgaagaaagcgctggaggatggcgcggacaaggacgaggaggactcggaagggcggcgtggcctccacttcgcttgcggctacggcgagctccagtgcgcgcaggcactcctggaggccggcgccgcggtggacgccgtcgacaagaacaagaacaccgcgctgcactacgccgccggatacggccgcaaggactgcgtcgcgctcctgctcgagagcggcgccgccgtgacgctgcagaacctggacgggaagacgcccatcgacgtggccaagctcaacaaccaggacgacgtcctcaagctgctggagaagcacgccttcgtatag

SEQ ID NO: 14777 - protein, 351 aa, Sorghum bicolor
  misc_feature: The sequence is a functional homolog of SEQ ID NO 1839 in the 10/374,780 US patent application
  misc_feature: Ceres ANNOT ID no. 8631564
  misc_feature (231)..(349): SWISSPROT Homolog: EC 2.4.2.30 NAD(+) ADP-ribosyltransferase
  misc_feature (292)..(324): Pfam ID: Ank Pfam Description: Ankyrin repeat
  misc_feature (259)..(291): Pfam ID: Ank Pfam Description: Ankyrin repeat
MAAQEEKTATAVTTEEPAPAAEPQPKPAAAARRAGPSASANPFDFSTMMNLLNDPSIKEMAEQIAKDPAFTEMAEQLQKTVVSPRQRQQQQAASAAAAAQLDPQKYVATMQQLMQNPQFVAMAERLGSALMQDPAVSTMLGGLTNPAHKEQLEARVARMKDDPDLKPILDEIESGGPAAMMKYWNDPEALQKFGRAMGVGGGPSGEAGGAEHAEAEDDAGEEGEYEDESIVHHTASIGDVEGLKKALEDGADKDEEDSEGRRGLHFACGYGELQCAQALLEAGAAVDAVDKNKNTALHYAAGYGRKDCVALLLESGAAVTLQNLDGKTPIDVAKLNNQDDVLKLLEKHAFV

SEQ ID NO: 14778 - DNA, 1113 bp, Sorghum bicolor
  misc_feature: Ceres ANNOT ID no. 8631617
  misc_feature: Encodes the peptide sequence at SEQ ID NO 14779
atgagcagcgtcagcccgctggtgtccttcgtgctgggcgccgccatggccaccgtctgcgtcctcttcttcatgtccgccacgcccgcgcgccgcctcgtcgacatctccgccttcacctccgccgcccccgacaacctgacggggatcgcctcctccgtctccgactccgactccgacgccgcggtcgccgactcggccgccgcccttgcctccaccgccaccctggcgccggctcccgcgcccgtccaggccccgtcgccgtggggcgacctggaggaggtgctggcgcgcgcggcgaccaaggaccggacggtgatcatgacgcagatcaacgcggcgtggacgcgcccgggctccctgctcgacctcttcttcgagagcttccgcaccggggagggcggcgtggcgcgcctcctggaccacctcgtcatcgtcaccatggaccccgccgcctacgagggctgcaaggccgtccaccgccactgctacttcctccgcacctccaatggcgtcgactaccgatccgagaagatgttcatgagcaaggactacctcgagatgatgtggggacgcaaccgcttccagcagacggtgctcgagctcggctacaacttcctcttcacggacgtggacgtgatgtggttccgtgacccgttccgtcacatctcgatggcggcggacatcgccatctccagcgacgtgtacatcggcgacccctacagcctgcgcaacttccccaacggcggcttcctcttcgtgcggtcgtcggccaagaccatcgacttctaccgggcgtggcagcaggggcggtggcgcttcttggggaagcacgagcaggacgtgttcaacctcatcaagcacgagatggcgcccaagctggacctcgccatccagttcctcgacaccgcctacatcagcggcttctgccagctcagcaaggacctcaacaagatctgcaccctccacgccaactgctgcgtcggactcggcgccaagctccacgacctccgcggggtgctcgacgtctggaggaactacaccgccggcacacccgacgagcgccgcgcaggcaagttccagtggaagctcccgggcatctgcatccactga

SEQ ID NO: 14779 - protein, 370 aa, Sorghum bicolor
  misc_feature: Useful for making plants with altered carbohydrate content
  misc_feature: Functional homolog of the protein sequence given in SEQ ID NO 14070
  misc_feature: Useful for making plants with modulated biomass
  misc_feature: Functional homolog of the protein sequence given in SEQ ID NO 13568
  misc_feature: Ceres ANNOT ID no. 8631617
MSSVSPLVSFVLGAAMATVCVLFFMSATPARRLVDISAFTSAAPDNLTGIASSVSDSDSDAAVADSAAALASTATLAPAPAPVQAPSPWGDLEEVLARAATKDRTVIMTQINAAWTRPGSLLDLFFESFRTGEGGVARLLDHLVIVTMDPAAYEGCKAVHRHCYFLRTSNGVDYRSEKMFMSKDYLEMMWGRNRFQQTVLELGYNFLFTDVDVMWFRDPFRHISMAADIAISSDVYIGDPYSLRNFPNGGFLFVRSSAKTIDFYRAWQQGRWRFLGKHEQDVFNLIKHEMAPKLDLAIQFLDTAYISGFCQLSKDLNKICTLHANCCVGLGAKLHDLRGVLDVWRNYTAGTPDERRAGKFQWKLPGICIH

SEQ ID NO: 14780 - DNA, 1272 bp, Sorghum bicolor
  misc_feature: Ceres ANNOT ID no. 8631616
  misc_feature: Encodes the peptide sequence at SEQ ID NO 14781
atggcgaagcagcagcagcagcagcagcaagtctccgccggcgcggaggccacgggccggcaggcggcgtcgttcctgctcggctgcgtcgccgcgctcaccgtcgtcctgctcctgcagcgccgccccgaggagctcaccagggcgccgatggtgcgattcttcggagggggaggggcacggacatcatcgtcgtcgtcgtcaccagcggcagcgtcgtcgccgtcctcctcctcttcctcttcaccaccagcggcaggtgaacatgcagcagcacatcttcagacgacgactgataacgccgccgcaaagccgccgccggctcctaccaccaccgccggtgatccacgacgccttccgccgcccaattccacgacccatcacggaaaagagccgggcgcggccgccggcgaggaggaagatgcagagttccgcgggctggcggcggtggtatcgcgcgcggcgacggcggacgaccggacggtgatcgtgacgtgcgtgaacgaggcgtgggcggcgcccgggtcgctgctggacctgttcctggagagcttccgcgtgggcgacggcacggcgccgctgctgcggcacgtgctgatcgtggccatggaccctgcggccatggcgcggtgccggacgctccaccgtcactgctaccactacgcgccgctgcccggcgtcgacttcgcctccgccaagttcttcctgtccaaggactacctggagctggtgtggagcaagctgaagctccagcgccgcgtgctccagctcggctacaccttcgtcttcaccgacgtcgacgtgctgtggttccggaacccgctgaagcacgtgacggcgtacgcggacatgagcgtctccagcgacgtcttcttcggcgacgcggacaacgtggacaacttccccaacacgggcttcttccacgtgaagccaaacaaccggacggtcgccatgacggcggcgtggcacgaggcgagggagaggttcccggggaagaacgagcagccggtgttcaacgccatcaagaaagggctcgtcgccgacctcgggctgcgcctgcagtacatcgacccggccttcgtcgccggcttctgcagctacggcaaggacctcggcaaggtgtgcaccatgcacgccaactgctgcgtcggcctgcgtaacaagctcgccgacctcaggaccgtgctggacgactggaggaactacaccgccatgccgcactgggccaggcaccaggctaagtggaccgtccccggagcatgcatccattga

SEQ ID NO: 14781 - protein, 423 aa, Sorghum bicolor
  misc_feature: Useful for making plants with altered carbohydrate content
  misc_feature: Functional homolog of the protein sequence given in SEQ ID NO 14071
  misc_feature: Ceres ANNOT ID no. 8631616
MAKQQQQQQQVSAGAEATGRQAASFLLGCVAALTVVLLLQRRPEELTRAPMVRFFGGGGARTSSSSSSPAAASSPSSSSSSSPPAAGEHAAAHLQTTTDNAAAKPPPAPTTTAGDPRRLPPPNSTTHHGKEPGAAAGEEEDAEFRGLAAVVSRAATADDRTVIVTCVNEAWAAPGSLLDLFLESFRVGDGTAPLLRHVLIVAMDPAAMARCRTLHRHCYHYAPLPGVDFASAKFFLSKDYLELVWSKLKLQRRVLQLGYTFVFTDVDVLWFRNPLKHVTAYADMSVSSDVFFGDADNVDNFPNTGFFHVKPNNRTVAMTAAWHEARERFPGKNEQPVFNAIKKGLVADLGLRLQYIDPAFVAGFCSYGKDLGKVCTMHANCCVGLRNKLADLRTVLDDWRNYTAMPHWARHQAKWTVPGACIH

SEQ ID NO: 14782 - DNA, 1446 bp, Sorghum bicolor
  misc_feature: Ceres ANNOT ID no. 8631641
  misc_feature: Encodes the peptide sequence at SEQ ID NO 14783
atggcaacgccgctgcacctcctcctcgtgctcgccgccatcgtcaccgcggcgacaccgtcgtgtgtagcagcagcagcatcatccgccgcttccacagccgagcacatcctgggcgtcaactacggcacgctgggcgacaacctcccgctgccgcagcgcgggctggagcttgcccgctcggcgggggcgtccgccgtccgcttctacgacgccaacgccaccatgctcgccgcggccgccgcctcggggctcgagttcgtgccgagcgtcccgaacgagctgatcccgtcgctcgccgcctcccagcgcgccgccgacgcctgggtggccaccacgctgctcccgttccgcggcaacccgcgcctccggtacctgttcgtcggcaacgaggtcctctccgaccccaccgccaggtcccggtggccgcggctcgtcccggccatggccaacgtccaccgcgcgctccaccgccacggcctcggcagcgtcaaggtcagcaccacgttcagcatgcacgagctggagggccagaacgtgttcccgccgtccgccggcgcgttcaggcccgacatcgccggcgccgtcgtccgcccgctgctcgccttcctggaccgcaccggctcgcccctcttcgtcgacgcgtacacctacttcacctggtcggcgaaccacaccgtggtgccgctgccgtacgcgctgctggcgccggcgtccgggtacgtgtaccgcgaccccgggacggggctgtcgtacaccaacctgctggaccagatgctcgacgcggtggtggccgccatgtgccgcgcgggccactgcggcgtcgggctggcgctggccgagaccgggtggccgacggcgggggacctggaccagttcggcgccaacgtgcggaacgcggccacgtacaaccggaacctggcgcggcacctggcgtcaggcgccggcacgccgcggcggccgcgggcgcgcgtagcgccggcgatggtgttcgcgctgttcaacgaggacctcaagtgggggccaggcacggagcggcactggggcctgttctaccccaacggcagcgcggtgtacgaggtggacctcacgggccggcgccggtcgctgccgtcgtacccgccgctgccgccggcgtcgaacgaccggccgtacccgggccccctatggtgcgtggtggcgacggacaagggaccggtgaacgagaccgcggtgagggcgcaggtggcggcggcgtgcgccgacgtgccggggttgtgcgaccccgtgcggccgggtggcgcgtgcttcctgccggacacggtgagcgcgcacgccagctacgtgttcagcgcgcactggaacaggttcagcgaggactacggcgggtgctacttcgccggcttcgccgtggagaccaccgtcgatcccagtcagtacctgcttccattttcctctgacatatag

SEQ ID NO: 14783 - protein, 481 aa, Sorghum bicolor
  misc_feature: Useful for making plants with altered carbohydrate content
  misc_feature: Functional homolog of the protein sequence given in SEQ ID NO 14072
  misc_feature: Ceres ANNOT ID no. 8631641
  misc_feature (36)..(471): SWISSPROT Homolog: EC 3.2.1.39 Glucan endo-1,3-beta-D-glucosidase
  misc_feature (38)..(363): Pfam ID: Glyco_hydro_17 Pfam Description: Glycosyl hydrolases family 17
  misc_feature (389)..(473): Pfam ID: X8 Pfam Description: X8 domain
MATPLHLLLVLAAIVTAATPSCVAAAASSAASTAEHILGVNYGTLGDNLPLPQRGLELARSAGASAVRFYDANATMLAAAAASGLEFVPSVPNELIPSLAASQRAADAWVATTLLPFRGNPRLRYLFVGNEVLSDPTARSRWPRLVPAMANVHRALHRHGLGSVKVSTTFSMHELEGQNVFPPSAGAFRPDIAGAVVRPLLAFLDRTGSPLFVDAYTYFTWSANHTVVPLPYALLAPASGYVYRDPGTGLSYTNLLDQMLDAVVAAMCRAGHCGVGLALAETGWPTAGDLDQFGANVRNAATYNRNLARHLASGAGTPRRPRARVAPAMVFALFNEDLKWGPGTERHWGLFYPNGSAVYEVDLTGRRRSLPSYPPLPPASNDRPYPGPLWCVVATDKGPVNETAVRAQVAAACADVPGLCDPVRPGGACFLPDTVSAHASYVFSAHWNRFSEDYGGCYFAGFAVETTVDPSQYLLPFSSDI

SEQ ID NO: 14784 - DNA, 711 bp, Sorghum bicolor
  misc_feature: Ceres ANNOT ID no. 8631678
  misc_feature: Encodes the peptide sequence at SEQ ID NO 14785
atgtcggggcggcggccggcgacgtgggagcagcaggccgccgacgactacgactacctgttcaaggtggtgctggtgggcgactccggcgtgggcaagtccaacctcctctctcgcttcacccgcaacaccttctccctcgactccaagtccaccatcggcgtcgagttcgccacccgcaccatccaggtggacgggaagacgatcaaggcgcagatctgggacacggcggggcaagagcggtaccgcgccgtaaccagcgcctactaccggggcgcggtgggggcgctgctggtgtacgacgtgaccaagtccgccacgttcggcaacgcggcgcggtggctccgcgagctccgggaccacgccgacggccgcggcaccgccgtcatgctcgtcggcaacaagaccgacctcgcgaagcagcgcggcggcctccgcgccgtgccccgcggggacggcgccgcgctcgcggagcgggaagggctctcgttcgtcgagacctccgcgctcgacgccaccaacgtcgacgccgcgttcgtgaccctgctcaccgagatctaccgcgccgtcagaaggaaggcgctggccgccgccgcggcggataataaggaggacgacgaggtggcggccgcggtcggggaggggcaggtgatccaggtgtcgtcgcccggcgactcccgcggcctcacgacgcggtgctgcgcgttctag

SEQ ID NO: 14785 - protein, 236 aa, Sorghum bicolor
  misc_feature: Useful for making plants with altered lignin content
  misc_feature: Functional homolog of the protein sequence given in SEQ ID NO 13076
  misc_feature: Useful for making plants with altered terpenoid content
  misc_feature: Functional homolog of the protein sequence given in SEQ ID NO 13157
  misc_feature: Useful for making plants with altered alkaloid content
  misc_feature: Functional homolog of the protein sequence given in SEQ ID NO 13220
  misc_feature: Useful for making plants with modulated oxidative stress sensitivity
  misc_feature: Functional homolog of the protein sequence given in SEQ ID NO 13074
  misc_feature: Ceres ANNOT ID no. 8631678
  misc_feature (22)..(142): SWISSPROT Homolog: EC 2.7.11.1 Non-specific serine/threonine protein kinase
  misc_feature (22)..(188): Pfam ID: Ras Pfam Description: Ras family
  misc_feature (22)..(137): Pfam ID: Miro Pfam Description: Miro-like protein
MSGRRPATWEQQAADDYDYLFKVVLVGDSGVGKSNLLSRFTRNTFSLDSKSTIGVEFATRTIQVDGKTIKAQIWDTAGQERYRAVTSAYYRGAVGALLVYDVTKSATFGNAARWLRELRDHADGRGTAVMLVGNKTDLAKQRGGLRAVPRGDGAALAEREGLSFVETSALDATNVDAAFVTLLTEIYRAVRRKALAAAAADNKEDDEVAAAVGEGQVIQVSSPGDSRGLTTRCCAF

SEQ ID NO: 14786 - DNA, 1281 bp, Sorghum bicolor
  misc_feature: Ceres ANNOT ID no. 8631687
  misc_feature: Encodes the peptide sequence at SEQ ID NO 14787
atggcatattctggacagaggcatggtggtgttgggagctcctcgaggccagggaatggtttcaagggggcagccaactcggtggagtttctgggtagggagatgctgggaatgcaactgagggatgccaagcccgatacagatgatgaaagggagatgggatcaagttcagatgtgactgatagttctagtaatgaagctggtcatgtaatagcgactacaattcgtgggcacaacggcctgcctaaacagtctgtcacatacatcgctgaacatgtggttggaactggttcttttggggttgtatatcaggcaaaatgccgagaaacaggagaaattgttgccataaaaaaggttcttcaagataagcgttataagaacagagagctgcaaatcatgcatatgcttgaccatcctaacatcatcggtcttaagcattacttcttttcaacaactgaaagggacgagctttatctcaatcttgttcttgagtttgttccagagacagtaaacaggattgcaaggcagtacaaccgaatgaatcagcggatgcccctcatttttgtcaaactgtacacgtaccagatatgtcgagcgcttgcttatatacataactgcattggcatatgccaccgtgatatcaaaccgcagaatgttcttgttaacccacatacacaccaactcaaaatttgcgattttggaagtgctaaagtattggtcagaggagagccaaacatctcctacatatgctcaaggtattaccgagcaccagagctcatatttggggcaacggaatatactactgctattgatttgtggtcagcaggctgtgtcatggcagagctgcttctaggacagcctctgtttcctggagaaagtggagtcgaccaactagttgagatcatcaaggttttgggtactccaacaagggaagagatcaagtgcatgaacccaaactacacggagttcaagttcccacaaattaaagctcatccgtggcacaaggtttttcaaagaaggcttccgcctgaagcagtggatcttgttagcaggtttctacagtactcaccaaatctacggtgcactgctttggaagcctgtatgcaccctttctttgatgagctgagagacccaaacactcgtctaccgaatggtcggcctctgccgcctctcttcaacttcagatctcaagagctgaaaggtgttcccctagaagtcgtcgaacgccttgtcccagagcactcaagaaggcagagtttgttcatggcgctacggacctag

SEQ ID NO: 14787 - protein, 426 aa, Sorghum bicolor
  misc_feature: Useful for making plants with modulated water use efficiency
  misc_feature: Functional homolog of the protein sequence given in SEQ ID NO 14073
  misc_feature: Useful for making plants with modulated biomass
  misc_feature: Functional homolog of the protein sequence given in SEQ ID NO 14074
  misc_feature: Ceres ANNOT ID no. 8631687
  misc_feature (1)..(426): SWISSPROT Homolog: EC 2.7.11.1 Non-specific serine/threonine protein kinase
  misc_feature (88)..(372): Pfam ID: Pkinase Pfam Description: Protein kinase domain
MAYSGQRHGGVGSSSRPGNGFKGAANSVEFLGREMLGMQLRDAKPDTDDEREMGSSSDVTDSSSNEAGHVIATTIRGHNGLPKQSVTYIAEHVVGTGSFGVVYQAKCRETGEIVAIKKVLQDKRYKNRELQIMHMLDHPNIIGLKHYFFSTTERDELYLNLVLEFVPETVNRIARQYNRMNQRMPLIFVKLYTYQICRALAYIHNCIGICHRDIKPQNVLVNPHTHQLKICDFGSAKVLVRGEPNISYICSRYYRAPELIFGATEYTTAIDLWSAGCVMAELLLGQPLFPGESGVDQLVEIIKVLGTPTREEIKCMNPNYTEFKFPQIKAHPWHKVFQRRLPPEAVDLVSRFLQYSPNLRCTALEACMHPFFDELRDPNTRLPNGRPLPPLFNFRSQELKGVPLEVVERLVPEHSRRQSLFMALRT

SEQ ID NO: 14788 - DNA, 870 bp, Sorghum bicolor
  misc_feature: Ceres ANNOT ID no. 8631688
  misc_feature: Encodes the peptide sequence at SEQ ID NO 14789
atggacggcctcaagggagccaagttgccgagcgccccgaagggcgggagcgcgctcgtgaagttggcggtgctcggcggcgcgggtctctacgccgccctcaacagcttctacaacgtcgagggcggccaccgcgccatcgtcttcaaccgcctcgagggtatcaaggacaaggtgtaccccgaaggaactcacctgatgatcccgtggatcgagaggccgatcatctacgacgtccgcgcccgacccaacctcgtcgagagcacctccggaagccgcgacctccagatggtgagaattggtcttcgtgtccttactcggcccatgccagatcagctacctaaaatctacaggaacctgggggagaacttcaatgagagagttctgccttcaatcattcatgaaacactcaaagctgtggttgctcaatacaatgccagtcagctgattacacagagagaggccgtgagcagggagattaggaagatcctgactgagagggccaacaacttcaatattgctctggatgatgtgtccatcacaagcctcagctttggaaaagagtttactcatgctattgaagccaaacaggttgctgcacaagaagctgagcgtgccaagttcattgttgagaaggccgagcaggacaagcgcagtgcagttatcagggcacagggtgaggctaagagtgcagagctgattggtcaagccattgccaacaaccccgctttcctggctctgagacagattgaagcagccagggagatctcccacaccatagcggcctcaagcaacaaggtgttccttgattccagggaccttttgcttgggctccagcagttgaatgtggggggcaaacaaaagaagtga

SEQ ID NO: 14789 - protein, 289 aa, Sorghum bicolor
  misc_feature: Useful for making plants with modulated biomass
  misc_feature: Functional homolog of the protein sequence given in SEQ ID NO 14075
  misc_feature: Ceres ANNOT ID no. 8631688
  misc_feature: Down-regulated in root tissues in response to salicylic acid treatment
  misc_feature (38)..(217): Pfam ID: Band_7 Pfam Description: SPFH domain / Band 7 family
MDGLKGAKLPSAPKGGSALVKLAVLGGAGLYAALNSFYNVEGGHRAIVFNRLEGIKDKVYPEGTHLMIPWIERPIIYDVRARPNLVESTSGSRDLQMVRIGLRVLTRPMPDQLPKIYRNLGENFNERVLPSIIHETLKAVVAQYNASQLITQREAVSREIRKILTERANNFNIALDDVSITSLSFGKEFTHAIEAKQVAAQEAERAKFIVEKAEQDKRSAVIRAQGEAKSAELIGQAIANNPAFLALRQIEAAREISHTIAASSNKVFLDSRDLLLGLQQLNVGGKQKK

SEQ ID NO: 14790 - DNA, 810 bp, Sorghum bicolor
  misc_feature: Ceres ANNOT ID no. 8631711
  misc_feature: Down-regulated in root tissues in response to salicylic acid treatment
  misc_feature: Encodes the peptide sequence at SEQ ID NO 14791
atggcatcgccgtcaccggccgccgtgcctgcattagtgcattcaaatgctcttatgagagaaaaaactgctcaattgttaacagcgatccatggcctttggcagttcgataacggaaccgtgacaagcacgcgcttccttctgaatccccgtcgccatggcctccgcaccgacgccgccacccctcctcccagtgaccaacctggcctcggatcgtcctcggccaccaccggaggcttcgatgcgccgatcgccacgccggctttccggctcttcctgagccggctctccgactcggcgcggcgctcgctgtccgatcgccggccgtggggggagctcctcgaccgctcggcgttctcgaagccggactccgtctccgacgccacctcccgcctccgccgcgacctcgcctacttccgcgtcaactacgccgccgtggtcgccttcgcgctgggggcctccctcctagcgcaccccttctcgctcctcatcctcctgggcctcctcgccgcctggtgcttcctctacctcttccgcgcctccgaccagcccgtcgtcctcttcagccggaccttctccaaccgcgagacgctgctggggctcgtcggcgcctccttcgtcctgctcttcttcacctccgtcgcgtcactcatcatctccgggctgctcgtcggcggggccctcgtcgcggcgcacagcgcgttccgggtgcccgaggacctcttcttcgacgagcccaacgcggccaccggcaacagcgcggcccaagggctgctctcattccttggcgcacccggatctggggtttga

SEQ ID NO: 14791 - protein, 269 aa, Sorghum bicolor
  misc_feature: The sequence is a functional homolog of SEQ ID NO 2244 in the 10/374,780 US patent application
  misc_feature: The sequence is a functional homolog of SEQ ID NO 82 in the 10/412,699 US patent application
  misc_feature: The sequence is a functional homolog of SEQ ID NO 922 in the 10/225,066 US patent application
  misc_feature: Ceres ANNOT ID no. 8631711
  misc_feature (99)..(252): Pfam ID: PRA1 Pfam Description: PRA1 family protein
MASPSPAAVPALVHSNALMREKTAQLLTAIHGLWQFDNGTVTSTRFLLNPRRHGLRTDAATPPPSDQPGLGSSSATTGGFDAPIATPAFRLFLSRLSDSARRSLSDRRPWGELLDRSAFSKPDSVSDATSRLRRDLAYFRVNYAAVVAFALGASLLAHPFSLLILLGLLAAWCFLYLFRASDQPVVLFSRTFSNRETLLGLVGASFVLLFFTSVASLIISGLLVGGALVAAHSAFRVPEDLFFDEPNAATGNSAAQGLLSFLGAPGSGV

SEQ ID NO: 14792 - DNA, 1191 bp, Sorghum bicolor
  misc_feature: Ceres ANNOT ID no. 8631719
  misc_feature: Encodes the peptide sequence at SEQ ID NO 14793
atggaggtttgcaatcttggcaataatgccatggaggctcagcagcagcgcgagcagagccaagccgggggctgcaccgacgacgacccggcggcggtgctgacgtgcctcacattcctggagcagaagatcgcgcacctccgcgccatcatcggcgcggcgccgcgcccgccgcggcagatggtgtcggccgagctcagctgcatcgccgtgcagctcgtctccatctccaagagcctcgccgcgaccggtggcggcggggccgcggcggcggaccaggacgacggcgccgcccgatcgccggccccgaacgacggcgacagcgactcgtccgaccatgacctcctccacgccgaggacgactacggcgacggcgacggcgacagcgatggccgcatgccaccggccggctcctacgaggtgatcgagctcggcaaggaggagatcctggcgccgcacgtgcactcgtgcaaggtctgcggcaagggcttcaagcgcgacgccaacctgcgcatgcacatgcgcggccacggcgaggagtacaagacggcggcggcgctcgccaagcccgcctccgcgccgtcgtcctcgctggcccggtgcttctactcctgccccttcgtcgggtgcaagcgcaacagggagcaccggagcttccagccgctcaagacggccgtctgcgtcaagaaccactaccgccggagccactgcgacaagagctacacctgccgccggtgcaacgtcaagcgcttctccgtgctcgccgacctgcgcacgcacgagaagcactgcggccgcgaccgatgggtctgctcctgtggcacctccttctccaggaaggacaagctcttcggccacgtcgccgccttcgacggccacgcgcccgcgctgccaccggaggacgacgacgctgttaccaatgctgtcggcctcggaactggctctggtcgcctgacgacgatggacaccgaggcagtgagcagaatggcgagcatggagttcttcccggacgccgtgctcgatggtctcgtctgttctgacatcaagggcttcgcgctcatggatggtggacaaggacaatatctggaggacgacgacggacgagggtcgctctcaccattgccaatggggctcgattcctgtgattttgatggatttgatctctttggggcaccagcaattgatttctga

SEQ ID NO: 14793 - protein, 396 aa, Sorghum bicolor
  misc_feature: The sequence is a functional homolog of SEQ ID NO 552 in the 10/666,642 US patent application
  misc_feature: Ceres ANNOT ID no. 8631719
  misc_feature (155)..(177): Pfam ID: zf-C2H2 Pfam Description: Zinc finger, C2H2 type
MEVCNLGNNAMEAQQQREQSQAGGCTDDDPAAVLTCLTFLEQKIAHLRAIIGAAPRPPRQMVSAELSCIAVQLVSISKSLAATGGGGAAAADQDDGAARSPAPNDGDSDSSDHDLLHAEDDYGDGDGDSDGRMPPAGSYEVIELGKEEILAPHVHSCKVCGKGFKRDANLRMHMRGHGEEYKTAAALAKPASAPSSSLARCFYSCPFVGCKRNREHRSFQPLKTAVCVKNHYRRSHCDKSYTCRRCNVKRFSVLADLRTHEKHCGRDRWVCSCGTSFSRKDKLFGHVAAFDGHAPALPPEDDDAVTNAVGLGTGSGRLTTMDTEAVSRMASMEFFPDAVLDGLVCSDIKGFALMDGGQGQYLEDDDGRGSLSPLPMGLDSCDFDGFDLFGAPAIDF

SEQ ID NO: 14794 - DNA, 1254 bp, Sorghum bicolor
  misc_feature: Ceres ANNOT ID no. 8631736
  misc_feature: Encodes the peptide sequence at SEQ ID NO 14795
atggcagcgccgccagcgctcgcgcgtgagctgctggacgaggcgcgggcgccggggttcgcggagtggcagcgcggcgtgcggcgccggatccaccagcacccggagctggcgttccaggagcaccgcaccagcgcgctcgtgcgcgccgagctcgacgcgataggcgtcccgtatgtgtggcccgtcgcgcagacgggcgtcgtggccaccatcgccggccccgccgcggccgggggggccgtgttcgcgctccgcgccgacatggacgcgcttcccatccaggaaatggtagaatgggagttcaagagcaaggaagacggaaagatgcatgcatgtggccatgacgcccatgtggcgatgcttctcggagcagctaagctgcttcagtctcggaggcgcaatttgaagggtacagtgaagcttgtcttccagccggcggaggagggccacgccggcggctaccatgtcctcaaagaaggcgtcctggacgacgtgcaggccatcttcgccgtgcacgtggacacgggactgcccgtgggcctggtcggctccaggccagggccggtcctcgccggagcggctcggttcacggcgaccatcacggggaaaggcgggcacgcggcggggccacagcatgtcgtcgacccgatcgtcgcggcgtcctccgccgtcctcagcctccagcagctcgttgctcgcgaaaccgatccgctacaaggcgcagttgtgtcggtgaccttcatcaaaggaggcgaagctttcaatgtcatcccggaatccgtcaccatgggcggcaccttcaggagcatgacgaacgatggcctatcctatctcatgaagagaatcagagaggtgatagaaggacaagccgccgtgagccggtgcgccgcaacggtggacttcatggaggagaagatgaggccgtacccggccacggtgaacgacgaggagatgtacgcccacgccaaggcggtggccgagagcatgctgggcgaggccaacgtgaaggtgcggccgcaggtcatggcggcggaggacttcggcttctacgcgcagaagatcccggctgccttcttcagcgtcggcgtccgcgacgaggggacggggaaggtccaccacgtgcactcgccgcacctccagatcgacgagggcgcgctccccgtcggagccgcgctccacgccgccgtggccatggagtacctgaacaaacacgtctcgccggcggcgagcgaggcccaggcgcccagctag

SEQ ID NO: 14795 - protein, 417 aa, Sorghum bicolor
  misc_feature: Useful for making plants with modulated nitrogen use efficiency
  misc_feature: Functional homolog of the protein sequence given in SEQ ID NO 14076
  misc_feature: Ceres ANNOT ID no. 8631736
  misc_feature: Up-regulated in shoot tissues in response to methyl jasmonate treatment
  misc_feature: Up-regulated in root tissues in response to methyl jasmonate treatment
  misc_feature (22)..(402): SWISSPROT Homolog: EC 3.5.1.32 Hippurate hydrolase
  misc_feature (84)..(400): Pfam ID: Peptidase_M20 Pfam Description: Peptidase family M20/M25/M40
  misc_feature (189)..(295): Pfam ID: M20_dimer Pfam Description: Peptidase dimerisation domain
MAAPPALARELLDEARAPGFAEWQRGVRRRIHQHPELAFQEHRTSALVRAELDAIGVPYVWPVAQTGVVATIAGPAAAGGAVFALRADMDALPIQEMVEWEFKSKEDGKMHACGHDAHVAMLLGAAKLLQSRRRNLKGTVKLVFQPAEEGHAGGYHVLKEGVLDDVQAIFAVHVDTGLPVGLVGSRPGPVLAGAARFTATITGKGGHAAGPQHVVDPIVAASSAVLSLQQLVARETDPLQGAVVSVTFIKGGEAFNVIPESVTMGGTFRSMTNDGLSYLMKRIREVIEGQAAVSRCAATVDFMEEKMRPYPATVNDEEMYAHAKAVAESMLGEANVKVRPQVMAAEDFGFYAQKIPAAFFSVGVRDEGTGKVHHVHSPHLQIDEGALPVGAALHAAVAMEYLNKHVSPAASEAQAPS

SEQ ID NO: 14796 - DNA, 2895 bp, Sorghum bicolor
  misc_feature: Ceres ANNOT ID no. 8631741
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 14797
atggcagcgccgccagcgctcgcgcgtgagctgctggacgaggcgcgggcgccggggttcgcggagtggcagcgcggcgtgcggcgccggatccaccagcacccggagctggcgttccaggagcaccgcaccagcgcgctcgtgcgcgccgagctcgacgcgataggcgtcccgtatgtgtggcccgtcgcgcagacgggcgtcgtggccaccatcgccggccccgccgcggccgggggggccgtgttcgcgctccgcgccgacatggacgcgcttcccatccaggaaatggtagaatgggagttcaagagcaaggaagacggaaagatgcatgcatgtggccatgacgcccatgtggcgatgcttctcggagcagctaagctgcttcagtctcggaggcgcaatttgaagggtacagtgaagcttgtcttccagccggcggaggagggccacgccggcggctaccatgtcctcaaagaaggcgtcctggacgacgtgcaggccatcttcgccgtgcacgtggacacgggactgcccgtgggcctggtcggctccaggccagggccggtcctcgccggagcggctcggttcacggcgaccatcacggggaaaggcgggcacgcggcggggccacagcatgtcgtcgacccgatcgtcgcggcgtcctccgccgtcctcagcctccagcagctcgttgctcgcgaaaccgatccgctacaaggcgcagttgtgtcggtgaccttcatcaaaggaggcgaagctttcaatgtcatcccggaatccgtcaccatgggcggcaccttcaggagcatgacgaacgatggcctatcctatctcatgaagagaatcagagaggtgatagaaggacaagccgccgtgagccggtgcgccgcaacggtggacttcatggaggagaagatgaggccgtacccggccacggtgaacgacgaggagatgtacgcccacgccaaggcggtggccgagagcatgctgggcgaggccaacgtgaaggtgcggccgcaggtcatggcggcggaggacttcggcttctacgcgcagaagatcccggctgccttcttcagcgtcggcgtccgcgacgaggggacggggaaggtccaccacgtgcactcgccgcacctccagatcgacgagggcgcgctccccgtcggagccgcgctccacgccgccgtggccatggagtacctgaacaaacacgtctcgccggcggcgagcgaggcccagtgctgcttccctggccgtcggatcctcccttcaaccattggatgccatccacgcttccacatcatcagaaaaaaaaaagaaaaaaaaaagaaaagctccctcgatccttccgtgccgcgtcgacgccagcgacaaacaccgctaccagtccattccgacctctggcgcggccccgacccgcctcggcccccacgacctcagccgcgtcctccttccccgctccgcgcgccgcatacagccgccctgcgccccccgccgctccgcaggctgccgctgcgtggccctgcagcgccgcaccctcgattccggcgacctccctcgcgggggtcctccgccggccggcgcggcgcgtacagccgcctcggtcgccgacaaggcgatcgagcagagcagctgtctcctctcactactcagtacgtcaaacaccgccgccgtctcctccctcttcctgtcctgacgaagacgatggcagcgacggcggcagcgctggcgcgggagctcctggacgcggcgcgcgcgccggagttcgcggagtggcagctcggcgtgcggcgccggatccaccagcacccggagctggcgttccaggagcaccgcaccagcgcgctcgtgcgcgcggagctggacgcgctcggcgtcccgtacgcctggcccgtcgctcggacgggtgtcgtggccaccgtcgccggcgccgcctcgggccccgtgttcgcgctccgggccgacatggacgcgctccctctccaggaattggtagagtgggagttcaagagcaaggaggacggtaagatgcacgcctgtggccatgatgctcacgtggcaatgctactcggagctgctaggctgcttcagtctaggagggaccttttcaagccggccgaggagggccacgccggcgggtactatgtcctcaaggaaggcgtcctggacgacgtgcacaccatcttcgccgtgcacgtggacactgccctaccggtgggcaccgtcggctctaggccgggcccgttcctcgccgggtcagctcggttcacggcgaccatcaccgggaaaggcggccacgcggcggggccccagctcgtcgtcgacccgatcgtcgcggcctcctccgccgtgctgagcctccagcagctcgtcgcccgcgagatcgaccccctgcagggcgctgtggtgtccgtgaccttcatcagaggaggcgaagctttcaacgtcattccagagtctgtgaccctgggtggcacctgccggagcatgacaactgaaggcctgtcctacctcatgaagagaatccgagaggtggtacaagggcaggccgccgtggggcggtgcacggcggtcgtcgacttcatggaggagaagatgaagccatatccagccaccgtgaatgacgaggcagtgtacggccacgccaaggcggtggccgagagcatgatcggggaggccaacgtgaggttgtgcccccagttcatggcggccgaagacttcggcttctactcgcagcggatcccagcggcattcttcagcgtcggcgtccgcaacgccgagacggggaagatccaccacgtgcactcgccgcacctcgacatcgacgaggccgcgctccccatcggagccgcgctccacgccgccgtggcgatcgagtacctgaacaaatag

SEQ ID NO: 14797 - protein, 964 aa, Sorghum bicolor
  misc_feature: Useful for making plants with modulated nitrogen use efficiency
  misc_feature: Functional homolog of the protein sequence given in SEQ ID NO 14076
  misc_feature: Ceres ANNOT ID no. 8631741
  misc_feature: Up-regulated in shoot tissues in response to methyl jasmonate treatment
  misc_feature: Up-regulated in root tissues in response to methyl jasmonate treatment
  misc_feature (22)..(402): SWISSPROT Homolog: EC 3.5.1.32 Hippurate hydrolase
  misc_feature (84)..(400): Pfam ID: Peptidase_M20 Pfam Description: Peptidase family M20/M25/M40
  misc_feature (652)..(960): Pfam ID: Peptidase_M20 Pfam Description: Peptidase family M20/M25/M40
  misc_feature (189)..(295): Pfam ID: M20_dimer Pfam Description: Peptidase dimerisation domain
  misc_feature (749)..(855): Pfam ID: M20_dimer Pfam Description: Peptidase dimerisation domain
MAAPPALARELLDEARAPGFAEWQRGVRRRIHQHPELAFQEHRTSALVRAELDAIGVPYVWPVAQTGVVATIAGPAAAGGAVFALRADMDALPIQEMVEWEFKSKEDGKMHACGHDAHVAMLLGAAKLLQSRRRNLKGTVKLVFQPAEEGHAGGYHVLKEGVLDDVQAIFAVHVDTGLPVGLVGSRPGPVLAGAARFTATITGKGGHAAGPQHVVDPIVAASSAVLSLQQLVARETDPLQGAVVSVTFIKGGEAFNVIPESVTMGGTFRSMTNDGLSYLMKRIREVIEGQAAVSRCAATVDFMEEKMRPYPATVNDEEMYAHAKAVAESMLGEANVKVRPQVMAAEDFGFYAQKIPAAFFSVGVRDEGTGKVHHVHSPHLQIDEGALPVGAALHAAVAMEYLNKHVSPAASEAQCCFPGRRILPSTIGCHPRFHIIRKKKEKKKKSSLDPSVPRRRQRQTPLPVHSDLWRGPDPPRPPRPQPRPPSPLRAPHTAALRPPPLRRLPLRGPAAPHPRFRRPPSRGSSAGRRGAYSRLGRRQGDRAEQLSPLTTQYVKHRRRLLPLPVLTKTMAATAAALARELLDAARAPEFAEWQLGVRRRIHQHPELAFQEHRTSALVRAELDALGVPYAWPVARTGVVATVAGAASGPVFALRADMDALPLQELVEWEFKSKEDGKMHACGHDAHVAMLLGAARLLQSRRDLFKPAEEGHAGGYYVLKEGVLDDVHTIFAVHVDTALPVGTVGSRPGPFLAGSARFTATITGKGGHAAGPQLVVDPIVAASSAVLSLQQLVAREIDPLQGAVVSVTFIRGGEAFNVIPESVTLGGTCRSMTTEGLSYLMKRIREVVQGQAAVGRCTAVVDFMEEKMKPYPATVNDEAVYGHAKAVAESMIGEANVRLCPQFMAAEDFGFYSQRIPAAFFSVGVRNAETGKIHHVHSPHLDIDEAALPIGAALHAAVAIEYLNK

SEQ ID NO: 14798 - DNA, 807 bp, Sorghum bicolor
  misc_feature: Ceres ANNOT ID no. 8631797
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 14799
atgtccaaggcaaggttggacggcaaggtggcgatcgtgacgggcggcgcgagcgggatcggcgaggcggcggcgcggctgttcgcgtcgagcggcgccacggtggtgatcgcggacgtgcaggacgagctggggcaggcggtggcggcgtcggtcgggtccggccggtgcgcgtacgcgcggtgcgacgtgacggacgaggcgcaggtggaggcgacggtggcgcgcgtggtggcggcgcacgggcggctggacgtgatgatgagcaacgcgggcgtgctgctcccgacggggtcggtgatggacatggacctggcggagctggaccgcgtgatggccgtcaacttccgtggcgcggcggcgtgcgtgaagcacgcggcgcgggcgatggtggcgtccggttccggcggcggcggcggcgccatcgtgtgcacggcgagcgtggcgtcgctgcagggcgggttcggcccggcgtcgtacacggcgtccaagcacgcgctgctgggcctggtgcgcgccgcggccggggagctggggagacacggcgtgcgcgtcaactgcgtgtcccccggcggcgtcgccacgcccctgagctgcgcgctcatgggcgtgggcccgcaggagctggaggccatgacggtgccgcacaacgtcctgcaggggaaggtgctgcgcgccgacgacgtcgcggaggccgcgctgttcctcgcgtccgaccaggccgccttcatcagcggtcataacctcgtcgtcgacggcgccatcactgccgtcaaccccgccgtgctgcagaccgtcgggctgtaa

SEQ ID NO: 14799 - protein, 268 aa, Sorghum bicolor
  misc_feature: Useful for making plants with modulated biomass
  misc_feature: Functional homolog of the protein sequence given in SEQ ID NO 14077
  misc_feature: Ceres ANNOT ID no. 8631797
  misc_feature (5)..(259): SWISSPROT Homolog: EC 1.1.1.288 Xanthoxin dehydrogenase
  misc_feature (9)..(179): Pfam ID: adh_short Pfam Description: short chain dehydrogenase
MSKARLDGKVAIVTGGASGIGEAAARLFASSGATVVIADVQDELGQAVAASVGSGRCAYARCDVTDEAQVEATVARVVAAHGRLDVMMSNAGVLLPTGSVMDMDLAELDRVMAVNFRGAAACVKHAARAMVASGSGGGGGAIVCTASVASLQGGFGPASYTASKHALLGLVRAAAGELGRHGVRVNCVSPGGVATPLSCALMGVGPQELEAMTVPHNVLQGKVLRADDVAEAALFLASDQAAFISGHNLVVDGAITAVNPAVLQTVGL

SEQ ID NO: 14800 - DNA, 1719 bp, Sorghum bicolor
  misc_feature: Ceres ANNOT ID no. 8631820
  misc_feature: Encodes the peptide sequence at SEQ ID NO 14801
atggcgatgtctgtgcgctgtggcggcagatgcagcggcagcggcacggtcgtgtcgtacacgtacgtacgaatggtagcttcgcgtgctctacccattcggttctcctcccgggtcccggtccctgggggagctctattaaacgcgcgcgcgcgcgcggccggccgtgcactgaacccgacggacaagccgatcgatgcatgcgccgcggtgaacgacaggtggtgcaccggagggagttgttggagccagcaaatggcgaaggccaagccacggccggcggcggccatccttcttctgctcatcagcttcctggccgccgccgcggctggtggtggctcggacgccgagacgacgggcggcggcggcggcatggtgggcgtggacggcacgcggttcgtggtggacgatggcaggcccatctacttcagcgggttcaacgcctactggctgatgctggtggcgtcggacccggcgcggaggggcaaggtggtggcggcgttccggcaggcggccgaccacgggctcaacctcgcgcggacctgggcgttcagcgacggcggcgacacgccgctgcaggcggcgccgggcgtctacgacgaggccatgttccagggtctggacttcgtggtcgccgaagccaggcggcacggcatctacctcctcctctgcctcacaaacaacttccacgacttcggcggcaagcggcagtacgtgcagtgggccagggacgccggccaccgcctcgccaccgacgacgacttcttcaacagcaccgtcgtcaaggactactacaagaaccacgtcaagacggtgctgacgcgcgtgaacaccctcaccggcgtggcgtacaaggacgaccccaccatcctcggctgggagctcatgaacgagccccgctgcgacgccgagcctaccggcgccatggtgcaggcgtgggtggaggagatggcgccgtacgtgaagtccatcgacggcgagcacctggtgacggcggggctggagggcttctacggcgccggcgcgcacgagagcaaggacctcaacccgtggggcatctactacggcaccaacttcgtcgagacgcaccgcgcgcggggcgtcgacttcgccaccatccacctctacccggacgtctggctctggggctccgccgccgacgcgcagctcgccttcctccgcaactggacgcgctcccacgcccgcgacgccgacctctacctgcgcaagccgctgctcgtcaccgagtacggcaagttcctctgggagggcgtcgccggcgccaaccgcacccagagggactacttcctccgcctcgtcctcgactccatctacgactccgccgcacggggagggccgctcgtcggcggcgcgttctggcagctgctcgacggcggcatggacacgctcagggatggatacgagatcatactccccgaggatcgactcgccgccaccatcatcggtaaccactcccgccagctggcccagctcagcctcgtcaccttcaccggggaggacgtcgacatcgaagcggcggcgcttcgccggaggagcaggagaagcccgcatagcaacaggaagatacgcgtacgcagcgtgggtggtcctagtgatagtgatagttattatacacaaacacaacggttgttgcacatactcttggttcgtttcatgtctttgttcacatcaatttcttcattgttcagtagtgtatag

SEQ ID NO: 14801 - protein, 572 aa, Sorghum bicolor
  misc_feature: The sequence is a functional homolog of SEQ ID NO 2 in US patent 7148399
  misc_feature: Ceres ANNOT ID no. 8631820
  misc_feature (134)..(559): SWISSPROT Homolog: EC 3.2.1.78 Mannan endo-1,4-beta-mannosidase
  misc_feature (132)..(459): Pfam ID: Cellulase Pfam Description: Cellulase (glycosyl hydrolase family 5)
MAMSVRCGGRCSGSGTVVSYTYVRMVASRALPIRFSSRVPVPGGALLNARARAAGRALNPTDKPIDACAAVNDRWCTGGSCWSQQMAKAKPRPAAAILLLLISFLAAAAAGGGSDAETTGGGGGMVGVDGTRFVVDDGRPIYFSGFNAYWLMLVASDPARRGKVVAAFRQAADHGLNLARTWAFSDGGDTPLQAAPGVYDEAMFQGLDFVVAEARRHGIYLLLCLTNNFHDFGGKRQYVQWARDAGHRLATDDDFFNSTVVKDYYKNHVKTVLTRVNTLTGVAYKDDPTILGWELMNEPRCDAEPTGAMVQAWVEEMAPYVKSIDGEHLVTAGLEGFYGAGAHESKDLNPWGIYYGTNFVETHRARGVDFATIHLYPDVWLWGSAADAQLAFLRNWTRSHARDADLYLRKPLLVTEYGKFLWEGVAGANRTQRDYFLRLVLDSIYDSAARGGPLVGGAFWQLLDGGMDTLRDGYEIILPEDRLAATIIGNHSRQLAQLSLVTFTGEDVDIEAAALRRRSRRSPHSNRKIRVRSVGGPSDSDSYYTQTQRLLHILLVRFMSLFTSISSLFSSV

SEQ ID NO: 14802 - DNA, 2712 bp, Sorghum bicolor
  misc_feature: Ceres ANNOT ID no. 8631865
  misc_feature: Encodes the peptide sequence at SEQ ID NO 14803
atggacttcgcggccgtgtaccgcgagttctcccgtcgcggggactggcagcgctcgctccggctcttcaagtacatgcagcgccagtcgtggtgccgccccgacgagcacatccacgccatcgtcatcggcgtgctcgggcgccagggccccgcgctgctcgacaagtgcctcgaggtgttccacgacctccccgccgagtcgcgcaccgcgctctcctacacctccctcatcgccgcctacgcgcgcaacgcgctgcacgaggaggcccgcgcgctgctcgaccagatgaaggccgcgggggtcgcgcccaccgccgccacctacaacaccgtgctcgccgcctgcgcccgcgccaccgacccacccgtccccttcgacatgctcctcggcctcttcgctgagatgcggcacgacgcgtccccctccgtgcgccccgacctcaccacctacaacaccctcctcgccgccgccgccgtgcgctctctggctgaccagtctgaaatgctgctgcgcactatgcttgaggctggcgtctccccggacactgtatcttatcgttacattgtggatgcctttgccagcgccggcaacctctcccgtgtagccgagctgttctccgaaatggctgtcatggggaacacggcggatgcctctgcgtatctaggactcatggaggcacacacgcgtgttggcgccacagctgaggcggtggctgtgctgcggcagatgcaggctgatggatgtgcgccaacagctgccacttaccgtgtcctgctcgatctttatggaaggcaggggcggtttgatggagtgcgcgaactcttccgtgagatgagaactgctgtaccgccagacacggccacatataatgtgcttttccgtgtatacggggacggtggcttcttcaaggaggtggtggagctcttccatgatatgcttgaaactggggtagagcctgatatggtgacctgcgaaaatgtcatggctgcctgtggtcgtggtggcctccatgaggatgcaagagaagttcttgaatatatgaccagagaaggaatggtgccgactgcagacgcctacactggcctggttgaggctcttggccacgcggctatgtatgaggaagcctatgttgctttcaacatgatgactgaaattggtagcttgccaactcttgagacctacaatactcttgcgtttgcatatgctaggggtgggctcttccaggaggctgaggccatcttttctcggatgagtaacaatgctggcattcagaaaaacaaagattcatttgatgccctcatcgaagcatattgccagggcgcacaattggatgatgcagtgaaggcgtacatggagatgcgcaaatccaggtttaatccagatgaacggtcccttgagggggtacttaatgcctactgcatagcaggggtcatagatgagagtaaagaacagtttgaagaacttcaatctagcgtgacactgcccagcattattgcctattgcatgatgttgtcactgtatgctaggaacgacaggtgggctgatgcgtatgatatgctggaagaaatgaaaacaaatcgtgctagtagtacacatcaagtaattgcttccctaatcaaaggggaatacgatgatagctccaactggcaaatggttgaatatgcccttgaaaacagtaccatggaaggctgtgactatagtttacggttctttaatgctctcctggatgtgctttggtggtttggtcagaagggccgagctgcaagagttctggatcaagcagtacaatttgggctcttccctgagttatatcgtgacaccaagctggtctggtcactagatgtacataggatgtcagtaggtggagcgctggtggctgtgtcagtatggctcaataagctttatgacagactagtagaagatgaagatcttccacagttagcatctgttgttgtattgagaggtgaaatggagaaaagcacaattacaagaggactgccaaccgccaaagttgtctactcctttctaaatgatacactatcagcatccttccacttcccaaaatggaacaagggacgaatcatatgcttgaagtcccaattgaaaaagctgcagtcagccgtagattcctcaaatgggtctcctgcagctggttttgtccccatgatgaactcccatttgccgtctcccgattccaagatatatacaagggaggaccaattgggaaatggtaccggccatttgcctgacgaaccgttggtagaggaaaaggagtcagagcttctcgcattagtgtggctggcttcagttatacatggtcctcgtggaaaggagtactcgaacccgggaggccgggagccagagcccagagccaccagcggccagcccaccacctaccaggaagagacggcgccgccggagatggagatggagacagaggcggcggcggcgaggcaggcgaaggagtccctggagctggcgttccagatgtcccagatcctcgacaccggcctcgaccgccacaccctgtcgctgctcatggcgctctgcgaccgtggagccaaccccgaggccctggccgccctcgtccgcgagctctcctccgctgctcctccaaccgccgcggcttcctcccccgtgagcaacggcgccgcggggctggccccggcaactgcgtcgatgttcccctccggccttcgccgtccctag

SEQ ID NO: 14803 - protein, 903 aa, Sorghum bicolor
  misc_feature: Useful for making plants with modulated nitrogen use efficiency
  misc_feature: Functional homolog of the protein sequence given in SEQ ID NO 14057
  misc_feature: Ceres ANNOT ID no. 8631865
  misc_feature: Down-regulated in shoot tissues in response to salicylic acid treatment
  misc_feature (72)..(106): Pfam ID: PPR Pfam Description: PPR repeat
  misc_feature (149)..(183): Pfam ID: PPR Pfam Description: PPR repeat
  misc_feature (288)..(322): Pfam ID: PPR Pfam Description: PPR repeat
  misc_feature (323)..(357): Pfam ID: PPR Pfam Description: PPR repeat
  misc_feature (254)..(287): Pfam ID: PPR Pfam Description: PPR repeat
  misc_feature (429)..(463): Pfam ID: PPR Pfam Description: PPR repeat
MDFAAVYREFSRRGDWQRSLRLFKYMQRQSWCRPDEHIHAIVIGVLGRQGPALLDKCLEVFHDLPAESRTALSYTSLIAAYARNALHEEARALLDQMKAAGVAPTAATYNTVLAACARATDPPVPFDMLLGLFAEMRHDASPSVRPDLTTYNTLLAAAAVRSLADQSEMLLRTMLEAGVSPDTVSYRYIVDAFASAGNLSRVAELFSEMAVMGNTADASAYLGLMEAHTRVGATAEAVAVLRQMQADGCAPTAATYRVLLDLYGRQGRFDGVRELFREMRTAVPPDTATYNVLFRVYGDGGFFKEVVELFHDMLETGVEPDMVTCENVMAACGRGGLHEDAREVLEYMTREGMVPTADAYTGLVEALGHAAMYEEAYVAFNMMTEIGSLPTLETYNTLAFAYARGGLFQEAEAIFSRMSNNAGIQKNKDSFDALIEAYCQGAQLDDAVKAYMEMRKSRFNPDERSLEGVLNAYCIAGVIDESKEQFEELQSSVTLPSIIAYCMMLSLYARNDRWADAYDMLEEMKTNRASSTHQVIASLIKGEYDDSSNWQMVEYALENSTMEGCDYSLRFFNALLDVLWWFGQKGRAARVLDQAVQFGLFPELYRDTKLVWSLDVHRMSVGGALVAVSVWLNKLYDRLVEDEDLPQLASVVVLRGEMEKSTITRGLPTAKVVYSFLNDTLSASFHFPKWNKGRIICLKSQLKKLQSAVDSSNGSPAAGFVPMMNSHLPSPDSKIYTREDQLGNGTGHLPDEPLVEEKESELLALVWLASVIHGPRGKEYSNPGGREPEPRATSGQPTTYQEETAPPEMEMETEAAAARQAKESLELAFQMSQILDTGLDRHTLSLLMALCDRGANPEALAALVRELSSAAPPTAAASSPVSNGAAGLAPATASMFPSGLRRP

SEQ ID NO: 14804 - DNA, 1941 bp, Sorghum bicolor
  misc_feature: Ceres ANNOT ID no. 8631886
  misc_feature: Down-regulated in shoot tissues in response to salicylic acid treatment
  misc_feature: Encodes the peptide sequence at SEQ ID NO 14805
atggacccccgtcctcgtgataatctcaactttggtgctcgattgcccaccccaaatccacccacacctcacatgattagcttctccctccaacagccacagcctcagttcttcccgtcatatggattccacagccacaaccacaacaaccctgctatcagctcacatccatctccaccctcagtcatgcctggctgcaccacgccaagcccagcatcaacaaccacaaccgaggcagacaatgccgaggatctctccgaggctgttgctgatgatgcagtccttgcttacatcaaccagttccttcttgaagatgaggatgaggagtcctatcctgttaccagtgtgcctgtggaggattcagtactcctcgccgctgtcgagaaaccattcgtcgacatcctcaagtctgctaaccatatcacagcaaaggcctatgaagtaaaatcctggatcactgatgattgccattccacgggaagtggaagatttcatgatgtggtcacaagtactctggactccacccaattggcccctgaaatggttcaaggggatgtagttgatgctgttcataagggtcagaagaacccacgtgacaatgacttggaggtggagaggaggaagagcaaacagtccgcattgtgtgatgaggagactgtccgagagatgtttgacaaagtgctgttgtgtaccgataagaattgtgcgttccactcaccaatgccagccgatgcacaaaacagcgggggatatgtgaaaggatctggaaatagaagagggcgaaggaagggaagatccggtgctggtgcagagcaggagccagtcgatctcacaaccctacttattcattgtgctcaggccgcggctattgatgaccacagaaactcaagtgagcatctgaaacagattaggaagcattcttctgctactggagatgctggccagagattggcacactactttgctgacgggctcgaggctcgcctagctggcactggtagcagcatctaccgttcacttgctgcaaagagaacttctactggtgatatgctgaaagcgttcaatttatatgttaaagcatgtccatttaggataatatcacactatgttgcaaatacgaccatcttaaatgctacgaagagcgtgacaaggttgcacattatagactacgggataatgtatggtttccagtggccaatcctcatgcagcggctctcaaagagatctggtgggcccccaacccttcgaatcactggtatagactttcccctgtcaggattccgccctgcagagcgtgttgaggcgacagggcgacggttacatgagtatgcccgtatgttcaatgttccgtttgaatatcaggccattgctgccaagtgggatactatccaagttaaagatctcaatataaagagcgatgagttcattgtcgttaactgcctttaccgaatgaggaacatgatggacgagacggcaacagatgacagcccgagaacaagagttttgaacacaatcagaaagttgaatccccatttgttcgttcatgggattgtcaacggtacttacaatgcacccttctttgtgacacggtttaaagaggctatgttttttttctcttcaatctttgatatgcttgaagcaaatgcctcacggatggatgaacataggctgctgatagaaagagaattctttggacgggaagctattaatgtgattgcttgcgagggtacagagaggattgaaaggccagagacctacaaacaatggcagatgagaaacctcagggcaggcttcaggcagctacctctggacagagagataatggcgagagcaaggtacaaggttagcaagacctatccgagggatttcctcgtggacgaagataacctacaaggttggaagggtcgtgtcatatatgctctttcagcatggagtacctag

SEQ ID NO: 14805 - protein, 646 aa, Sorghum bicolor
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
  misc_feature: Ceres ANNOT ID no. 8631886
  misc_feature (252)..(557): Pfam ID: GRAS Pfam Description: GRAS family transcription factor
MDPRPRDNLNFGARLPTPNPPTPHMISFSLQQPQPQFFPSYGFHSHNHNNPAISSHPSPPSVMPGCTTPSPASTTTTEADNAEDLSEAVADDAVLAYINQFLLEDEDEESYPVTSVPVEDSVLLAAVEKPFVDILKSANHITAKAYEVKSWITDDCHSTGSGRFHDVVTSTLDSTQLAPEMVQGDVVDAVHKGQKNPRDNDLEVERRKSKQSALCDEETVREMFDKVLLCTDKNCAFHSPMPADAQNSGGYVKGSGNRRGRRKGRSGAGAEQEPVDLTTLLIHCAQAAAIDDHRNSSEHLKQIRKHSSATGDAGQRLAHYFADGLEARLAGTGSSIYRSLAAKRTSTGDMLKAFNLYVKACPFRIISHYVANTTILNATKSVTRLHIIDYGIMYGFQWPILMQRLSKRSGGPPTLRITGIDFPLSGFRPAERVEATGRRLHEYARMFNVPFEYQAIAAKWDTIQVKDLNIKSDEFIVVNCLYRMRNMMDETATDDSPRTRVLNTIRKLNPHLFVHGIVNGTYNAPFFVTRFKEAMFFFSSIFDMLEANASRMDEHRLLIEREFFGREAINVIACEGTERIERPETYKQWQMRNLRAGFRQLPLDREIMARARYKVSKTYPRDFLVDEDNLQGWKGRVIYALSAWST

SEQ ID NO: 14806 - DNA, 1257 bp, Sorghum bicolor
  misc_feature: Ceres ANNOT ID no. 8631890
  misc_feature: Encodes the peptide sequence at SEQ ID NO 14807
atggggaactgctgctgctggggcgcgcggatcaaggatgggagccctcaccctggcacctcaggaatgttctcgaagagtggtggtaaggatgggagtaggcttagcggctgtagtagtcgagcctcttcagcttccatgccaacaagtgccaagactgaatgtgaaatcctgcaatcagccaatgttaaggtcttcaccttcaataatctcaaggcagccacaaggaatttccgtcctgatagtgttctaggtgaaggagggtttggatctgtctataaaggatggatcgatgaaaacacattatcgccttgcaggcctggcactggaattgctgttgctgtgaaaaaactcaaccctgagggtttgcaagggcaccgagaatggttggcggaagttaattacctaggtcagttctgtcatcccaaccttgtcaagctgattggatactgcgtagaggatgagcaccgactgctagtatacgagttcatgccccgtgggagcttggaaaatcatctgtttaggagaggctcatacttccaacctctgtcatggaaccttagaatgaaggttgcacttggagcagcaaaaggactggcttaccttcatagtgcagaggcaaaagttatttaccgagattttaagacttccaacatcctccttgacacagattattctgcgaagctttctgattttggattggctaaggatggtcctgttggtgagaagagccatgtgtccacaagagttatgggaacatacggttatgcagctcctgagtatctttcaacaggtcacctaactacaaagagcgacatctatagctttggagtagtgcttctggagatgctgtcaggccgccgtgccattgacaagaaccgcccccagggtgagcacaatcttgtggagtgggctcgaccttacctcgcacataagcgcaagatattccgcattctggataccaggctggaaggtcaatacaatctcaacagtgcgcaatcaattgctgcccttgctcttgaatgcctatcctacgaagctaagatgaggccgactatggatgatgtggtcactattctacaagaggtccaagactccagtgaagctgagaagcttcaagaacccaaggctggaaccaaacaggcacctgctgctgtgactgctagcaagagcactcgcaatcctcgccggagaagcctggcaggcacaaaggagactgttggtccaaatccaaaaccattggcccattctcgttag

SEQ ID NO: 14807 - protein, 418 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8631890
  misc_feature (6)..(411): SWISSPROT Homolog: EC 2.7.11.1 Non-specific serine/threonine protein kinase
  misc_feature (78)..(360): Pfam ID: Pkinase Pfam Description: Protein kinase domain
MGNCCCWGARIKDGSPHPGTSGMFSKSGGKDGSRLSGCSSRASSASMPTSAKTECEILQSANVKVFTFNNLKAATRNFRPDSVLGEGGFGSVYKGWIDENTLSPCRPGTGIAVAVKKLNPEGLQGHREWLAEVNYLGQFCHPNLVKLIGYCVEDEHRLLVYEFMPRGSLENHLFRRGSYFQPLSWNLRMKVALGAAKGLAYLHSAEAKVIYRDFKTSNILLDTDYSAKLSDFGLAKDGPVGEKSHVSTRVMGTYGYAAPEYLSTGHLTTKSDIYSFGVVLLEMLSGRRAIDKNRPQGEHNLVEWARPYLAHKRKIFRILDTRLEGQYNLNSAQSIAALALECLSYEAKMRPTMDDVVTILQEVQDSSEAEKLQEPKAGTKQAPAAVTASKSTRNPRRRSLAGTKETVGPNPKPLAHSR

SEQ ID NO: 14808 - DNA, 462 bp, Sorghum bicolor
  misc_feature: Ceres ANNOT ID no. 8631904
  misc_feature: Encodes the peptide sequence at SEQ ID NO 14809
atgactgtcttctccacatactcgaacaaccagctcggtgtgctgatccaggtttacgagggcaagaggacccggaataaggacaacaacctccttgggaaatttgagggcgtccctcagatcactgtattctttgacattgatgccaacgagaactacaagtccgaggatgaggagcacaagaagaaggttgaggcgaagaactctctggagaactatgacgagaagattgcctcgaagctgcctgccgacgacaagaagaagattgaggatgctgttgagcagggcatccactggctggacagcaaccagctcgctgaggttgaagagtttgaggacaagatgaaggagctggaaggcctctgcaaccccatcattgccaagatgtaccagggcgctggtgctgacatggctggcggaatggaggatgaggcccctgctgctgctggcggggctggttga

SEQ ID NO: 14809 - protein, 153 aa, Sorghum bicolor
  misc_feature: Useful for making plants with modulated drought sensitivity
  misc_feature: Useful for making plants with modulated heat sensitivity
  misc_feature: Functional homolog of the protein sequence given in SEQ ID NO 14080
  misc_feature: Ceres ANNOT ID no. 8631904
MTVFSTYSNNQLGVLIQVYEGKRTRNKDNNLLGKFEGVPQITVFFDIDANENYKSEDEEHKKKVEAKNSLENYDEKIASKLPADDKKKIEDAVEQGIHWLDSNQLAEVEEFEDKMKELEGLCNPIIAKMYQGAGADMAGGMEDEAPAAAGGAG

SEQ ID NO: 14810 - DNA, 450 bp, Sorghum bicolor
  misc_feature: Ceres ANNOT ID no. 8631909
  misc_feature: Encodes the peptide sequence at SEQ ID NO 14811
atggcgaagcacccgagagactccggcgccggcgccgtgccgctctccctcgcgctgtccctcggcggcggcggcgtggccgccgagcacggcagcaacaagaggcaccggcgcgcggcggcgggcggcggggacggcggcggcgagttcgtctgcaagacgtgcagccgcgccttcgggtcgttccaggcgctgggcgggcaccggaccagccacctgcggggccgccacggcctcgcgctcgggatgcccgcgccggcgaaggacgacgccaaggagaccaccacgaagcagccagcggcggcgtccgcgagccacctgtgccacgtctgcgggctcagcttcgagatgggccaggcgctcggcggccacatgcggcgccaccgcgaggaggccgccgccgccaccaccgcgcaggcgccgcccgtcctcctccagctcttcgtgtag

SEQ ID NO: 14811 - protein, 149 aa, Sorghum bicolor
  misc_feature: The sequence is a functional homolog of SEQ ID NO 1288 in the 10/666,642 US patent application
  misc_feature: The sequence is a functional homolog of SEQ ID NO 622 in the 10/374,780 US patent application
  misc_feature: The sequence is a functional homolog of SEQ ID NO 1488 in the 10/666,642 US patent application
  misc_feature: The sequence is a functional homolog of SEQ ID NO 2156 in the 10/374,780 US patent application
  misc_feature: The sequence is a functional homolog of SEQ ID NO 280 in the 10/714,887 US patent application
  misc_feature: The sequence is a functional homolog of SEQ ID NO 280 in the 11/435,388 US patent application
  misc_feature: The sequence is a functional homolog of SEQ ID NO 1291 in the 10/666,642 US patent application
  misc_feature: The sequence is a functional homolog of SEQ ID NO 625 in the 10/374,780 US patent application
  misc_feature: The sequence is a functional homolog of SEQ ID NO 1292 in the 10/666,642 US patent application
  misc_feature: The sequence is a functional homolog of SEQ ID NO 626 in the 10/374,780 US patent application
  misc_feature: The sequence is a functional homolog of SEQ ID NO 1289 in the 10/666,642 US patent application
  misc_feature: The sequence is a functional homolog of SEQ ID NO 623 in the 10/374,780 US patent application
  misc_feature: Useful for making plants with modulated nitrogen use efficiency
  misc_feature: Functional homolog of the protein sequence given in SEQ ID NO 13271
  misc_feature: Useful for making plants with modulated biomass
  misc_feature: Functional homolog of the protein sequence given in SEQ ID NO 13580
  misc_feature: The sequence is a functional homolog of SEQ ID NO 1480 in the 10/666,642 US patent application
  misc_feature: The sequence is a functional homolog of SEQ ID NO 2150 in the 10/374,780 US patent application
  misc_feature: The sequence is a functional homolog of SEQ ID NO 276 in the 10/714,887 US patent application
  misc_feature: The sequence is a functional homolog of SEQ ID NO 276 in the 11/435,388 US patent application
  misc_feature: Ceres ANNOT ID no. 8631909
MAKHPRDSGAGAVPLSLALSLGGGGVAAEHGSNKRHRRAAAGGGDGGGEFVCKTCSRAFGSFQALGGHRTSHLRGRHGLALGMPAPAKDDAKETTTKQPAAASASHLCHVCGLSFEMGQALGGHMRRHREEAAAATTAQAPPVLLQLFV

SEQ ID NO: 14812 - DNA, 552 bp, Sorghum bicolor
  misc_feature: Ceres ANNOT ID no. 8631910
  misc_feature: Encodes the peptide sequence at SEQ ID NO 14813
atgaagcacccgaggacggagcaggaggcggcgggcgaggtggtgtcgctggcgctgtcgctgagcacggactcgtccacgacgtccgactccacggggaccccgtcgtcggcgggggcgaagcgggcgcggcggaggggcgccgtggtggccacgtcgggggagggggagttcgtctgcaagacctgcagccgcgccttcacctcgttccaggcgctcggcggccaccggaccagccacctgcggggccgccacggcctcgagctcggcgtcggcgcccgggcgctcaagcagcacaagcaacaggccgccgccgccgaagccagcggcagaggaggagacaacaagccgccgcagcagcagcagcagcagcacgagtgccacatctgcgggctcggcttcgagatggggcaggcgctgggcggtcacatgaggaggcaccgcgaggagatgggcgccgccgaggccgccgacgcctgggtctggcgcaccgaggctccgcgcaccgctgccgccgccgatccgcccgtcttgctcgagctcttcgcctag

SEQ ID NO: 14813 - protein, 183 aa, Sorghum bicolor
  misc_feature: The sequence is a functional homolog of SEQ ID NO 1288 in the 10/666,642 US patent application
  misc_feature: The sequence is a functional homolog of SEQ ID NO 622 in the 10/374,780 US patent application
  misc_feature: Ceres ANNOT ID no. 8631910
MKHPRTEQEAAGEVVSLALSLSTDSSTTSDSTGTPSSAGAKRARRRGAVVATSGEGEFVCKTCSRAFTSFQALGGHRTSHLRGRHGLELGVGARALKQHKQQAAAAEASGRGGDNKPPQQQQQQHECHICGLGFEMGQALGGHMRRHREEMGAAEAADAWVWRTEAPRTAAAADPPVLLELFA

SEQ ID NO: 14814 - DNA, 645 bp, Sorghum bicolor
  misc_feature: Ceres ANNOT ID no. 8631913
  misc_feature: Encodes the peptide sequence at SEQ ID NO 14815
atggcagcgccgccggcgagggctcgagccgactacgactacctcatcaaactgctcctcatcggagacagcggtgttggaaaaagttgtctcctgttacggttttcagatggatcattcaccactagcttcattaccactattggtattgacttcaagataaggactgtcgagttggatggcaaacggattaagttgcagatctgggatactgcaggccaagaacgtttccgcactattacaactgcctactacaggggagcaatgggcattttacttgtgtacgatgtcacagacgagtcatctttcaataacataagaaattggatcagaaacattgagcaacatgcttcggataatgtgaacaaagttctggtggggaataaagctgatatggatgaaagcaaacgggctgtgcccacttcaaaggggcaagctctcgctgacgaatatgggatcaagttctttgaaacgagtgcaaagacaaacctgaatgtcgagcaggttttcttttcgatagcaagggatatcaaacagagactttcagagactgattccaagcctgaggatcgaactatcaagatcaaggctgaaggggaagctgatgcagcagcggcacagaaatcagcttgctgcggctcctga

SEQ ID NO: 14815 - protein, 214 aa, Sorghum bicolor
  misc_feature: Useful for making plants with altered lignin content
  misc_feature: Functional homolog of the protein sequence given in SEQ ID NO 13211
  misc_feature: Useful for making plants with modulated oxidative stress sensitivity
  misc_feature: Functional homolog of the protein sequence given in SEQ ID NO 13074
  misc_feature: Ceres ANNOT ID no. 8631913
  misc_feature (16)..(143): SWISSPROT Homolog: EC 2.7.11.1 Non-specific serine/threonine protein kinase
  misc_feature (17)..(179): Pfam ID: Ras Pfam Description: Ras family
  misc_feature (17)..(131): Pfam ID: Miro Pfam Description: Miro-like protein
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKVLVGNKADMDESKRAVPTSKGQALADEYGIKFFETSAKTNLNVEQVFFSIARDIKQRLSETDSKPEDRTIKIKAEGEADAAAAQKSACCGS

SEQ ID NO: 14816 - DNA, 540 bp, Sorghum bicolor
  misc_feature: Ceres ANNOT ID no. 8631908
  misc_feature: Encodes the peptide sequence at SEQ ID NO 14817
atggtacgtgccctctggacgctcgattcgcaatctggactctgcaggagcacgttttcatttcctcagctactgcatggtggttgcactgcgttgcaggcgaacgcggcgtccggcgtggcggtggcggaggagtgcgtggcgcggttccaggagctgcgcggcggccgcgcgcaccgcttcgtggtgttcaaggtcgacgacgcgctgcagcgtgtggtggtggacaaggtgggcgaacggggcgccgggttcggcgacctcaccgccagcctccccgccgacgactgccgctacgccgtgtacgaccacgacttcaccgtcgaggacgccaccgccaccggggaggcgcaggcggcgccgcgcagcaagatcttcttcgtggcctggtcccctgaggcggcggccgtgcggagcaagatggtgtacgctagctcctgcgacggcttcaggaaggagctggacggcgtgcaggtggacctccaggccaccgagcccagcgagctgacgctcgacgtcctcaacgaccacgcatcctga

SEQ ID NO: 14817 - protein, 179 aa, Sorghum bicolor
  misc_feature: Useful for making plants with modulated time to senescence
  misc_feature: Functional homolog of the protein sequence given in SEQ ID NO 13287
  misc_feature: Ceres ANNOT ID no. 8631908
  misc_feature (44)..(179): Pfam ID: Cofilin_ADF Pfam Description: Cofilin/tropomyosin-type actin-binding protein
MVRALWTLDSQSGLCRSTFSFPQLLHGGCTALQANAASGVAVAEECVARFQELRGGRAHRFVVFKVDDALQRVVVDKVGERGAGFGDLTASLPADDCRYAVYDHDFTVEDATATGEAQAAPRSKIFFVAWSPEAAAVRSKMVYASSCDGFRKELDGVQVDLQATEPSELTLDVLNDHAS

SEQ ID NO: 14818 - DNA, 696 bp, Sorghum bicolor
  misc_feature: Ceres ANNOT ID no. 8631916
  misc_feature: Encodes the peptide sequence at SEQ ID NO 14819
atggccgtgccggaggtggtggtcgagggcgtcgtcttcccgccggtggcccgcccgccgggctccgccggctcgcacttcctcggcggcgcaggcgtgcgaggcatcgagatcggaggcaacttcatcaagttcacggccatcggcgtgtacctggaggacgcggccgtgtccgcgctggcgaagaagtgggccggcaagacggccgacgagctcgcgtccgacgccgccttcttccgcgacgtcgtcacgggtgacttcgagaagttcacgagggtgaccatgctccttccgctcacgggcgagcagtacgcggggaaagtgacggagaattgcgtggcgttctggaaggccgtcggcctgtacacggacgccgagggcgtcgccgtggagaagttcaaggaggcgttcaagcccgagacgttcccgccgggcgcctccatccttttcacgcactcgtccaccggagtcctcaccgtcgccttctccaaggactcgtcggtgccggcgtccggcggcgtggcgatcgagaacaagcacctctgcgaggccgtgctggagtccatcatcggggagcacggcgtgtcgccggccgcgaagctgagcctcgcggcgagggtgtcggagctcctcaccaagggaaccgccggggccgccgacgcgccgcaggcggagcccgtctcggtcaccgcctga

SEQ ID NO: 14819 - protein, 231 aa, Sorghum bicolor
  misc_feature: The sequence is a functional homolog of SEQ ID NO 2 in US patent 7202398
  misc_feature: Ceres ANNOT ID no. 8631916
  misc_feature (17)..(231): SWISSPROT Homolog: EC 5.5.1.6 Chalcone isomerase
  misc_feature (1)..(212): Pfam ID: Chalcone Pfam Description: Chalcone-flavanone isomerase
MAVPEVVVEGVVFPPVARPPGSAGSHFLGGAGVRGIEIGGNFIKFTAIGVYLEDAAVSALAKKWAGKTADELASDAAFFRDVVTGDFEKFTRVTMLLPLTGEQYAGKVTENCVAFWKAVGLYTDAEGVAVEKFKEAFKPETFPPGASILFTHSSTGVLTVAFSKDSSVPASGGVAIENKHLCEAVLESIIGEHGVSPAAKLSLAARVSELLTKGTAGAADAPQAEPVSVTA

SEQ ID NO: 14820 - DNA, 1242 bp, Sorghum bicolor
  misc_feature: Ceres ANNOT ID no. 8631930
  misc_feature: Encodes the peptide sequence at SEQ ID NO 14821
atggtgctggatctcaatgtagcgtcgccggcggactcgggcacgtcgagctcgtccgtcctcaactccgcgaacggcggcttccggttcggtctgctcgggagccccgtcgacgacgacgactgctccggcgagatggcgccgggcgcgtccacggggttcatgacgcggcagctcttcccgtccccgaccccgccggccgagccggagccggagccgccggcggcgccggtgccggtgtggcagccacggcgcgccgaggatctcggcgtggcacagaggccggtggcgcccgcgaagaagacgcggcgtgggccgaggtcgcgcagctcgcagtacaggggcgtcaccttctacaggaggacgggccgctgggagtcgcacatctgggcgtacgatcgagctgcgatcaagttccgcggcctcgaggcggacatcaacttcagtctgggcgactacgaggatgatttaaagcagatgaggaattggaccaaggaggaattcgtgcacatactccggcggcagagcacagggttcgcgaggggaagctcgaagtaccgtggcgtgacgctgcacaagtgcggccgctgggaagctaggatggggcaacttcttggcaagaagtacatctatcttgggctctttgacagtgaagttgaagcggcaagggcttatgacagggcagcccttcgcttcaatgggagggaagctgttactaactttgagcctagctcctacaatgcaggagacaatagcctgcctgacaccgaaactgaggcaattgttgatcgtgatgccattgatttggatttgcggatttcacaacctaatgtgcaagatcccaaaagggactataccttaaccagcctccagccaacatgtgattcccctgaatcttcaaatacgatggcctctcagccaatgagctcatcatccccatggcccgggtatcagcaaaacccagcagtgtcatctcaccatcagcatttgtactcgtcagcctgtcatggctcctttccgaaccaccaggtgcaggaaaggccaatggagcgaaggcctgagctgggtgcccagccattccccacctgggcatggcaaacgcagggctcccctcacgtgccgttgcaccactctgcagcatcatcaggattctcgaccgccgccggggcgaacggcggcatgccgctgccgtctcacccgccggcgccgttcccgactacaaacccgttcttcttcccctag

SEQ ID NO: 14821 - protein, 413 aa, Sorghum bicolor
  misc_feature: Useful for making plants with modulated biomass
  misc_feature: Functional homolog of the protein sequence given in SEQ ID NO 13414
  misc_feature: Useful for biocontainment applications
  misc_feature: Functional homolog of the protein sequence given in SEQ ID NO 14008
  misc_feature: Ceres ANNOT ID no. 8631930
  misc_feature (184)..(235): Pfam ID: AP2 Pfam Description: AP2 domain
MVLDLNVASPADSGTSSSSVLNSANGGFRFGLLGSPVDDDDCSGEMAPGASTGFMTRQLFPSPTPPAEPEPEPPAAPVPVWQPRRAEDLGVAQRPVAPAKKTRRGPRSRSSQYRGVTFYRRTGRWESHIWAYDRAAIKFRGLEADINFSLGDYEDDLKQMRNWTKEEFVHILRRQSTGFARGSSKYRGVTLHKCGRWEARMGQLLGKKYIYLGLFDSEVEAARAYDRAALRFNGREAVTNFEPSSYNAGDNSLPDTETEAIVDRDAIDLDLRISQPNVQDPKRDYTLTSLQPTCDSPESSNTMASQPMSSSSPWPGYQQNPAVSSHHQHLYSSACHGSFPNHQVQERPMERRPELGAQPFPTWAWQTQGSPHVPLHHSAASSGFSTAAGANGGMPLPSHPPAPFPTTNPFFFP

SEQ ID NO: 14822 - DNA, 597 bp, Sorghum bicolor
  misc_feature: Ceres ANNOT ID no. 8631928
  misc_feature: Encodes the peptide sequence at SEQ ID NO 14823
atgtggatcttcgtcagcaccctcaccggggagaccatccctctcgaggttctgggttcagacaccatcaacgtggtgaaagcaaagattcaggatcggcaccgcctcatctatgatgggaagtggctggacgacaggcatactttggaccattacgaaatccacagtggatgcagcctcatcctagatctcaaccgcggtgggatgccaatgccgatcttcatcaagatgatgacaggcagaagcagaaccatcacccttgatgtacagaatacagataccatccgcactgtcaaggctatgatatatcatatggatgacattccattggaccagcaatgcctcacgtttgatggcaagcagctgaaggacggatgctctttggctgacaacccaccatcacttttgagttcgagagctcagataccattgcagatatcaaggagaggattcattatatgcagcacattcccccctagagagcagcgtctcgtctatggagggaggcagctacaggacgatcacacccttgcggactacaatatcttgagattttgcacgctggatctactactacgccttcgtggtggtcaatga

SEQ ID NO: 14823 - protein, 198 aa, Sorghum bicolor
  misc_feature: Useful for making plants with modulated cold sensitivity
  misc_feature: Functional homolog of the protein sequence given in SEQ ID NO 13521
  misc_feature: Ceres ANNOT ID no. 8631928
  misc_feature (76)..(149): Pfam ID: ubiquitin Pfam Description: Ubiquitin family
  misc_feature (6)..(67): Pfam ID: ubiquitin Pfam Description: Ubiquitin family
MWIFVSTLTGETIPLEVLGSDTINVVKAKIQDRHRLIYDGKWLDDRHTLDHYEIHSGCSLILDLNRGGMPMPIFIKMMTGRSRTITLDVQNTDTIRTVKAMIYHMDDIPLDQQCLTFDGKQLKDGCSLADNPPSLLSSRAQIPLQISRRGFIICSTFPPREQRLVYGGRQLQDDHTLADYNILRFCTLDLLLRLRGGQ

SEQ ID NO: 14824 - DNA, 753 bp, Sorghum bicolor
  misc_feature: Ceres ANNOT ID no. 8631936
  misc_feature: Encodes the peptide sequence at SEQ ID NO 14825
atggatatggcccccgcgcccgtctcctccaacccgcgctcggtcgaggatatctttaaagacttctccggccgccgcgcggggctcgtccgcgccctcacctccgatgtggacgatttctgcagcttctgcgacccagataaggagaatttgtgtctctacggccttcccaacgggacctgggaggtgtcgccgccggcggacgaggttccgccggagttgcccgagccggcgctcggcatcaactttgcgcgcgacggcatgcagcgccgcgactggctctcactcgtcgcggtccactctgactcgtggctcatctccgtcgctttcttctacggtgctcgcctcaacgccaacgaccggaagcgcttattcagcttgatcagtgatcatccttctgtctttgaagcattcgcggacaggaaacacggcagagataggtctggggttgatagcagtggcaagtccagacactcatcaaagagagcaaacgatggccatgcgaagaattccagggcagcagctcctgctgccaaagactatgacgacgacgatgacgaggaagatgaggaacacacggaaaccttttgtggaagctgcggcggcctttacaacgcgaatgagttctggatcggctgcgacatatgtgagcggtggttccacggcaagtgcgtgaggatcacccctgccaaagcggagcacataaagcactacaagtgcccggactgcagctcaaagaaaatgaggcagtag

SEQ ID NO: 14825 - protein, 250 aa, Sorghum bicolor
  misc_feature: Useful for making plants with altered lignin content
  misc_feature: Useful for making plants with modulated flowering time
  misc_feature: Functional homolog of the protein sequence given in SEQ ID NO 13473
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: Useful for making plants with altered alkaloid content
  misc_feature: Functional homolog of the protein sequence given in SEQ ID NO 13176
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: The sequence is a functional homolog of SEQ ID NO 1981 in the 11/479,226 US patent application
  misc_feature: Ceres ANNOT ID no. 8631936
  misc_feature (196)..(246): Pfam ID: PHD Pfam Description: PHD-finger
MDMAPAPVSSNPRSVEDIFKDFSGRRAGLVRALTSDVDDFCSFCDPDKENLCLYGLPNGTWEVSPPADEVPPELPEPALGINFARDGMQRRDWLSLVAVHSDSWLISVAFFYGARLNANDRKRLFSLISDHPSVFEAFADRKHGRDRSGVDSSGKSRHSSKRANDGHAKNSRAAAPAAKDYDDDDDEEDEEHTETFCGSCGGLYNANEFWIGCDICERWFHGKCVRITPAKAEHIKHYKCPDCSSKKMRQ

SEQ ID NO: 14826 - DNA, 1242 bp, Sorghum bicolor; identical to SEQ ID NO: 14820
  misc_feature: Ceres ANNOT ID no. 8631933
  misc_feature: Encodes the peptide sequence at SEQ ID NO 14827

SEQ ID NO: 14827 - protein, 413 aa, Sorghum bicolor; identical to SEQ ID NO: 14821
  misc_feature: Useful for making plants with modulated biomass
  misc_feature: Functional homolog of the protein sequence given in SEQ ID NO 13414
  misc_feature: Useful for biocontainment applications
  misc_feature: Functional homolog of the protein sequence given in SEQ ID NO 14008
  misc_feature: Ceres ANNOT ID no. 8631933
  misc_feature (184)..(235): Pfam ID: AP2 Pfam Description: AP2 domain

SEQ ID NO: 14828 - DNA, 399 bp, Sorghum bicolor
  misc_feature: Ceres ANNOT ID no. 8631966
  misc_feature: Encodes the peptide sequence at SEQ ID NO 14829
atgacgttcaagcggaggaatggcggtcgcaacaagcacgggcgcggccacgtcaagtacatccgctgctccaactgcgcaaaatgctgtcctaaggataaggctatcaagcggttcttggtgaggaacattgtcgagcaggctgctgtgagagatgtgcaggaggcttgtgtgcatgatggatatgttcttcccaaattgtacgcaaaggttcatcactgtgtctcatgcgcaatccatgcgcacattgtccgtgtccgctctcgtgagaacaggaggaaccgtgagcccccgcagcgtttcaggcgccgggatgacggcccaaggccaggacagggcccaccgcgcccagggggtgctgcacctgcagctgcccctgcagccgctcctcgtacctaa

SEQ ID NO: 14829 - protein, 132 aa, Sorghum bicolor
  misc_feature: Useful for making plants with modulated nitrogen use efficiency
  misc_feature: Functional homolog of the protein sequence given in SEQ ID NO 14081
  misc_feature: Ceres ANNOT ID no. 8631966
  misc_feature (1)..(114): Pfam ID: Ribosomal_S26e Pfam Description: Ribosomal protein S26e
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRPGQGPPRPGGAAPAAAPAAAPRT

SEQ ID NO: 14830 - DNA, 960 bp, Sorghum bicolor
  misc_feature: Ceres ANNOT ID no. 8631975
  misc_feature: Encodes the peptide sequence at SEQ ID NO 14831
atgggattgccggtgatgaggagggagagggacgcggaggcggagctgaacctgccgccggggttccggttccaccccacagacgacgagctggtggagcactacctgtgccggaaagcggcggggcagcgcctcccggtgcccatcatcgcggaggtggacctatacaagttcgacccctgggacctgccggagcgcgcgctgttcggggtcagggagtggtacttcttcacgcccagggaccgcaagtacccaaacgggtcccgccccaaccgcgccgccggcaacgggtactggaaggccaccggcgccgacaagcccgtcgcgccgcggggccgcacgctcgggatcaagaaggcgctcgtcttctacgccgggaaggcgccgcgtggggtcaagacggactggatcatgcacgagtacaggctcgcggacgccggccgcgcagccgcctccaagaagggatcgctcaggctggatgactgggtgctgtgccgcctgtacaataagaagaacgagtgggagaagatgcagctggggaaggagtccgccgccggcgtcggcaccgccaaggaggaggcgatggacatgaccacctcgcactcgcactcccactcgcagtcgcactcgcactcgtggggcgagacgcgcacgccggagtcggagatcgtggacaacgacccgttcccggagctggactcgttcccggcgttccaggacccggcggcggcgatgatgatggtgcccaagaaggagcaggtggacgacggcagcgccgccgccaacgccgccaagagcagcgacctgttcgtggaccttagctacgacgacatccagggcatgtacagcggcctcgacatgctgcccccgccaggggaggacttcttctcctcgctcttcgcgtcgcccagggtcaaggggaaccagcccgccggagccgccgggttggggccattctga

SEQ ID NO: 14831 - protein, 319 aa, Sorghum bicolor
  misc_feature: The sequence is a functional homolog of SEQ ID NO 891 in the 10/374,780 US patent application
  misc_feature: The sequence is a functional homolog of SEQ ID NO 853 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 890 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with altered terpenoid content
  misc_feature: Functional homolog of the protein sequence given in SEQ ID NO 13966
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated light quality response
  misc_feature: Functional homolog of the protein sequence given in SEQ ID NO 13870
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 851 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 852 in the 10/374,780 US patent application
  misc_feature: Useful for making plants with modulated light quality sensitivity
  misc_feature: Functional homolog of the protein sequence given in SEQ ID NO 13618
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: Useful for making plants with modulated nitrogen use efficiency
  misc_feature: Functional homolog of the protein sequence given in SEQ ID NO 13624
  misc_feature: Useful for making plants with altered carbohydrate content
  misc_feature: Functional homolog of the protein sequence given in SEQ ID NO 13685
  misc_feature: The sequence is a functional homolog of SEQ ID NO 344 in the 10/666,642 US patent application
  misc_feature: Ceres ANNOT ID no. 8631975
  misc_feature (18)..(144): Pfam ID: NAM Pfam Description: No apical meristem (NAM) protein
MGLPVMRRERDAEAELNLPPGFRFHPTDDELVEHYLCRKAAGQRLPVPIIAEVDLYKFDPWDLPERALFGVREWYFFTPRDRKYPNGSRPNRAAGNGYWKATGADKPVAPRGRTLGIKKALVFYAGKAPRGVKTDWIMHEYRLADAGRAAASKKGSLRLDDWVLCRLYNKKNEWEKMQLGKESAAGVGTAKEEAMDMTTSHSHSHSQSHSHSWGETRTPESEIVDNDPFPELDSFPAFQDPAAAMMMVPKKEQVDDGSAAANAAKSSDLFVDLSYDDIQGMYSGLDMLPPPGEDFFSSLFASPRVKGNQPAGAAGLGPF

SEQ ID NO: 14832 - DNA, 663 bp, Sorghum bicolor
  misc_feature: Ceres ANNOT ID no. 8631984
  misc_feature: Encodes the peptide sequence at SEQ ID NO 14833
atggggctcacgttcaccaagctgttcagccggctgttcgccaagaaggagatgcggatcctcatggtggggctcgacgccgccggaaagaccaccatcctctacaagctcaagctcggcgagatcgtcaccaccatccccaccatcggattcaatgttgaaactgtggagtacaagaacatcagcttcactgtctgggatgtcgggggtcaggacaagatcaggccgctgtggaggcattacttccagaatacacagggtctcatcttcgttgtggacagcaatgatagggaccgtgttgttgaagcaagggatgagcttcaccggatgctgaatgaggatgagttgcgtgacgctgtgttgcttgtgttcgctaacaagcaagatcttccaaatgctatgaatgcagctgagattactgataagcttggactgcattcacttcgccagcgtcattggtacattcaaagcacttgtgctacaactggtgagggattgtacgaaggcctggattggctgtccagcaacattgcaagcaagctaaaaagagaagatgcgtcaattggttgccattatattacgagattctttcatggtccatatgaacacaatcacatcagaatgatggcattttcgccgatggcacggattctgtacttctga

SEQ ID NO: 14833 - protein, 220 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 12945
  misc_feature: Useful for making plants with modulated nitrogen use efficiency
  misc_feature: Functional homolog of the protein sequence given in SEQ ID NO 14003
  misc_feature: Useful for making plants with altered terpenoid content
  misc_feature: Functional homolog of the protein sequence given in SEQ ID NO 13081
  misc_feature: Ceres ANNOT ID no. 8631984
  misc_feature (5)..(177): Pfam ID: Arf Pfam Description: ADP-ribosylation factor family
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKLKREDASIGCHYITRFFHGPYEHNHIRMMAFSPMARILYF

SEQ ID NO: 14834 - DNA, 1599 bp, Sorghum bicolor
  misc_feature: Ceres ANNOT ID no. 8632042
  misc_feature: Encodes the peptide sequence at SEQ ID NO 14835
atgggaaactgctgtgccgcgccgttgacggaggagagcggcaagaaccgccccaagaagcagaaggcgaacccctacaacgtcgcgtacaaccgcggggcggcgccgccgtcggcgcgcccgggcctgctggtgctgcgggacccgacggggcgggacctcggcgcgcagtacgagctcggcggcgagctgggccgcggcgagttcggcatcacgtacctgtgcacggagtccgccacgggggcgcgctacgcgtgcaagtccatctccaagcgcaagctgcggacgcccgtcgacgtggaggacgtgcgccgggaggtggacatcatgcgccacatgcccgcgcaccccaacatcgtcagcctccgcgccgcctacgaggatgaggacgccgtgcacctcgtcatggagctctgcgagggaggggagctcttcgacaggatcgtcgcccggggccactacaccgagcgtgccgccgccgccgtcctgcgcaccatcgtggaggtcgtccagatgtgccacaggcatggcgtcatgcaccgggaccttaaaccagagaactttttatatgcaaacaagaaggagagttcccccctgaaagcaattgattttgggctgtctgtgttcttcaggcctggtgagcgattttctgaaatcgtaggcagtccatactacatggctccagaggttctaaagcgaaactatggccctgaagttgatgtctggagtgctggagtgatactttacatacttctttgtggtgtaccaccattttgggcagaaaccgaacagggagtagcacaggcaattatacgatctgtggtagatttcaaaagagaaccatggcccagagtatctgagcctgctaaagatcttgtcaggcggatgctggacccaaatccattgacacggtttactgcagcacaagtacttgagcatccatggctacatgactccaaaaagatgccagacatttctcttggtgatactgtccgagcaagattgcagcaatttgctgcaatgaacaagttaaagaagaaagcactaagggtgattgctgagcatctgtctgtggaggaagtagctgacataaagcagatgtttgataagatggatgtgaacaagaatggcaagttaacattcgaggaattcaaggccggccttcgtaaactgggaaaccaaatgcctgattcagatcttcagatattgatggatgctgctgatattgataaaaacgggaccctagattatggggaattcgtcactgtgtctgttcatgtgagaaaaataggcaacgatgaacacatcgagaaggccttcacatacttcgaccggaataagagtgggtatatagaaatcgaagagcttagagaggcgctatctgatgaactggatggaaatgatgaagacattatcaatggcatcatccgagatgtggacacagataaggacgggaagataagctacgatgagttcgcggcaatgatgaaggccggcactgactggaggaaggcgtctcggcagtactcgaggcaacggttcagcaacctgagcctgaagctccagaaggatgggtccctcagtgccgagacacgatag

SEQ ID NO: 14835 - protein, 532 aa, Sorghum bicolor
  misc_feature: The sequence is a functional homolog of SEQ ID NO 2 in US patent 7084323
  misc_feature: Ceres ANNOT ID no. 8632042
  misc_feature (1)..(530): SWISSPROT Homolog: EC 2.7.11.1 Non-specific serine/threonine protein kinase
  misc_feature (58)..(316): Pfam ID: Pkinase Pfam Description: Protein kinase domain
  misc_feature (363)..(391): Pfam ID: efhand Pfam Description: EF hand
  misc_feature (471)..(499): Pfam ID: efhand Pfam Description: EF hand
  misc_feature (435)..(463): Pfam ID: efhand Pfam Description: EF hand
MGNCCAAPLTEESGKNRPKKQKANPYNVAYNRGAAPPSARPGLLVLRDPTGRDLGAQYELGGELGRGEFGITYLCTESATGARYACKSISKRKLRTPVDVEDVRREVDIMRHMPAHPNIVSLRAAYEDEDAVHLVMELCEGGELFDRIVARGHYTERAAAAVLRTIVEVVQMCHRHGVMHRDLKPENFLYANKKESSPLKAIDFGLSVFFRPGERFSEIVGSPYYMAPEVLKRNYGPEVDVWSAGVILYILLCGVPPFWAETEQGVAQAIIRSVVDFKREPWPRVSEPAKDLVRRMLDPNPLTRFTAAQVLEHPWLHDSKKMPDISLGDTVRARLQQFAAMNKLKKKALRVIAEHLSVEEVADIKQMFDKMDVNKNGKLTFEEFKAGLRKLGNQMPDSDLQILMDAADIDKNGTLDYGEFVTVSVHVRKIGNDEHIEKAFTYFDRNKSGYIEIEELREALSDELDGNDEDIINGIIRDVDTDKDGKISYDEFAAMMKAGTDWRKASRQYSRQRFSNLSLKLQKDGSLSAETR

SEQ ID NO: 14836 - DNA, 975 bp, Sorghum bicolor
  misc_feature: Ceres ANNOT ID no. 8632003
  misc_feature: Encodes the peptide sequence at SEQ ID NO 14837
atgtgccacatgcgccagctccacccagattctgacaacgccttcccaacccgcatcgacagcgcgcacttggattcggcgacgccggagcgcggaggaggcaagcgccgatccagagacgatggccgccgcgggctcctcgccgtcatcctcctcaagcaagcgcccaggttggaagggaaggtggccctcgtcaccggtggcgccaccggcatcggcgaagccatcgttcgcctcttcacggagcacggcgccaaggtctgcatcgcggacatccaggacgaggccgggcagcagctgcgcgacgccctgggaggcgacgcgcagggcgtcatgttcgtccactgcgacgtgacgtcggaggaggacgtgagccgcgccgtggacgcggcggcggagcggttcggcgcgctggacgtgatggtgaacaacgcgggcgtgacgggtgccaaggtgacggacatccgtgccgtggacttcgccgaggtgcgccgggtgctcgacatcaacgtgcacggcgtgttcctggggatgaagcacgcggcgcgcgtcatgatcccgcagaagcggggctccatcgtgtcgctggccagcgtggccagcgccatcggcgggctgggcccgcacgcgtacacggcgtccaagcacgccgtggtcgggctcaccaagagcgtcgccgcggagctcggccgccacggggtgcgcgtcaactgcgtgtccccctacgccgtgcccacggcgctgtccatgccgcacctgccccagggcgcgcgcgccgacgacgcgctcacggacttcctggccttcgtcggcggcgaggccaacctcaagggcgtcgacgccatgcccaaggacgtcgcccaggcggtgctatacctggccagcgacgaggcgaggtacgtcagcgcgctcaacctcatggtggacggcggcttcacagccgtcaaccataacctcaggccattcgatgattag

SEQ ID NO: 14837 - protein, 324 aa, Sorghum bicolor
  misc_feature: Useful for making plants with modulated salt sensitivity
  misc_feature: Functional homolog of the protein sequence given in SEQ ID NO 14082
  misc_feature: Useful for making plants with modulated drought sensitivity
  misc_feature: Useful for making plants with modulated water use efficiency
  misc_feature: Functional homolog of the protein sequence given in SEQ ID NO 14083
  misc_feature: Ceres ANNOT ID no. 8632003
  misc_feature (57)..(322): SWISSPROT Homolog: EC 1.1.1.288 Xanthoxin dehydrogenase
  misc_feature (61)..(230): Pfam ID: adh_short Pfam Description: short chain dehydrogenase
MCHMRQLHPDSDNAFPTRIDSAHLDSATPERGGGKRRSRDDGRRGLLAVILLKQAPRLEGKVALVTGGATGIGEAIVRLFTEHGAKVCIADIQDEAGQQLRDALGGDAQGVMFVHCDVTSEEDVSRAVDAAAERFGALDVMVNNAGVTGAKVTDIRAVDFAEVRRVLDINVHGVFLGMKHAARVMIPQKRGSIVSLASVASAIGGLGPHAYTASKHAVVGLTKSVAAELGRHGVRVNCVSPYAVPTALSMPHLPQGARADDALTDFLAFVGGEANLKGVDAMPKDVAQAVLYLASDEARYVSALNLMVDGGFTAVNHNLRPFDD

SEQ ID NO: 14838 - DNA, 2322 bp, Sorghum bicolor
  misc_feature: Ceres ANNOT ID no. 8632040
  misc_feature: Encodes the peptide sequence at SEQ ID NO 14839
atgacggtgacgccgaggattacggtgggggatgggcggctggtggcgcacgggcggaccatcctcaccggcgtgccggacaacatcgcgctcacgcacgcctccggtgcggggctcgtcgacggcgccttcgtcggcgccacggccgccgagcccagtagcatgcacgtcttcaccttcggcaccctccgggagctgcggttcatgtgctgcttccggttcaagctatggtggatgacccagcgcatgggcacctccggccgcgacgtcccgctggagacacagttcatgctcctggagagccgcccaggcacgggcgacaccaccggcggcggcggcgacggcgacagcggcgagacggtgtacgttgtgatgctgccgctgctggagggccaattccgggcggcgctgcagggcaacgaccgcgacgagctggagatcaccctcgagagcggggacaaggcggtgcagacggcgcaggggacctacatggtgtacgtgcacgccgggaccaaccctttcgacaccatcactcaggccgtcaaggtggtggagaggcacctgcaaacgttccatcacagggagaagaaaaagctgccgtcgttcgtggactggttcggctggtgcacgtgggacgccttctacaccgacgtcaccgccgagggcgtcaagcaaggtctcaagagcttggcggagggcggcacgccgccgcggttcctgatcatcgacgacgggtggcagcagatcggcagcgagaacaaggaggagtccaacaacgccgtcgtccaggaaggagcgcagttcgcaagcaggctgacagggatcaaggagaacgccaagttccagaagaagaagaataagaagaagagcgacgacgacaaggatggcggcgatgatcagcaggcccaggcgccggggctgaagctggtggtggaggaggcgaagcgcgaccacggcgtgaagtacgtgtacgtgtggcacgccatggcggggtactggggcggcgtgaagccggcggcggaagggatggagcactacgagagcgcgctggcgtacccggtgcagtcccccggggtgatgggcaaccagccggacatcgtcatggactcgctctccgtgctgggcctggggctggtgcacccgcgcagggtgctcagcttctacgacgagctgcactcgtacctcgcctcctgcggcgtcgacggcgtcaaggtggacgtgcagaacatcatcgagacgctcggcgccgggcacggcggccgcgtcgcgctcacccgcgcctaccaccgcgcgctcgaggcctccgtcgcccgcaacttccccgacaacggctgcatctcctgcatgtgccacaacaccgacatgctctacagcgcgcgacagaccgccgtcgtccgcgcctccgacgacttctacccgcgcgacccggcgtcgcacaccgtccacgtctcctccgtcgcctacaacaccctcttcctcggcgagttcatgcagccagactgggacatgttccatagcctgcacccggcggcggagtaccacggcgcggcgagggcgatcggcggctgcccgatctacgtcagcgacaagccaggcaaccacaacttcgagctgctcaagaagctggtcctccccgacggctccgtgctccgcgcgcagctccccggccgccccacccgcgactgcctcttcgccgacccggcacgcgacggcaccagcctgctcaagatctggaacgtgaacaagtgcacgggcgtggtgggcgtgttcaactgccagggcgccgggtggtgccgcgtcaccaagaagacccgcgtgcacgacgccgcgccggggacgctgacgggatcaatccgcgccgacgacgtggacgcgatcgccggcctcgcgggggccggctggagcggcgaggccgtcgtgtacgcctacaggtcgggggagctcgtcaggctgcccggtggcgccacgctgccggtgacgctcaaggtgctggagtacgaggtgttccacgtctgccccgtcagcggggtcgcgccgggcgtgtcgttcgcgcccatcggcctgctcgacatgttcaactccggcggggcggtggagcagtgcgaggtccgcggcggcggcggtggcgcgggcgccgtcgtcgcgctcagggtccgcggctgcggccggttcggcgcgtactgctcgcggaggcccgcgaggtgcaggctggacgcggcggaggtggacttcagctacgacgacgacacggggctcgtcgcgctccatatccccgtgccggagcaggagttctacagatgggacctggagatcgatgtctag

SEQ ID NO: 14839 - protein, 773 aa, Sorghum bicolor
  misc_feature: Useful for making plants with altered carbohydrate content
  misc_feature: Functional homolog of the protein sequence given in SEQ ID NO 14032
  misc_feature: Ceres ANNOT ID no. 8632040
  misc_feature (306)..(771): SWISSPROT Homolog: EC 2.4.1.67 Galactinol--raffinose galactosyltransferase
  misc_feature (7)..(757): Pfam ID: Raffinose_syn Pfam Description: Raffinose synthase or seed imbibition protein Sip1
MTVTPRITVGDGRLVAHGRTILTGVPDNIALTHASGAGLVDGAFVGATAAEPSSMHVFTFGTLRELRFMCCFRFKLWWMTQRMGTSGRDVPLETQFMLLESRPGTGDTTGGGGDGDSGETVYVVMLPLLEGQFRAALQGNDRDELEITLESGDKAVQTAQGTYMVYVHAGTNPFDTITQAVKVVERHLQTFHHREKKKLPSFVDWFGWCTWDAFYTDVTAEGVKQGLKSLAEGGTPPRFLIIDDGWQQIGSENKEESNNAVVQEGAQFASRLTGIKENAKFQKKKNKKKSDDDKDGGDDQQAQAPGLKLVVEEAKRDHGVKYVYVWHAMAGYWGGVKPAAEGMEHYESALAYPVQSPGVMGNQPDIVMDSLSVLGLGLVHPRRVLSFYDELHSYLASCGVDGVKVDVQNIIETLGAGHGGRVALTRAYHRALEASVARNFPDNGCISCMCHNTDMLYSARQTAVVRASDDFYPRDPASHTVHVSSVAYNTLFLGEFMQPDWDMFHSLHPAAEYHGAARAIGGCPIYVSDKPGNHNFELLKKLVLPDGSVLRAQLPGRPTRDCLFADPARDGTSLLKIWNVNKCTGVVGVFNCQGAGWCRVTKKTRVHDAAPGTLTGSIRADDVDAIAGLAGAGWSGEAVVYAYRSGELVRLPGGATLPVTLKVLEYEVFHVCPVSGVAPGVSFAPIGLLDMFNSGGAVEQCEVRGGGGGAGAVVALRVRGCGRFGAYCSRRPARCRLDAAEVDFSYDDDTGLVALHIPVPEQEFYRWDLEIDV

SEQ ID NO: 14840 - DNA, 1368 bp, Sorghum bicolor
  misc_feature: Ceres ANNOT ID no. 8632048
  misc_feature: Encodes the peptide sequence at SEQ ID NO 14841
atggcgcccctacccctacccctcctcgcgctgctcttcttgtcgagcaccctcgaggcagtagtaggcgccagcaacgccaacgacacctcagctgacggcgcgagctacacgtgcagctctggcagcagcaggttcctggcgttgccgtcgtcgtcgtcccactcccaccggagcgtgttcagcctcgaccgctacggtgcccgtggcgacgggaggcacgacgacacgcgcgcgctcgccgcggcgtggaaggcggcgtgcgcctcgccgcggccggccgccgtgctcgtccccaacggcaggcgctacctgctcaaggtcgtcaccctccgtggcccgtgcaagtccaccgtcgcggtcaccgtgaaaggcacgctggtggcgtcgccgaacagggcggactggagcgacagggataggaggctctggatcgtgttccggagcatcaacaagctcactctcaacggcggtggcgccatcgacggcaacggacacaagtggtggccgtactcgtgcaagatcaacaagggcctgccttgcaaggaggctccaacggctttgtcattccactactgcaccaatctgagggtggacaatctgaaaattgtgaatagccaacagatccacatgtcggtcgaggattccaccaatgtgcaactggcgaagttgtccatcacagcacctggcacgagccctaacactgatggcattcacatcactcggagcaaagatgtgcgggtcacaaattgcaagatcaagactggggatgattgcatatcaatcgaggacgggactcataaacttcatgtctccaatgttgtttgtggtcctgggcacgggattagcatcggaagcttaggagatgacaactcacgagcccaggtctctggtattaccatagattcagtacaattacatggcacaaccaatggagcacggatcaagacataccagggaggaagtggatacgccaaggacatcacattccagaacatgatcatgtacaatgtcaagaacccgataatcatcgaccaaaactattgcgacaaggctaagccatgcagggaacaaaggtcagcagtgcagattagcaatgttgtcttcaagaacattagagggacaactattaccaaggatgctatcaagatgcactgcagcaagaatgttccatgccaaggcattacactgcagaacattgacctgaaaatgcagggtggcaagggaaacacagaaagtacatgccagaatgcaaaatggagaaaatacggaaaggttgttccacagccgtgcacctccaaaatcatgggcacatttggagacctcttggagttcctgttggcttcagactcgtggagttcctggtaa

SEQ ID NO: 14841 - protein, 455 aa, Sorghum bicolor
  misc_feature: Useful for making plants with altered carbohydrate content
  misc_feature: Functional homolog of the protein sequence given in SEQ ID NO 13985
  misc_feature: Useful for making plants with altered cell wall content and/or composition
  misc_feature: Functional homolog of the protein sequence given in SEQ ID NO 14051
  misc_feature: Ceres ANNOT ID no. 8632048
  misc_feature (63)..(428): SWISSPROT Homolog: EC 3.2.1.15 Polygalacturonase
  misc_feature (88)..(431): Pfam ID: Glyco_hydro_28 Pfam Description: Glycosyl hydrolases family 28
MAPLPLPLLALLFLSSTLEAVVGASNANDTSADGASYTCSSGSSRFLALPSSSSHSHRSVFSLDRYGARGDGRHDDTRALAAAWKAACASPRPAAVLVPNGRRYLLKVVTLRGPCKSTVAVTVKGTLVASPNRADWSDRDRRLWIVFRSINKLTLNGGGAIDGNGHKWWPYSCKINKGLPCKEAPTALSFHYCTNLRVDNLKIVNSQQIHMSVEDSTNVQLAKLSITAPGTSPNTDGIHITRSKDVRVTNCKIKTGDDCISIEDGTHKLHVSNVVCGPGHGISIGSLGDDNSRAQVSGITIDSVQLHGTTNGARIKTYQGGSGYAKDITFQNMIMYNVKNPIIIDQNYCDKAKPCREQRSAVQISNVVFKNIRGTTITKDAIKMHCSKNVPCQGITLQNIDLKMQGGKGNTESTCQNAKWRKYGKVVPQPCTSKIMGTFGDLLEFLLASDSWSSW

SEQ ID NO: 14842 - DNA, 3243 bp, Sorghum bicolor
  misc_feature: Ceres ANNOT ID no. 8632052
  misc_feature: Encodes the peptide sequence at SEQ ID NO 14843
atggacggtggcggtaacggcggcgacgctgcgaattctgggaagcatggggccgggcatgtgtgccagatctgcggcgatggcgtgggcaccgcggcggacggcgagctcttcaccgcctgcgacgtctgcggcttcccagtgtgccggccctgctacgagtacgagcgcaaggacggcacccaggcgtgcccgcagtgcaagaccaagtacaagcgtcacaaggggagcccaccagtacacggtgaggaaaatgaggatgtggatgctgatgatgtgagtgactacaactaccaagcatccggcaaccaggaccagaagcaaaagattgctgagagaatgctcacctggcggacaaactcacgtggcagtgatattggcctggctaagtatgacagtggtgagattgggcatgggaagtatgacagtggtgagatccctcgtggatatatcccgtcactaactcatagccagatctcaggagagatacctggagcttcccctgatcatatgatgtctcctgttgggaacattggcaggcgtggacatcaatttccttatgtcaatcattctccaaacccatcgagggagttctctggtagccttggcaatgttgcatggaaagagagagtggatggatggaaaatgaaggacagaggtgcaattcctatgactaatgggacaagcattgctccgtcagaagggcgtggacttaatgatattgatgcttctactgattataacatggaagatgccttactgaatgatgaaactcggcaacctctttctaggaaagtgccaattccttcatccagaataaatccatacagaatggtcattgttttacgtttggttgttctatgcatattcctgcgctaccgtatcacacatcctgtgaacaatgcatatccactgtggctgttatccgtcatatgtgagatttggtttgctctgtcctggattttggatcagttcccaaagtggtccccaatcaaccgtgaaacttatcttgataggctggctttaaggtatgaccgagaaggtgaaccgtctcaattagctcctgttgacatttttgtcagtactgtggatcctatgaaggagcctcctcttgtcactgcaaatactgtgctttccatccttgctgttgactatccggttgacaaggtatcttgctatgtttctgatgatggggctgctatgctgacttttgatgcgctctctgaaacttcagagtttgctagaaaatgggttccattctgtaagaagtacaacatagagcctagggccccagagtggtactttgctcagaaaattgattacttgaaagacaaagttcaaacttcatttgtgaaagaacgccgggccatgaagagagaatatgaagaattcaaagtccgtatcaatgccctagtagccaaggcacaaaaagttcctgaggagggatggatcatgcaagatggtacaccttggcctgggaacaatactagggaccatcctggaatgattcaggttttcctaggtcacagtggaggccttgacgttgacggcaatgaacttcctcgtttggtttatgtgtctcgtgaaaaacgtcctggattccaacatcacaagaaggctggtgccatgaatgcacttgttcgtgtatcagctgtccttactaatgggcaatacatgttgaatcttgactgcgaccactacatcaataatagcaaggctctccgagaagctatgtgcttccttatggacccaaacctaggaaggaatgtctgttatgtccaatttcctcagaggtttgatggtattgataggaatgaccgatatgcaaacaggaacactgtgtttttcgatattaacttgagaggtcttgatggcattcaagggccagtttatgtgggaactggttgtgtgtttaacagaacagccctatatggttacgagcctccagtgaagaagaaaaaaccaggcttcttctcttcgctttgtgggggaaggaaaaagacgtcaaagtctaagaagagctcagaaaagaagaagtcacacagacacgcagacagttctgtaccagtatttaatcttgaagatatagaggaagggattgaaggttctcaatttgatgatgagaaatcgctgattatgtctcaaatgagcctggagaagagatttggccagtccagtgtttttgtagcctccacccttatggaatatggcggtgttccacaatctgcaactccagagtctcttctgaaagaagctattcatgtcatcagctgtggctatgaggacaaaactgactggggaactgagatcggatggatctatggttctgttacagaagatattctcactggattcaagatgcatgctcgaggctggcgatcaatctactgcatgcctaagcgaccagctttcaagggatctgctcctatcaacctttcggatcgtttgaatcaagtgcttcggtgggctcttggttccattgaaattcttttcagcaggcattgtcccatatggtatggctatggaggacggcttaaatttctggagagatttgcttatattaacacaacaatttatcccctcacatcaatcccgctgctcctgtactgcatattgccagcagtttgccttctcactgggaagttcatcatcccaaagattagtaatctggagagtgtttggtttatatcgctctttatctcgatctttgccactggtatccttgagatgaggtggagtggtgttggcattgatgaatggtggaggaacgagcagttttgggttattggtggtatttctgcgcatttatttgccgtcttccagggtctcctaaaggtgcttgctggtattgacacgagcttcactgtcacctctaaggccactgatgaagaaggtgattttgccgagctctacatgttcaagtggacaacgcttctgatcccaccaaccactattttgattatcaacctgatcggtgtggttgctggcacttcctatgcgatcaatagtggttaccagtcatgggggcctctttttgggaagctcttcttcgcgttctgggtgattgtccacttgtaccccttcctcaagggcctcatggggaagcagaaccgcacgccgaccattgttcttgtatgggctaccctccttgcatcgatattttccctgctgtgggttcgtatcgatccattcaccacccgggtcactggtcccccaattggtaattgcggcatcaactgctag

SEQ ID NO: 14843 - protein, 1080 aa, Sorghum bicolor
  misc_feature: The sequence is a functional homolog of SEQ ID NO 6 in US patent 7285702
  misc_feature: Useful for making plants with altered carbohydrate content
  misc_feature: Functional homolog of the protein sequence given in SEQ ID NO 13628
  misc_feature: Useful for making plants with altered cell wall content and/or composition
  misc_feature: Functional homolog of the protein sequence given in SEQ ID NO 14084
  misc_feature: Useful for making plants with modulated biomass
  misc_feature: Functional homolog of the protein sequence given in SEQ ID NO 14061
  misc_feature: The sequence is a functional homolog of SEQ ID NO 26 in US patent 7312377
  misc_feature: The sequence is a functional homolog of SEQ ID NO 2 in US patent 7049481
  misc_feature: Ceres ANNOT ID no. 8632052
  misc_feature (22)..(1080): SWISSPROT Homolog: EC 2.4.1.12 Cellulose synthase (UDP-forming)
  misc_feature (261)..(1075): Pfam ID: Cellulose_synt Pfam Description: Cellulose synthase
MDGGGNGGDAANSGKHGAGHVCQICGDGVGTAADGELFTACDVCGFPVCRPCYEYERKDGTQACPQCKTKYKRHKGSPPVHGEENEDVDADDVSDYNYQASGNQDQKQKIAERMLTWRTNSRGSDIGLAKYDSGEIGHGKYDSGEIPRGYIPSLTHSQISGEIPGASPDHMMSPVGNIGRRGHQFPYVNHSPNPSREFSGSLGNVAWKERVDGWKMKDRGAIPMTNGTSIAPSEGRGLNDIDASTDYNMEDALLNDETRQPLSRKVPIPSSRINPYRMVIVLRLVVLCIFLRYRITHPVNNAYPLWLLSVICEIWFALSWILDQFPKWSPINRETYLDRLALRYDREGEPSQLAPVDIFVSTVDPMKEPPLVTANTVLSILAVDYPVDKVSCYVSDDGAAMLTFDALSETSEFARKWVPFCKKYNIEPRAPEWYFAQKIDYLKDKVQTSFVKERRAMKREYEEFKVRINALVAKAQKVPEEGWIMQDGTPWPGNNTRDHPGMIQVFLGHSGGLDVDGNELPRLVYVSREKRPGFQHHKKAGAMNALVRVSAVLTNGQYMLNLDCDHYINNSKALREAMCFLMDPNLGRNVCYVQFPQRFDGIDRNDRYANRNTVFFDINLRGLDGIQGPVYVGTGCVFNRTALYGYEPPVKKKKPGFFSSLCGGRKKTSKSKKSSEKKKSHRHADSSVPVFNLEDIEEGIEGSQFDDEKSLIMSQMSLEKRFGQSSVFVASTLMEYGGVPQSATPESLLKEAIHVISCGYEDKTDWGTEIGWIYGSVTEDILTGFKMHARGWRSIYCMPKRPAFKGSAPINLSDRLNQVLRWALGSIEILFSRHCPIWYGYGGRLKFLERFAYINTTIYPLTSIPLLLYCILPAVCLLTGKFIIPKISNLESVWFISLFISIFATGILEMRWSGVGIDEWWRNEQFWVIGGISAHLFAVFQGLLKVLAGIDTSFTVTSKATDEEGDFAELYMFKWTTLLIPPTTILIINLIGVVAGTSYAINSGYQSWGPLFGKLFFAFWVIVHLYPFLKGLMGKQNRTPTIVLVWATLLASIFSLLWVRIDPFTTRVTGPPIGNCGINC

SEQ ID NO: 14844 - DNA, 1224 bp, Sorghum bicolor
  misc_feature: Ceres ANNOT ID no. 8632069
  misc_feature: Encodes the peptide sequence at SEQ ID NO 14845
atggacacctcgcggggggtcgcgtgcctgctcgtggcggtcatctgcttgtcgtgcgccgccgccgccgccgcgaggtcgccggccgcgaggctgcaccgccacctcaagcggctcaacaaaccggccgtgaagagtatcgagagtccagacggggacatgatagactgcgtgcacatctcacatcagccagcgtttgatcacccctacctcaagaatcacacaatccagatgaggccgaactaccaccccgaaggcctgttcgacgaatccaagacctccagcagcagtggggagaggcctatggttcagctctggcatcagaatgggatgtgtcctgaaggtacagtccccatcaggagaacgaagaaggacgacctgctcagggcaagctcaatgcggcggtacggcaggaagcggcacaccaccgcgaacccaatgtccgtcaaccccaccatgctcaacgagggtggccatcagcatgccatagcgtatgttcagggagacaagtactatggcgccaaggcgactatcaatgtgtgggagcccaagatcgagcagcctaacgagttcagcttgtcccagctctggatcttggggggctcatttggggaggatctgaacagcatcgaggctggatggcaggttagtccagacctctatggggataacaacacaaggctgttcacgtactggactagtgatgcataccaggcaacagggtgctacaacatgctgtgctcagggttcattcaggttaacaaccagattgccatgggagccagcatcttcccaacctcaagctactctggttcccaatatgatatcagtatactgatctggaaggacccaaaggagggcaactggtggatgcaattcggcaaggattacgtgctcggctactggccgtcctttctcttctcgtacctggcggacagcgcttcgatgatcgagtggggtggggaggtggtgaactcgcagccagacggcgtgcacacctcgacgcagatgggcagcgggcacttcccggaggaagggttcagcaaggcgagctacttcaagaacatccaggtggtggacagcaccaacaacctcaaggcccccaaggggctgggcaccttcactgagcagtcaaactgctacgacgtgcagaacggcaacaacggcgactggggcacctacttctactacggcggccctgggaggagctccaactgccagtaa

SEQ ID NO: 14845 - protein, 407 aa, Sorghum bicolor
  misc_feature: Useful for biocontainment applications
  misc_feature: Functional homolog of the protein sequence given in SEQ ID NO 14085
  misc_feature: Ceres ANNOT ID no. 8632069
MDTSRGVACLLVAVICLSCAAAAAARSPAARLHRHLKRLNKPAVKSIESPDGDMIDCVHISHQPAFDHPYLKNHTIQMRPNYHPEGLFDESKTSSSSGERPMVQLWHQNGMCPEGTVPIRRTKKDDLLRASSMRRYGRKRHTTANPMSVNPTMLNEGGHQHAIAYVQGDKYYGAKATINVWEPKIEQPNEFSLSQLWILGGSFGEDLNSIEAGWQVSPDLYGDNNTRLFTYWTSDAYQATGCYNMLCSGFIQVNNQIAMGASIFPTSSYSGSQYDISILIWKDPKEGNWWMQFGKDYVLGYWPSFLFSYLADSASMIEWGGEVVNSQPDGVHTSTQMGSGHFPEEGFSKASYFKNIQVVDSTNNLKAPKGLGTFTEQSNCYDVQNGNNGDWGTYFYYGGPGRSSNCQ

SEQ ID NO: 14846 - DNA, 1311 bp, Sorghum bicolor
  misc_feature: Ceres ANNOT ID no. 8632054
  misc_feature: Encodes the peptide sequence at SEQ ID NO 14847
atggcgtccctcctcgcgctgctccttgtgtccggcgcttccaacggcacctcgtctgacggcaccagctacctgcgcagctcaggtgccagcggacccgccgccgcgcccaggagcagcagcaggtcgctggcaatggcaatggcaatggcaatggcatcatcgtctcaccaccagagcgtgttcagcctcgacagctacggcgcccgtggcgacgggaggcacgacgacacgccggcgctggagaaggcgtgggaggcggcgtgcgcctcgccacggccggccgtcgtgctcgtccccaacggcgggcgctacctgctcaagctcgtcaccctccgtggcccgtgcaagtccagcgtcacgctcacggtgaagggcacgctggtggcgtcgccggacagggcggactggagcgacaaggacaggaggcactggatcgtgttccgaagggtcaacaagctcaccgtcaatggcggtggcaccatcgacggcaatggccagaaatggtggccacactcgtgcaagatcaacaagactctgccttgcaaggtagctccaacggctttgtcattccaccactgcacgaatctgagagtggacaatctgaaaattatgaacggccagcaaatgcacatgtcagtcgaggattgcacggatgtggtattagcacggttatccatcacagcgccggccaggagccctaacactgacggcatccacatcactcggagcaaaaatgtacgggtcacaaattgcaagatcaagactggggatgactgcatgtcaatcgagaacgggactcataaccttcatgtctccaaagtggtttgtggtccggggcacgggatcagcatcggaagcttaggagacgacaactcacgagctgaagtctctggcattaccatagattcggtgcaactatatggcacgacaaatggagcacgcatcaagacgtaccagggaggaagtgggtacgccaaggacatcacgttccaaaacatgatcatgtacggtgtcaagaacccgataatcatcgaccagaactactgcgacaaagctacgccatgcgctgaacaaagatcagcggtgcgggttagcaatgttgtcttcaagaacattagagggacaaccatcaccaagcatgccatcaagatgaactgcagcaagaatgtcccatgccaaggaattaccttaaagaacattgacatgaaactaaagggcggcaagggcaacatagatagcacatgccagaatgccaagtggagaaaatctgggtttgttcacccacagccttgcattgccacaaagtag

SEQ ID NO: 14847 - protein, 436 aa, Sorghum bicolor
  misc_feature: Useful for making plants with altered carbohydrate content
  misc_feature: Functional homolog of the protein sequence given in SEQ ID NO 13985
  misc_feature: Useful for making plants with altered cell wall content and/or composition
  misc_feature: Functional homolog of the protein sequence given in SEQ ID NO 14051
  misc_feature: Ceres ANNOT ID no. 8632054
  misc_feature (63)..(429): SWISSPROT Homolog: EC 3.2.1.15 Polygalacturonase
  misc_feature (89)..(432): Pfam ID: Glyco_hydro_28 Pfam Description: Glycosyl hydrolases family 28
MASLLALLLVSGASNGTSSDGTSYLRSSGASGPAAAPRSSSRSLAMAMAMAMASSSHHQSVFSLDSYGARGDGRHDDTPALEKAWEAACASPRPAVVLVPNGGRYLLKLVTLRGPCKSSVTLTVKGTLVASPDRADWSDKDRRHWIVFRRVNKLTVNGGGTIDGNGQKWWPHSCKINKTLPCKVAPTALSFHHCTNLRVDNLKIMNGQQMHMSVEDCTDVVLARLSITAPARSPNTDGIHITRSKNVRVTNCKIKTGDDCMSIENGTHNLHVSKVVCGPGHGISIGSLGDDNSRAEVSGITIDSVQLYGTTNGARIKTYQGGSGYAKDITFQNMIMYGVKNPIIIDQNYCDKATPCAEQRSAVRVSNVVFKNIRGTTITKHAIKMNCSKNVPCQGITLKNIDMKLKGGKGNIDSTCQNAKWRKSGFVHPQPCIATK

SEQ ID NO: 14848 - DNA, 876 bp, Sorghum bicolor
  misc_feature: Ceres ANNOT ID no. 8632075
  misc_feature: Encodes the peptide sequence at SEQ ID NO 14849
atgagggacttcccttcctgcttcggcgagagcggcgtccagatcgcggacgcgtcgtcgtcgtcgtccagcgccggcaagggcgcggcgcagaacctggtgacctgcctctaccagacgcagttctcgggccggccctgcgtgatctcgctcacgtggagcaagagcctcatggggcagggcctcagcatcggcgtcgacgacctgtccggccactgcctctgcaaggcggacatcaagccgtggctcttctccaagaagaaggggtccaagagcctcgacgtcgaggacggcaagatcgacatcttctgggacctgtcgggcgccaagttcggtgccgggccagaaccggtggaggggttctatgttgcggtggtgttcgaccttgagctcgtgctcttgctgggggacatgaagaaggatgcgtacaggaagactggagccaaccgatcgatgctgaatgccgcgttcgtggcgaggaaggagcacatatatggcaagaagatctactctgccaaggcgcaattctgcaacaatggccagttccatgacattgccatagagtgcgataccgtcggcttgaaggatccatgtcttgaaataagagttgataagaagcccgtgatgcaggtgaagcgcctggcgtggaagtttaggggaaatcagacaattctcgttgatggcttgcctgtggaggtgttctgggatgttcacagttggctctttggatcaacgacgagcaatgcggtgttcatgtttcagacatgccaggcacctgagaagtcgctgccatggtcctactcgcagatttttagggagtcccagttgcaaggtcttggtttctcgctgatcctgcatgcgtggaaggttgaatag

SEQ ID NO: 14849 - protein, 291 aa, Sorghum bicolor
  misc_feature: Useful for making plants with modulated nitrogen use efficiency
  misc_feature: Functional homolog of the protein sequence given in SEQ ID NO 14086
  misc_feature: Ceres ANNOT ID no. 8632075
MRDFPSCFGESGVQIADASSSSSSAGKGAAQNLVTCLYQTQFSGRPCVISLTWSKSLMGQGLSIGVDDLSGHCLCKADIKPWLFSKKKGSKSLDVEDGKIDIFWDLSGAKFGAGPEPVEGFYVAVVFDLELVLLLGDMKKDAYRKTGANRSMLNAAFVARKEHIYGKKIYSAKAQFCNNGQFHDIAIECDTVGLKDPCLEIRVDKKPVMQVKRLAWKFRGNQTILVDGLPVEVFWDVHSWLFGSTTSNAVFMFQTCQAPEKSLPWSYSQIFRESQLQGLGFSLILHAWKVE

SEQ ID NO: 14850 - DNA, 1461 bp, Sorghum bicolor
  misc_feature: Ceres ANNOT ID no. 8632096
  misc_feature: Encodes the peptide sequence at SEQ ID NO 14851
atgaacgaagcagcggccaccacgaagaaactgaacttggtgctgttcccatggctggcgttcggccacatgatcccgtacctggagctcgccaagcgcctggcggcgcggggccacgccgtcaccttcctttccacgccgaggaacgtcgccaggctcccgccggtgccggcggacctgtcgccccgcgtgcacctcgtggcgctgcccgcgcccgtcgtggacggcctgcccgagggtgccgagtccacggccgacgtgccgccggagatgaacgagctcataaagaaggcggtcgacggcctggccgccccgttcgcggcgttcctcgcggacgccgttgccgacgacggtgggaggaggcccgactggatcgtcatggacttctgccaccactggctccccgcgatcgccgaggcgcacggggtgccgtgcgccgcgttccttatcgtgcagcccaccgcgatcgcgttcctgggcccgcggtgggcgcaggccgcgcacccgcgcacgacgctggaggacttcgccgcgccgcccaggtggtgctcgtccttcccttccgccatcgcctaccgccgccacgaagccggctgggctgtcgacgcgttccggcccaacgcgtccggggtgtccgacatagaacgcatgtggcagatcatagagcgcacccgcttcaccatctaccgcagctgcgacgaggtcgagcccggggtgttcgcgctcctcaccgatctcttccacaagccggccgtccccgccggcgtcctcttacagcccgacattgccgatggcaacagcagctcccgctcagctggtgcccgctccgaggtgcttcaatggctggacaggcagccaccaaagtccaccatctacgtcgcgcttgggagcgaggcgccgctgacggccagcaacctgcacgagctcgcgctggggctggaactcgccggcgtccgcttcctatgggctttccggaagccgagcggcatgtcagcgcccaccagcagcaccgacgtggccgagctgctgcctgcggggttcgagggccgaacacggggtcacgccctcgtgtggtcggggtgggtgccacaggtggctgtgctcgcgcacgccgcggtgggcgcgttcctgacgcactgcgggtggggctccaccatcgagagcctcgtgttcgggcgcccgctggtcatgctgccgttcgtcgtcgaccagggcctcatcgcacggacgatggcggagcggggcgtcggcgtggaggtggcgagggacgaggtagacggctcgtttggcagagacggcgtcgcggcggcggtgcggagcgtcatggtggaggaacagggagaggtgttcgccagcaacgcggagaggctggagcgagttctccgtgatcagcgacggcaggatcagtacatggacgagcttgtggggtgtctgaaacgctacaaggaagacagctgctag

SEQ ID NO: 14851 - protein, 486 aa, Sorghum bicolor
  misc_feature: Useful for making plants with altered carbohydrate content
  misc_feature: Functional homolog of the protein sequence given in SEQ ID NO 14087
  misc_feature: Ceres ANNOT ID no. 8632096
  misc_feature (208)..(462): SWISSPROT Homolog: EC 2.4.1.236 Flavanone 7-O-glucoside 2''-O-beta-L-rhamnosyltransferase
  misc_feature (12)..(482): Pfam ID: UDPGT Pfam Description: UDP-glucoronosyl and UDP-glucosyl transferase
MNEAAATTKKLNLVLFPWLAFGHMIPYLELAKRLAARGHAVTFLSTPRNVARLPPVPADLSPRVHLVALPAPVVDGLPEGAESTADVPPEMNELIKKAVDGLAAPFAAFLADAVADDGGRRPDWIVMDFCHHWLPAIAEAHGVPCAAFLIVQPTAIAFLGPRWAQAAHPRTTLEDFAAPPRWCSSFPSAIAYRRHEAGWAVDAFRPNASGVSDIERMWQIIERTRFTIYRSCDEVEPGVFALLTDLFHKPAVPAGVLLQPDIADGNSSSRSAGARSEVLQWLDRQPPKSTIYVALGSEAPLTASNLHELALGLELAGVRFLWAFRKPSGMSAPTSSTDVAELLPAGFEGRTRGHALVWSGWVPQVAVLAHAAVGAFLTHCGWGSTIESLVFGRPLVMLPFVVDQGLIARTMAERGVGVEVARDEVDGSFGRDGVAAAVRSVMVEEQGEVFASNAERLERVLRDQRRQDQYMDELVGCLKRYKEDSC

SEQ ID NO: 14852 - DNA, 1317 bp, Sorghum bicolor
  misc_feature: Ceres ANNOT ID no. 8632093
  misc_feature: Encodes the peptide sequence at SEQ ID NO 14853
atgagcagtccccatggcggcctcgacgaccagatcgagcggctcatgcagtgcaagccgctcgctgagcccgaggtcagagctctgtgtgagaaggcaaaggagattctgatggaggaaagcaatgttcagcctgtaaagagtcctgttactatatgcggtgatattcatggacaatttcacgatcttgctgaactcttccgaattggtggaaagtgtccagatacgaactacctgtttatgggagattatgttgaccgtggttactactctgtcgaaactgtcacacttttggtggctttaaaagttcgatatcctcagaggatcaccattctcagaggaaaccatgaaagccgacagattactcaagtttatggattctatgatgaatgcttaaggaagtatggaaacgcaaatgtctggaaaacctttacagatctatttgattacttccccttgactgcattggtcgagtcagaaatattttgcttgcatggtggattatcgccatccattgagaccctcgacaacatccgcaacttcgatcgcgtccaggaagttcctcatgaaggtccaatgtgtgatcttctgtggtctgatccagatgatcgatgtggttggggtatttctccacgtggtgctgggtataccttcggacaggatatatcagagcagttcaaccataccaatagcctaaggctaattgctagagctcaccaattggttatggagggattcaattgggctcatgagcaaaaagttgtgactatatttagtgcacctaattattgctaccgctgtgggaacatggcatcaatcctagaagtggatgattgcagggagcatactttcatccagtttgagccagccccaagaaggggagagccagatgtaactcgtaggacacctgactatttcctcaaaggtttgatagataggtgcagtttcctggttgcagataattttttttgctggaatccctccgtgtgctattcttattatttttgcccatggcgctttggctgtcgcgggctgctttgccgcatcatgattcaagtgtatacctactacagctggaaggactggattgtgttctcacttatctctaactggttgatgcttttggcttggtgggggctgcagtggtggggtttcaagcatcaagcagcaatctgtattatgggaggaaacttttcccgttgtattcattttgttcccctttcttcctcacctgattttcttctctttcttcttttttccttttttgtgattcttgtagaggtgaacactttgtatggttctatgttgggccattag

SEQ ID NO: 14853 - protein, 438 aa, Sorghum bicolor
  misc_feature: The sequence is a functional homolog of SEQ ID NO 13 in US patent 7271316
  misc_feature: Ceres ANNOT ID no. 8632093
  misc_feature (1)..(307): SWISSPROT Homolog: EC 3.1.3.16 Phosphoprotein phosphatase
  misc_feature (48)..(243): Pfam ID: Metallophos Pfam Description: Calcineurin-like phosphoesterase
MSSPHGGLDDQIERLMQCKPLAEPEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLRLIARAHQLVMEGFNWAHEQKVVTIFSAPNYCYRCGNMASILEVDDCREHTFIQFEPAPRRGEPDVTRRTPDYFLKGLIDRCSFLVADNFFCWNPSVCYSYYFCPWRFGCRGLLCRIMIQVYTYYSWKDWIVFSLISNWLMLLAWWGLQWWGFKHQAAICIMGGNFSRCIHFVPLSSSPDFLLFLLFSFFVILVEVNTLYGSMLGH

SEQ ID NO: 14854 - DNA, 1713 bp, Sorghum bicolor
  misc_feature: Ceres ANNOT ID no. 8632100
  misc_feature: Encodes the peptide sequence at SEQ ID NO 14855
atggaagtggaagcagccgccgccggcaagctgaatgtggtgctgttcccgtggctggcgttcggccacatgatcccgttcatggagctcgccaagcgcctggcggcgatgggccacgccgtcaccttcctcaccacgccgaggaacgtcgccaggctgccgcccgtgccagcggacctgtcgccccgcgtgcgcctcgtggcgcttcccgcgcccgtcgcgcagggcctgcccgagggcgccgagtccacgaccgacgtgccgccggagaagcaggagcttctcaagaaggcgctcgacggcctcgccgccccgttcgcggcgttccttgcggaagccgtcgccgacggtgggaggaggcccgactggatcgtcatggacttctgccaccactgggtgcccgcgatcgccgaggcgcacggggtgtcgtgcgccatgttcctgatcgtgcaggcggcctggatggcgtttgtggggccgcggtcggcgaacgccgggcatccgcgcacgacggcggagcacttcaccgtgccgccgaagtggcttccgtcgttccctcccgccatcgcctaccgccgccacgagggcgactggatcctcgccgcgttccagcccaacgcgtccggggtgtccgacttcgaccgcttgtggcaggcaatggatggcacccgcctcatcatctaccgcagctgcgacgaggtcgacgtgcccggggtgttcgccgtcctcaccgatctcttccaacagccggccgtccccgccggggtcttgctgcagcctgtactcgacgacgacgaccgtgactcctccatatcagtatcaggggcacgtcccgaggtccttcaatggctggacaagcaggcacccaagtcagtcatctacgtggcgctaggaagcgaggcgccgctgaccgccaagaccctccatgagctcgcgctgggccttgagctcgccggcgtccgcttcctgtgggctttccggaagccggccggcatgtccgcacccggcacagacgacggcgtgggcgagctgctgcccgccgggttcgaagaccggacgcggggacgcggcctggtgtggccgggatgggtgccccaggtgcgggtgctcgcgcacgccgcggtgggcgcgttcctgacacactgtggctggggctccaccgtcgagggcctcgtgttggggcacccgctggtgatgctgccgttcgtcgtcgaccagggcatcatcgcgcggacgatggcggagcgcggcgtcggcgtggaggtggcgagggacgagagcgacggctcgttcggtagagacggcgtcgcggaggcggtgcgacgtgtcgtggtggaggaggacggcaaggtgttcgcgagcaacgcgatgaagctgaaggaagctcttggcgatcagcgacggcaggatcagtacatggacgaccttgtagggtatcttacacgctacaaggatcaacggccctcccaccatcgcctaccgccgccacgagggcgactggatcctcgccgtgttccagcccaacgcgtccggggtgtccgacttcgaccgcttgtggcaggcaatggatggcacccgcctcatcatctaccgcagctgcgacgaggtcgacgtgcccggagtgttcgccgtcctcaccgatctcttccaacagccagccgtccccgccggggtcttgctgcagcctgtactcgacgacgacgacgaccgtga

SEQ ID NO: 14855 - protein, 570 aa, Sorghum bicolor
  misc_feature: Useful for making plants with altered carbohydrate content
  misc_feature: Functional homolog of the protein sequence given in SEQ ID NO 14087
  misc_feature: Ceres ANNOT ID no. 8632100
  misc_feature (279)..(426): SWISSPROT Homolog: EC 2.4.1.236 Flavanone 7-O-glucoside 2''-O-beta-L-rhamnosyltransferase
  misc_feature (12)..(484): Pfam ID: UDPGT Pfam Description: UDP-glucoronosyl and UDP-glucosyl transferase
MEVEAAAAGKLNVVLFPWLAFGHMIPFMELAKRLAAMGHAVTFLTTPRNVARLPPVPADLSPRVRLVALPAPVAQGLPEGAESTTDVPPEKQELLKKALDGLAAPFAAFLAEAVADGGRRPDWIVMDFCHHWVPAIAEAHGVSCAMFLIVQAAWMAFVGPRSANAGHPRTTAEHFTVPPKWLPSFPPAIAYRRHEGDWILAAFQPNASGVSDFDRLWQAMDGTRLIIYRSCDEVDVPGVFAVLTDLFQQPAVPAGVLLQPVLDDDDRDSSISVSGARPEVLQWLDKQAPKSVIYVALGSEAPLTAKTLHELALGLELAGVRFLWAFRKPAGMSAPGTDDGVGELLPAGFEDRTRGRGLVWPGWVPQVRVLAHAAVGAFLTHCGWGSTVEGLVLGHPLVMLPFVVDQGIIARTMAERGVGVEVARDESDGSFGRDGVAEAVRRVVVEEDGKVFASNAMKLKEALGDQRRQDQYMDDLVGYLTRYKDQRPSHHRLPPPRGRLDPRRVPAQRVRGVRLRPLVAGNGWHPPHHLPQLRRGRRARSVRRPHRSLPTASRPRRGLAAACTRRRRRP

SEQ ID NO: 14856 - DNA, 588 bp, Sorghum bicolor
  misc_feature: Ceres ANNOT ID no. 8632110
  misc_feature: Encodes the peptide sequence at SEQ ID NO 14857
atggcgcgcggcggcggtgcggcggcgctggtggtggtggcggccttcgtcgtggtgctgtcggtgtcggcaggcgtggcccgcgcggacttcgccaaggaccgcgccatgtgcgcggacaagctgatgggcctggcgacgtgcctgacgttcgtgcaggacaaggcgacggcgcgcgcgccgacgcccgactgctgcgcggggctgaagcaggtggtggcggccagcaagatgtgcatgtgcgtgctggtcaaggaccgcgacgagccggcgctcgggttcaagatcaacgtcacccgcgccatggacctgccctcgctctgcagcaaccccgccaccttctccgactgccccaagattctggggatgtcgcccgacgcccccgaggcggagatcttcaaggagtacgccaagaagcacgagggccagaacggcaccaccatacctgcagctgcaaccggtgccgcggcgaccgggaagagcacgagcgcggcgccgacggcggacggcgccgggaggcagccttgcgcggtcttcttctacctcgtgtcggcgctgttcgcctccgttgcggtcctgctgggctga

SEQ ID NO: 14857 - protein, 195 aa, Sorghum bicolor
  misc_feature: Useful for making plants with altered carbohydrate content
  misc_feature: Functional homolog of the protein sequence given in SEQ ID NO 14088
  misc_feature: Ceres ANNOT ID no. 8632110
  misc_feature (38)..(117): Pfam ID: Tryp_alpha_amyl Pfam Description: Protease inhibitor/seed storage/LTP family
MARGGGAAALVVVAAFVVVLSVSAGVARADFAKDRAMCADKLMGLATCLTFVQDKATARAPTPDCCAGLKQVVAASKMCMCVLVKDRDEPALGFKINVTRAMDLPSLCSNPATFSDCPKILGMSPDAPEAEIFKEYAKKHEGQNGTTIPAAATGAAATGKSTSAAPTADGAGRQPCAVFFYLVSALFASVAVLLG

SEQ ID NO: 14858 - DNA, 483 bp, Sorghum bicolor
  misc_feature: Ceres ANNOT ID no. 8632102
  misc_feature: Encodes the peptide sequence at SEQ ID NO 14859
atgtccgcacccggcacagacgacggcgtgggcgagctgctgcccgccgggttcgaagaccggacgcggggacgcggcctggtgtggccgggatgggtgccccaggtgcgggtgctcgcgcacgccgcggtgggcgcgttcctgacacactgtggctggggctccaccgtcgagggcctcgtgttggggcacccgctggtgatgctgccgttcgtcgtcgaccagggcatcatcgcgcggacgatggcggagcgcggcgtcggcgtggaggtggcgagggacgagagcgacggctcgttcggtagagacggcgtcgcggaggcggtgcgacgtgtcgtggtggaggaggacggcaaggtgttcgcgagcaacgcgatgaagctgaaggaagctcttggcgatcagcgacggcaggatcagtacatggacgaccttgtagggtatcttacacgctacaagggtcaaggggcgctgggtaattaa

SEQ ID NO: 14859 - protein, 160 aa, Sorghum bicolor
  misc_feature: Useful for making plants with altered carbohydrate content
  misc_feature: Functional homolog of the protein sequence given in SEQ ID NO 14087
  misc_feature: Ceres ANNOT ID no. 8632102
  misc_feature (10)..(95): SWISSPROT Homolog: EC 2.4.1.236 Flavanone 7-O-glucoside 2''-O-beta-L-rhamnosyltransferase
MSAPGTDDGVGELLPAGFEDRTRGRGLVWPGWVPQVRVLAHAAVGAFLTHCGWGSTVEGLVLGHPLVMLPFVVDQGIIARTMAERGVGVEVARDESDGSFGRDGVAEAVRRVVVEEDGKVFASNAMKLKEALGDQRRQDQYMDDLVGYLTRYKGQGALGN

SEQ ID NO: 14860 - DNA, 588 bp, Sorghum bicolor; identical to SEQ ID NO: 14856
  misc_feature: Ceres ANNOT ID no. 8632106
  misc_feature: Encodes the peptide sequence at SEQ ID NO 14861

SEQ ID NO: 14861 - protein, 195 aa, Sorghum bicolor; identical to SEQ ID NO: 14857
  misc_feature: Useful for making plants with altered carbohydrate content
  misc_feature: Functional homolog of the protein sequence given in SEQ ID NO 14088
  misc_feature: Ceres ANNOT ID no. 8632106
  misc_feature (38)..(117): Pfam ID: Tryp_alpha_amyl Pfam Description: Protease inhibitor/seed storage/LTP family

SEQ ID NO: 14862 - DNA, 1917 bp, Sorghum bicolor
  misc_feature: Ceres ANNOT ID no. 8632116
  misc_feature: Encodes the peptide sequence at SEQ ID NO 14863
atgccgcccaagcgcgcgtgccgcctggcgctgctggccgcggcggcggcgtacctcctcttcctcctcctcttcgagctgccctccttcgccgtctccaccgcgtcgccccgccacatccacgccgccacgcaccgcgcccgccgccgcgagctcctccgcgcctcctccgcgccgctgcacacgtcgtccccgctccgtcccgtcaggactgccccgctcgccgtctcctccgtccgcgtccaccacggcgccaccaactcctcctctgccgctgccgcgtcatccatcgacgcctcggcctccgccgcattcgccgccgcggcgccccacctcgcgcgcctcctctccgctcccgcatccccgtcctcctcctcgtccccttcgccgtccccgtccgctgccacctcggcctcctgccccgcgacggtctcggtgtcgagggaccggctcgcgagcggcgggggagtcgcggtggacctgccgtgcgggatggcggtggggtcgcgcctcacggtggtggcgcggccgcgggccgcgcgggcggaggtcgcgggagcgagggacggggccgcaccgctcatggtgtcgcagttcatgctcgagctcctgggcaccaaggcggtgcagggggaggagccgccaaggatactgcacttcaaccccaggatccgcggggacttcagtggccgccccgtcatcgagctcaacacttgctaccggatgcagtgggcgcagccgcagcgctgcgaggggtgggcgtcacggcaggacgacgatactgttgacggggaattgaagtgtaacaaatggattcgtgatgataacaacgagacacaagaatcacggatgaaagggtggctgaaccgtttgattggtaggtcgaatgtcaactggccatacccatttgcagagggcaagcaatttgttttaatcataacagctggttcggagggctaccatgtcaatgttgatggccggcatgttacatcgttcccttaccgcaccggctacaatctcgaggatgcaacacggttgtctttgaaaggagacattgatgtcgagtccattttggctggttctttgcccacttcacctcctacttctgcaacaaaaagttatcttgagatgtctgaacagtggaaggcctcacccttgccaactgaacctgctgagctttttattggcatcctgtcatctgctaaccattttgctgagcgtatggctgttcgaaagtcatggttgatgtctaccaggagatcatctgatgttgttgctcgcttctttgttgctctgaatggaagaaacgaggtcaatgaagagttgaagaaggaggcagattactttggggatattgttatagttccattcatggacagctatgaccttgttgttctaaaaactatcgcgattgttgagtatggggtgagggttattcctgcaaagcacataatgaaatgtgacgatgatacatttgtcagaattgaatctgtattggatcaagtaaacaaggtccaaagtggaaagagcatttatgtgggaaatataaactactaccacagacccttaagatctgggaaatggtctgtcacatatgaggaatggccagaggaagtgtatcctccttatgctaatgggcctggctatattatttcatccgatattgctcaatatattttatccgagtttgataataagacattaagactattcaagatggaagatgttagtatgggcatgtgggttgagaagttcaatactactcgttcgcctgtagagtatttgcatgatctcaggttctaccagcctggttgctttgatggttatttcaccgcacactaccaatccccacaacacatgatttgtttgtggagaaagttgcaagctgggagcactcaatgctgcaacgtaagatga

SEQ ID NO: 14863 - protein, 638 aa, Sorghum bicolor
  misc_feature: Useful for making plants with altered carbohydrate content
  misc_feature: Functional homolog of the protein sequence given in SEQ ID NO 13850
  misc_feature: Ceres ANNOT ID no. 8632116
  misc_feature (391)..(621): SWISSPROT Homolog: EC 2.4.1.134 Galactosylxylosylprotein 3-beta-galactosyltransferase
  misc_feature (156)..(359): Pfam ID: Gal-bind_lectin Pfam Description: Galactoside-binding lectin
  misc_feature (405)..(593): Pfam ID: Galactosyl_T Pfam Description: Galactosyltransferase
MPPKRACRLALLAAAAAYLLFLLLFELPSFAVSTASPRHIHAATHRARRRELLRASSAPLHTSSPLRPVRTAPLAVSSVRVHHGATNSSSAAAASSIDASASAAFAAAAPHLARLLSAPASPSSSSSPSPSPSAATSASCPATVSVSRDRLASGGGVAVDLPCGMAVGSRLTVVARPRAARAEVAGARDGAAPLMVSQFMLELLGTKAVQGEEPPRILHFNPRIRGDFSGRPVIELNTCYRMQWAQPQRCEGWASRQDDDTVDGELKCNKWIRDDNNETQESRMKGWLNRLIGRSNVNWPYPFAEGKQFVLIITAGSEGYHVNVDGRHVTSFPYRTGYNLEDATRLSLKGDIDVESILAGSLPTSPPTSATKSYLEMSEQWKASPLPTEPAELFIGILSSANHFAERMAVRKSWLMSTRRSSDVVARFFVALNGRNEVNEELKKEADYFGDIVIVPFMDSYDLVVLKTIAIVEYGVRVIPAKHIMKCDDDTFVRIESVLDQVNKVQSGKSIYVGNINYYHRPLRSGKWSVTYEEWPEEVYPPYANGPGYIISSDIAQYILSEFDNKTLRLFKMEDVSMGMWVEKFNTTRSPVEYLHDLRFYQPGCFDGYFTAHYQSPQHMICLWRKLQAGSTQCCNVR

SEQ ID NO: 14864 - DNA, 855 bp, Sorghum bicolor
  misc_feature: Ceres ANNOT ID no. 8632209
  misc_feature: Encodes the peptide sequence at SEQ ID NO 14865
atggccgggcaaccgccgccgcagggcccggaagacgatttcttcgaccagttcttctccatggcggccggcggctcctaccccgcaaccgcgggcggcgggcgcgcaccgggggaccagcccttctcccttgcactcagcctcgacgccgcggccgccgaggcttccggaagcgggaagcacgccgacggtggcaaggtggatcgggaggctgtgcagctccccgggctcttcccgccggtgttcagcggcggtgtgcagccgccccacctccgccccaacccgcctacccaggtgttccgcgcgcagcagccgaagcaaggcggggcgggtgtcgggccacaaccgccggcgccgaggccaaaggtgcgggcgcggcgagggcaggcgacggacccccacagcatcgcagagaggctaagaagagagagaatagcagaaaggatgagggccctacaggaattggtgcccaatacaaacaagacagatagggcagttatgctagacgagatcctcgattatgtgaagtttctgaggcttcaagtcaaggttctaagcatgagcaggctgggtggtgctggtgctgtggcacagctggttgctgatatcccactttcagttaagggggaagcaagtgatagtggaagcaaacagcagatttgggaaaagtggtcaacggatggcacagaaagacaggtcgcaaagctgatggaagaagacattggggcagcgatgcaatttctccagtccaaggcactctgcatgatgcccatttcgctcgccatggcaatctatgacacacaacattcacaggatggacaaccagtgaaaccagaacccaacactccttcctag

SEQ ID NO: 14865 - protein, 284 aa, Sorghum bicolor
  misc_feature: The sequence is a functional homolog of SEQ ID NO 1106 in the 10/225,066 US patent application
  misc_feature: The sequence is a functional homolog of SEQ ID NO 220 in the 10/225,068 US patent application
  misc_feature: The sequence is a functional homolog of SEQ ID NO 2368 in the 10/374,780 US patent application
  misc_feature: The sequence is a functional homolog of SEQ ID NO 390 in the 10/412,699 US patent application
  misc_feature: The sequence is a functional homolog of SEQ ID NO 909 in the 11/479,226 US patent application
  misc_feature: The sequence is a functional homolog of SEQ ID NO 1211 in the 11/479,226 US patent application
  misc_feature: The sequence is a functional homolog of SEQ ID NO 546 in the 10/412,699 US patent application
  misc_feature: The sequence is a functional homolog of SEQ ID NO 1488 in the 11/479,226 US patent application
  misc_feature: The sequence is a functional homolog of SEQ ID NO 712 in the 10/412,699 US patent application
  misc_feature: Ceres ANNOT ID no. 8632209
  misc_feature (130)..(179): Pfam ID: HLH Pfam Description: Helix-loop-helix DNA-binding domain
MAGQPPPQGPEDDFFDQFFSMAAGGSYPATAGGGRAPGDQPFSLALSLDAAAAEASGSGKHADGGKVDREAVQLPGLFPPVFSGGVQPPHLRPNPPTQVFRAQQPKQGGAGVGPQPPAPRPKVRARRGQATDPHSIAERLRRERIAERMRALQELVPNTNKTDRAVMLDEILDYVKFLRLQVKVLSMSRLGGAGAVAQLVADIPLSVKGEASDSGSKQQIWEKWSTDGTERQVAKLMEEDIGAAMQFLQSKALCMMPISLAMAIYDTQHSQDGQPVKPEPNTPS

SEQ ID NO: 14866 - DNA, 1215 bp, Sorghum bicolor
  misc_feature: Ceres ANNOT ID no. 8632224
  misc_feature: Encodes the peptide sequence at SEQ ID NO 14867
atggccgccgccgcgcgccccctggtctccgtgagggccctggagggcgacatggccacggactccgccgggatcccgttggcggacgtcctccgcgcgccgctccgccctgacatcgtgcgcttcgtccacaagctcctgtcctgcaacagccgccagccctacgcggtgtcgcgtcgagccggccaccagacctccgcggagtcctggggcacggggcgtgcggtgtcccgtatcccccgcgttcctggcggtggtacccaccgcgccggccaggcagccttcggcaacatgtgccgtggcggacgcatgttcgcgcccaccaagatctggcgccgctggcaccgccgcgtcaacatccacctccgccgtgtcgccatcgcctccgccctctccgccaccaccgtcccgtccctcgtcctcgcccgcggccaccgcgtggagtccgtccccgagcttccgctcgtcgtttccgactctgccgagtctattgagaagactacacaggccatcaagatcctcaagcagctcggtgcctacgccgatgctgagaaggccaaggactccgttggcatccgccccggcaaggggaagatgcgcaaccgccgctacatcaaccgcaagggacccctcgttgtctacggcacggagggctctaagatcgtcaaggccttccgcaacctccctggcgttgatgttgccaatgtcgagcgtctcaacctgctcgacctcgctcctggtggccaccttggccggtttgtcatctggactgagtccgcgtttaagaagctcgatgaggtgtacggtaccttcgacacgccatcggcgaagaagaagggtttcgtgctcccgagggccaagatggcaaacgctgatttgtccaggctcatcaactctgacgaggtgcagtcagtggtgaagcccatcaacaaggaggtgaagcgtagggagcctaggaagaatccactgaagaatatggctgcagtgctcaagctgaacccgtaccttggtactgcacgcaagatggcagccctagcagaggcagcgcgtgtcaatgccaggaagcagaagcttgactccaagaggaccaaactcagcccagaggaggcttctaaggttaaggctgctggaaaggcgtggtacaaaaccatgatctcagacagcgactacacggaatatgagaacttcaccaagtggcttggtgttacacagtga

SEQ ID NO: 14867 - protein, 404 aa, Sorghum bicolor
  misc_feature: Useful for making plants with modulated biomass
  misc_feature: Functional homolog of the protein sequence given in SEQ ID NO 13039
  misc_feature: Ceres ANNOT ID no. 8632224
  misc_feature (23)..(267): Pfam ID: Ribosomal_L4 Pfam Description: Ribosomal protein L4/L1 family
MAAAARPLVSVRALEGDMATDSAGIPLADVLRAPLRPDIVRFVHKLLSCNSRQPYAVSRRAGHQTSAESWGTGRAVSRIPRVPGGGTHRAGQAAFGNMCRGGRMFAPTKIWRRWHRRVNIHLRRVAIASALSATTVPSLVLARGHRVESVPELPLVVSDSAESIEKTTQAIKILKQLGAYADAEKAKDSVGIRPGKGKMRNRRYINRKGPLVVYGTEGSKIVKAFRNLPGVDVANVERLNLLDLAPGGHLGRFVIWTESAFKKLDEVYGTFDTPSAKKKGFVLPRAKMANADLSRLINSDEVQSVVKPINKEVKRREPRKNPLKNMAAVLKLNPYLGTARKMAALAEAARVNARKQKLDSKRTKLSPEEASKVKAAGKAWYKTMISDSDYTEYENFTKWLGVTQ

SEQ ID NO: 14868 - DNA, 1290 bp, Sorghum bicolor
  misc_feature: Ceres ANNOT ID no. 8632276
  misc_feature: Encodes the peptide sequence at SEQ ID NO 14869
atggaggacgaggacgccggccctggcggcgggggcgaggcctccccgccgcaccacgccgcggcggcgtcgggcgaccgggcgcgggacatggcggcgtccccgacgaggtcgcgctccgtgacgcagacggtgaacggatcccaccgcttcgtgatccagggctactcgctcgccaagggcatgggcgtcgggaagcacatcgccagcgagaccttcaccgtgggcggataccagtgggcgatctacttctaccccgacgggaagaaccccgaggacaactccaactacgtctccgtcttcatcgcgctcgcgtccgacggcaccgacgtgcgcgcgctcttcgagctcacgctcctcgaccagagcggcaagggcaagcacaaggtgcactcgcacttcgaccgctcccttgagtccgggccatacaccctcaagtaccgcggatccatgtggggctataaaaggttctttcggcgtaatgctcttgagctatcagattttcttaaagatgattgcttgaagataaactgcactgtgggtgttgtagtatcaactatggattattcaaggccacattcaatagaggttccagagtctgacataggctatcattttggaacgcttttggacactcaggaaggtgtagatgttatttttagtgtagcaggagagaagtttcatgcccataagttggtattggctgcccgatctcccttttttagatctgaattttttgatcatgaatcgggtgaagagaagaatgaaactgatacgaaggatgaaatcaaagagatcgtcattgatgacatggatcctgtagtgttcaaggctgtgcttcattttatctacagggacaatcttgttgatgatgatgagttgtctgcatcaagctctgactgctctatctttgatagtttagctgggaaattaatggctgcagcagacaaatatgagttgccaaggctaagattattgtgtgaatcttacttgtgcaagcatatttctgtaaactccgtggcaactactctagcattggctgatcggcaccatgctgtggagcttaaatctgtttgcctaaaatttgctgctgaaaacctttcagcggtgatccggaccgaggggttcgactatctcaaagacaactgcatatctctgcagtcagagatactacggacagttgccgggtgtgaggagccatgtagcagcggtgtgaaaagccagagcgtgtgggcgcagctctctgacggcggtgacaccagcgggcgcagggtgaggccaagggtctga

SEQ ID NO: 14869 - protein, 429 aa, Sorghum bicolor
  misc_feature: Useful for making plants with modulated biomass
  misc_feature: Functional homolog of the protein sequence given in SEQ ID NO 12898
  misc_feature: Ceres ANNOT ID no. 8632276
  misc_feature (206)..(335): Pfam ID: BTB Pfam Description: BTB/POZ domain
MEDEDAGPGGGGEASPPHHAAAASGDRARDMAASPTRSRSVTQTVNGSHRFVIQGYSLAKGMGVGKHIASETFTVGGYQWAIYFYPDGKNPEDNSNYVSVFIALASDGTDVRALFELTLLDQSGKGKHKVHSHFDRSLESGPYTLKYRGSMWGYKRFFRRNALELSDFLKDDCLKINCTVGVVVSTMDYSRPHSIEVPESDIGYHFGTLLDTQEGVDVIFSVAGEKFHAHKLVLAARSPFFRSEFFDHESGEEKNETDTKDEIKEIVIDDMDPVVFKAVLHFIYRDNLVDDDELSASSSDCSIFDSLAGKLMAAADKYELPRLRLLCESYLCKHISVNSVATTLALADRHHAVELKSVCLKFAAENLSAVIRTEGFDYLKDNCISLQSEILRTVAGCEEPCSSGVKSQSVWAQLSDGGDTSGRRVRPRV

SEQ ID NO: 14870 - DNA, 1104 bp, Sorghum bicolor
  misc_feature: Ceres ANNOT ID no. 8632298
  misc_feature: Encodes the peptide sequence at SEQ ID NO 14871
atggcgtcggagtgggaaatggccatgggggtggagctcggcatgggaatgggcacgtaccaccacaacgcctccagcatcaccaccgcgccgatgatgagtagtcaccacaacggcggcgccagctactccacggtgcaccaccaccaccattactacgggatgccgcccatgggtgacgacgccgccatgcgcgtggacgacctctccaccggcggcggcgctggcgcccacgagttcttccccaccgcggccacctcggggcccatggtgggtgagccgtcacccaccgtcaactcctcggatcaccagacgtcgtcgctcctctccttcgctgatgagttctacatacccagcgaggaagctgccgagctggagtggctatccaagttcgtggacgactcatactcggacatgccgaattactcgtcggccgcgcatcatgccgcaatggcggcggcggcggctgctaacgcagcagcagccggcaatggaggaggcacctcggccggtcaagacagctgcgtcaccgccgcggcgcctggccgcggcgcgcgtagcaagcggtccggccgcgcgactgccgcggcgtggcagtccctcgtgccgcgcccaccatcgcagtcgtcgtcgccaattccatcatcaccgtcctgctcgtcttcggacttcacgtcgtcgtcgaacaagccggcacgcccgacgaacggcggcggcagccgcggcaagaagagcccggcggggacggctggggaggaggtgggcatggtggacggcggcgtgcgtcggtgcacgcactgcgcgtcggagaagacgccgcagtggcggtcggggccactgggccccaagaccctgtgcaacgcgtgcggcgtgcggttcaagtccgggcggctgatgccggagtaccggccggcggccagccccacgttcgtgctcacgcagcactccaactcgcaccgcaaggtcgtggagctgcgccgccagaaggagctcatcctcatccgcggaagccaccgggacgccgcggcggccgcggctgcaggatccgccggcgggccgaggccggaggagctcatgttccgtgactatagcggcgtgtgttag

SEQ ID NO: 14871 - protein, 367 aa, Sorghum bicolor
  misc_feature: The sequence is a functional homolog of SEQ ID NO 607 in the 10/374,780 US patent application
  misc_feature: Ceres ANNOT ID no. 8632298
  misc_feature (264)..(299): Pfam ID: GATA Pfam Description: GATA zinc finger
MASEWEMAMGVELGMGMGTYHHNASSITTAPMMSSHHNGGASYSTVHHHHHYYGMPPMGDDAAMRVDDLSTGGGAGAHEFFPTAATSGPMVGEPSPTVNSSDHQTSSLLSFADEFYIPSEEAAELEWLSKFVDDSYSDMPNYSSAAHHAAMAAAAAANAAAAGNGGGTSAGQDSCVTAAAPGRGARSKRSGRATAAAWQSLVPRPPSQSSSPIPSSPSCSSSDFTSSSNKPARPTNGGGSRGKKSPAGTAGEEVGMVDGGVRRCTHCASEKTPQWRSGPLGPKTLCNACGVRFKSGRLMPEYRPAASPTFVLTQHSNSHRKVVELRRQKELILIRGSHRDAAAAAAAGSAGGPRPEELMFRDYSGVC

SEQ ID NO: 14872 - DNA, 1425 bp, Sorghum bicolor
  misc_feature: Ceres ANNOT ID no. 8632312
  misc_feature: Encodes the peptide sequence at SEQ ID NO 14873
atgggcagcgcgccggtgcacggcgcccttgtcttattcctcctgctcctggtaggggcggcggccgaggagacggcgccgcaagaacccacattgcccgccgccagctccggctccggctccggcgctgccggctcggcggcggcggtcggggtcaactccaactccgtgctggtggcgctgctggactcgcactacacggagctggcggagctggtggagaaggcgctgctcctgcagacgctggaggacgccgtcgggaagcacaacgtcaccatcttcgcgccgcggaacgaggcgctggagcgggacctggacccggagttcaagcgcttcctgctggagccgcgcaacctcaagtcgctccaggcgctgctgctctaccacgtcctgccctcgcgcctcccctccgacgcctggcccgcggcctcccaccccacgctctccggcgaggaggtcgagctcgccgccgccggtactggcaccggcatgcgtgtcggccacgccgccgtcacgcgcccggacgctgtgcttaggcctgacggggtcatccacggcatcgagcgcctcctcgtcccgcgctccgtgcaggaggacttcaaccgccgccgcagcctcgccgcaatctcggccgtgctgcccacgggcgcgcctgaggtcgaccccaggacgcaccgcctcaagaagcccgcgccgccggttctccccggcgcgccccccgtgctcccgatctgggacgccatggcgcctggcccctccatcgcccccgcgcccgcgcctggccccggctccgggaagcaccacttcgacgggcacagccaggtcaaggacttcatccagacgctgctcctctacggcggctacaacgagctcgccgacatcctcgtcaacctcacctccctcgccaccgagatgggccgcctcgtctccgagggctacgtcctcaccgtgctcgcccccaacgacgaggccatggcgcgcctcaccacggaccagctcagcgagccggggtcgccggagaacatcctctactaccacatgatcccggagtaccagaccgaggagtccatgtacaacgccgtgcgccgcttcggcaaggtgcgctacgacacgctgcgcctgccgcacaaggtggtggcgcgggaggccgacggctccgtcaagttcggccagggcgagggctccgcctacctcttcgacccggacatctacaccgacggcaggatctccgtgcagggcattgacgccgtgctgttcgcgccggacgacaccaaggccacacagaccgccgatccgaacaggaagcctcccgccatcgtcacccacaagaagaagatcaagctccggcgaggtaaattgttagaagcaacgtgccaaatggccgggctctttggtcagcgatcgcgatttgcaagctgccagtag

SEQ ID NO: 14873 - protein, 474 aa, Sorghum bicolor
  misc_feature: Useful for making plants with altered carbohydrate content
  misc_feature: Functional homolog of the protein sequence given in SEQ ID NO 14089
  misc_feature: Useful for making plants with altered cell wall content and/or composition
  misc_feature: Functional homolog of the protein sequence given in SEQ ID NO 14044
  misc_feature: Ceres ANNOT ID no. 8632312
  misc_feature (65)..(193): Pfam ID: Fasciclin Pfam Description: Fasciclin domain
  misc_feature (287)..(421): Pfam ID: Fasciclin Pfam Description: Fasciclin domain
MGSAPVHGALVLFLLLLVGAAAEETAPQEPTLPAASSGSGSGAAGSAAAVGVNSNSVLVALLDSHYTELAELVEKALLLQTLEDAVGKHNVTIFAPRNEALERDLDPEFKRFLLEPRNLKSLQALLLYHVLPSRLPSDAWPAASHPTLSGEEVELAAAGTGTGMRVGHAAVTRPDAVLRPDGVIHGIERLLVPRSVQEDFNRRRSLAAISAVLPTGAPEVDPRTHRLKKPAPPVLPGAPPVLPIWDAMAPGPSIAPAPAPGPGSGKHHFDGHSQVKDFIQTLLLYGGYNELADILVNLTSLATEMGRLVSEGYVLTVLAPNDEAMARLTTDQLSEPGSPENILYYHMIPEYQTEESMYNAVRRFGKVRYDTLRLPHKVVAREADGSVKFGQGEGSAYLFDPDIYTDGRISVQGIDAVLFAPDDTKATQTADPNRKPPAIVTHKKKIKLRRGKLLEATCQMAGLFGQRSRFASCQ

SEQ ID NO: 14874 - DNA, 1854 bp, Sorghum bicolor
  misc_feature: Ceres ANNOT ID no. 8632313
  misc_feature: Encodes the peptide sequence at SEQ ID NO 14875
atggggaacacgtgcgtcggccccagcatcaccaagaacggcttcttccagtccgtctccaccgcgctgtggaagacgccgcaggacggcgacgcgctgcccgccgccaccgccgccaatggccccggcggcgccagcccgggccggtcgcagtcgatgccgccgccgaagccggcgtccgacgtgcacgtcgccgtgcagagcaaggcccctgagcccgtcaagatcgccgtctcctactcggagccgccgcccaaggcggccgccgccacgcaggacgccaagcctgccaacaccaaggccaacgccaacgccaacgccagccccagccccaactcgtccgccgaggcgccgcccaagccgcgtcccaaggtgccgcaggtgaagcgcgtgtccagcgccgggctgctcgtcggctcggtgctcaagcgcaagacggagaacctcaaggacaagtacagcctggggcggcggctcgggcagggccagttcggcaccacgtacctgtgcgtggagcgggccaccggcaaggagtacgcgtgcaagtccatcctcaagcgcaagctcgtcaccgacgacgacgtcgaggacgtccgccgggagatccagataatgtaccacctggcaggccaccccaacgtcatctccatccgcggcgcgtacgaggacgccgtcgccgtgcatctcgtcatggagctctgcgccggcggcgagctcttcgacaggatcgtgcagaagggccactacaccgagaggaaggccgccgagctcgccagggtcatcgttggagtcgtcgaggtgtgccactccatgggcgtcatgcatcgggatctcaagccggagaacttcctcttcgctgaccagaaggaggaggccgctctcaagaccattgactttggtctctccattttctttcgccccggtcaaatattcacggatgttgttggtagcccttactacgtcgcaccagaggtcctgaagaagaaatacggtccagaggcagacgtttggagtgctggtgtaatcatttacatcttgctgtgtggagtgccaccattttgggcagagaacgagcagggtatatttgaagaggttttgcatgggagacttgacttcgagtcagagccgtggcccagtatctccgaaggcgccaaagatcttgtgagaagaatgcttattagggacccaaggaagagattaacagctcatgaagttttacggcatccgtgggttcaggtcggtggtttggctcctgataagccgctggattccgctgttctttctcgcatgaagcagttctcggctatgaataagctgaaaaagatggctcttagggtaattgccgagaacctatccgaggacgagatcgccggcctgaaagagatgttcaagatgatcgacgcggacaacagtgggcagatcacgttcgaggagctgaaggtgggcctgaagaaggttggcgccaacctccaggaatcggagatttacgctctgatgcaggccgcggacgtggacaacaacgggacgatcgactacggcgagttcctcgcggcgacgctgcacctgaacaaggtggagcgggaggaccacctgttcgcggcgttccagtacttcgacaaggacggcagcgggtacatcaccgccgacgagctgcaggtggcgtgcgaggagttcggcctgggcgacgtcaagctggaggacatgatcggagaagtcgaccaggacaatgacgggcgcatcgactacaacgagttcgttgcgatgatgcagaagccgacggtgggtctgcccaagaaggccggccttcagaacagcttcagcatcggcttcagggaggcactcaggatggcctga

SEQ ID NO: 14875 - protein, 617 aa, Sorghum bicolor
  misc_feature: The sequence is a functional homolog of SEQ ID NO 2 in US patent 7084323
  misc_feature: Ceres ANNOT ID no. 8632313
  misc_feature (132)..(611): SWISSPROT Homolog: EC 2.7.11.1 Non-specific serine/threonine protein kinase
  misc_feature (153)..(411): Pfam ID: Pkinase Pfam Description: Protein kinase domain
  misc_feature (458)..(486): Pfam ID: efhand Pfam Description: EF hand
  misc_feature (564)..(592): Pfam ID: efhand Pfam Description: EF hand
  misc_feature (530)..(558): Pfam ID: efhand Pfam Description: EF hand
  misc_feature (494)..(522): Pfam ID: efhand Pfam Description: EF hand
MGNTCVGPSITKNGFFQSVSTALWKTPQDGDALPAATAANGPGGASPGRSQSMPPPKPASDVHVAVQSKAPEPVKIAVSYSEPPPKAAAATQDAKPANTKANANANASPSPNSSAEAPPKPRPKVPQVKRVSSAGLLVGSVLKRKTENLKDKYSLGRRLGQGQFGTTYLCVERATGKEYACKSILKRKLVTDDDVEDVRREIQIMYHLAGHPNVISIRGAYEDAVAVHLVMELCAGGELFDRIVQKGHYTERKAAELARVIVGVVEVCHSMGVMHRDLKPENFLFADQKEEAALKTIDFGLSIFFRPGQIFTDVVGSPYYVAPEVLKKKYGPEADVWSAGVIIYILLCGVPPFWAENEQGIFEEVLHGRLDFESEPWPSISEGAKDLVRRMLIRDPRKRLTAHEVLRHPWVQVGGLAPDKPLDSAVLSRMKQFSAMNKLKKMALRVIAENLSEDEIAGLKEMFKMIDADNSGQITFEELKVGLKKVGANLQESEIYALMQAADVDNNGTIDYGEFLAATLHLNKVEREDHLFAAFQYFDKDGSGYITADELQVACEEFGLGDVKLEDMIGEVDQDNDGRIDYNEFVAMMQKPTVGLPKKAGLQNSFSIGFREALRMA

SEQ ID NO: 14876 - DNA, 1758 bp, Sorghum bicolor
  misc_feature: Ceres ANNOT ID no. 8632306
  misc_feature: Encodes the peptide sequence at SEQ ID NO 14877
atgggcaacacctgcgtcggccccagcgccgccggccgcaacggcttcctggccaacgtcaccctgtggcggccccgcggcgacgaccccgcggcagcaccatccctaccgccgccctcctcccccgcctccgacaaggcgcccgatcccgtcaccatccctgattccgagcattcctcgcaccactcatcccgatccgccgacctgccaccacagccccccacctcccaggcgcatgggcaggcgcaggacaaccctccggcgaagaagcccgcgcccaaggtcaagcgcgtccagagcgcgggcctcctcgcggactccgtgctcaagcgcgacgttaacacggcccggctcaaggacctctacacaattggcaagaagttagggcagggtcaattcggcaccacctacctctgcgtcgagaaggccaccggccgggagttcgcatgcaagtccattgccaaacggaagctgctcacggaggaggatgtcgaagacgtgcgccgcgagatccagatcatgcaccacctcgcgggtcatgccaacgtcgtctccatcgtcggcgcctacgaggacgccgtcgccgtgcagctcgtcatggagctctgcgccggtggggaacttttcgataggatcatccagagggggcactattccgagaaggcggccgcgcagctggccagggtgatcgtcggcgtcgtcgaggcgtgccactcgctcggcgtaatgcacagggatcttaagccggagaatttcttgtttgtcaatcaaaaggaggactcgcccctcaagaccatcgattttggcctgtccatcttcttcaagccaggcgagatgtttacagatgtcgttggaagcccatactatgtagcacctgaggttttgctaaaattctatggccgtgaagttgatgtctggagtgctggtgtcataatctatatcctgttgagtggagtccctccattctgggatgaaagtgaacaagggatatttgaacaagttttgaaaggtgaactggacttttcgtcagagccctggcctagcatctcagaaagtgcaaaggatttggtcaggaaaatgcttattcgtgatccaaagaagagattgactgcccatgaagccttatgtcacccttgggtttgtgttgatggagttgctcctgacaagcctcttgattctgctgttctaagccggttgaaacaattttctgcaatgaataaactaaagaaaatggcccttagggttattgccgagagtttatccgaggaagaaattgcagggttaaaagaaatgttcaaaatgcttgacactgacaacagtggtcatatcacaatggaggaactaaaaaatggcttgcagagagttggtgctaatttgatggactcagaaatcaatgctctaatggaagcagcggatatcgacaatagtggcacaattgattatggggagttcattgctgcaactttgcatataaacaaagttgaaaaggaggataagctctttgctgctttctcatactttgacaaagatggcagtggttacataactcaagatgagctccaaaaggcatgtgaggagtttggtataggcgatacccgacttgaggatattattggggacatcgatcaggacaatgatggacggatcgactacaatgagtttgttgcaatgatgcagaagggagataatcctctgggaagaaagggacatcaaagtaatgctaattttggtcttggagatgcacttaagcttcggtaa

SEQ ID NO: 14877 - protein, 585 aa, Sorghum bicolor
  misc_feature: The sequence is a functional homolog of SEQ ID NO 2 in US patent 7084323
  misc_feature: Ceres ANNOT ID no. 8632306
  misc_feature (97)..(561): SWISSPROT Homolog: EC 2.7.11.1 Non-specific serine/threonine protein kinase
  misc_feature (122)..(380): Pfam ID: Pkinase Pfam Description: Protein kinase domain
  misc_feature (427)..(455): Pfam ID: efhand Pfam Description: EF hand
  misc_feature (533)..(561): Pfam ID: efhand Pfam Description: EF hand
  misc_feature (499)..(527): Pfam ID: efhand Pfam Description: EF hand
  misc_feature (463)..(491): Pfam ID: efhand Pfam Description: EF hand
MGNTCVGPSAAGRNGFLANVTLWRPRGDDPAAAPSLPPPSSPASDKAPDPVTIPDSEHSSHHSSRSADLPPQPPTSQAHGQAQDNPPAKKPAPKVKRVQSAGLLADSVLKRDVNTARLKDLYTIGKKLGQGQFGTTYLCVEKATGREFACKSIAKRKLLTEEDVEDVRREIQIMHHLAGHANVVSIVGAYEDAVAVQLVMELCAGGELFDRIIQRGHYSEKAAAQLARVIVGVVEACHSLGVMHRDLKPENFLFVNQKEDSPLKTIDFGLSIFFKPGEMFTDVVGSPYYVAPEVLLKFYGREVDVWSAGVIIYILLSGVPPFWDESEQGIFEQVLKGELDFSSEPWPSISESAKDLVRKMLIRDPKKRLTAHEALCHPWVCVDGVAPDKPLDSAVLSRLKQFSAMNKLKKMALRVIAESLSEEEIAGLKEMFKMLDTDNSGHITMEELKNGLQRVGANLMDSEINALMEAADIDNSGTIDYGEFIAATLHINKVEKEDKLFAAFSYFDKDGSGYITQDELQKACEEFGIGDTRLEDIIGDIDQDNDGRIDYNEFVAMMQKGDNPLGRKGHQSNANFGLGDALKLR

SEQ ID NO: 14878 - DNA, 1101 bp, Sorghum bicolor
  misc_feature: Ceres ANNOT ID no. 8632344
  misc_feature: Encodes the peptide sequence at SEQ ID NO 14879
atgtcgtttgccgacgaggacgacgacgaggccttcctcctcgccctcgacgccgcggaggcagccgcgctggactcctccaagcgccgccgcctctccaccacctcgtcctcatcgaccccctcaacctcacccgccacccctgaggggccctacctggccgcgctcaagggaagccacagctccacctggaaacagcagatgcatggatatgcccacaagcagccccacggctccaaacccctagccccgggtaccggaggggcccaggtggcgagcggagcgtgcttcaagtgcggggaccccgggcactgggcgcgggactgccctcaatcggttccgaacacgggtggaggaggtcagatcggcgtcggcggtggatatgtgaatgcggacatgaaggtggaggacaaggcgtgcccctgcggtgccgggacctgtctcgtgctcacttccaacacgctgaagaaccccggtcgcaagttctacaagtgccccacgcgggatgggggttgcaacttcttcgagtggtgtgatgctccatctcctgcccctgcaaatgcacgaaataacatggttttacactcagagacgtcagcaacagatatgctttgcccatgcggtgctggaacttgcttaattctcaccacgaagacagggaaaaatgttgggaggcagttttttcgctgcccattaaatcagggtggtggctcttgtggctttttcaagtggtgtgatgagcaacagcctagggtaggtgcaccactgcagcagcaagcttcaccgcaataccaagcggattctatgtcaagcatccaaaaccccagccagaggagctcgtcttcctgcttcaagtgcggccaggagaaccactgggcgagggactgtccgaatcaatcgtcggatccttatcctgacaagggtgggagaccaataacctcatcgagctcacctggtgcgtgctacaactgtggtcggcctggtcactggtcccgcgactgcccaacctcgaatagtggtggtggtggtagtggtggtaccggcaccaaccgtgccaagtcgtcctctgctttgagctcgtggaatagtcagagatactga

SEQ ID NO: 14879 - protein, 366 aa, Sorghum bicolor
  misc_feature: The sequence is a functional homolog of SEQ ID NO 1036 in the 10/374,780 US patent application
  misc_feature: The sequence is a functional homolog of SEQ ID NO 846 in the 10/666,642 US patent application
  misc_feature: Ceres ANNOT ID no. 8632344
  misc_feature (202)..(299): SWISSPROT Homolog: EC 5.99.1.2 DNA topoisomerase
  misc_feature (203)..(248): Pfam ID: zf-GRF Pfam Description: GRF zinc finger
  misc_feature (138)..(181): Pfam ID: zf-GRF Pfam Description: GRF zinc finger
  misc_feature (94)..(111): Pfam ID: zf-CCHC Pfam Description: Zinc knuckle
  misc_feature (319)..(336): Pfam ID: zf-CCHC Pfam Description: Zinc knuckle
  misc_feature (281)..(298): Pfam ID: zf-CCHC Pfam Description: Zinc knuckle
MSFADEDDDEAFLLALDAAEAAALDSSKRRRLSTTSSSSTPSTSPATPEGPYLAALKGSHSSTWKQQMHGYAHKQPHGSKPLAPGTGGAQVASGACFKCGDPGHWARDCPQSVPNTGGGGQIGVGGGYVNADMKVEDKACPCGAGTCLVLTSNTLKNPGRKFYKCPTRDGGCNFFEWCDAPSPAPANARNNMVLHSETSATDMLCPCGAGTCLILTTKTGKNVGRQFFRCPLNQGGGSCGFFKWCDEQQPRVGAPLQQQASPQYQADSMSSIQNPSQRSSSSCFKCGQENHWARDCPNQSSDPYPDKGGRPITSSSSPGACYNCGRPGHWSRDCPTSNSGGGGSGGTGTNRAKSSSALSSWNSQRY

SEQ ID NO: 14880 - DNA, 1092 bp, Sorghum bicolor
  misc_feature: Ceres ANNOT ID no. 8632369
  misc_feature: Encodes the peptide sequence at SEQ ID NO 14881
atgccactccacttcactcctgctgcttgtatcctcctcgtcgtctttccccttccttccctcctccgtcgtccaagctttctccagaaagggggaagaagggacgaggagcccagcatgccgctctgcagcttctacgcctccacgtccgtccccgtcgtcaagccccagcagtccgtcgcctcctccaagcccccctccacggcggcggcctctgtgactacaactgtgccgatgcgcagtgcgacgacggcgacggtaacgacggccgtgcccacagcgagccaaacgctgtcgctgcacctgccggagctgccgtcgcaggtgaaggacaagatcctgagcctagagctgatgggcgtggactacaggcgcgcgctggagctgaacccggcgctccgcgacgcggcgccggagtccatccacgcggtggtgtcgttcctccagtcccgcgggctccagttcaaggacctgggccgcgtcttcggcatgtgcccgtccgtgctcaccgccagcgtccgcgccgacctccgccccgtcttcgccttcctctccgaggacctgtgcatcccggagtcggcgcaccggcgcgtggtgatcaagtgcccgcgcgtgctggcctgcagcgtccgcgaccagctccgcccggcgctcatctacctccgccgcctggggttccgtgacagccgcgcgctggcgctgcaggacccgatcctcctcgtctccagcgtggagcgcaccctggcgccgaagctggagtacctggccgggctgggcatgtcgcgggacgacgccgtcgccatggtgctgcggtgcccggcgctcttcaccttcagcatcgagcggaacttcaggcccaagttcgagtacctggtggacgccatgggcggcggcgtcgaggacgtcaaggccttcccgcagtacttcgccttcagcctcgagaagcggatcgcgccccgccaccgcgccgcggaggacgccggcgtcgcgctgccgctgccggacatgctcaaggccaccgacgaggagttcagggagatgctcgacaaggagcgggagctgctgcaggagcagacagcgacgacggactga

SEQ ID NO: 14881 - protein, 363 aa, Sorghum bicolor
  misc_feature: Useful for making plants with altered terpenoid content
  misc_feature: Functional homolog of the protein sequence given in SEQ ID NO 13264
  misc_feature: Ceres ANNOT ID no. 8632369
  misc_feature (66)..(346): Pfam ID: mTERF Pfam Description: mTERF
MPLHFTPAACILLVVFPLPSLLRRPSFLQKGGRRDEEPSMPLCSFYASTSVPVVKPQQSVASSKPPSTAAASVTTTVPMRSATTATVTTAVPTASQTLSLHLPELPSQVKDKILSLELMGVDYRRALELNPALRDAAPESIHAVVSFLQSRGLQFKDLGRVFGMCPSVLTASVRADLRPVFAFLSEDLCIPESAHRRVVIKCPRVLACSVRDQLRPALIYLRRLGFRDSRALALQDPILLVSSVERTLAPKLEYLAGLGMSRDDAVAMVLRCPALFTFSIERNFRPKFEYLVDAMGGGVEDVKAFPQYFAFSLEKRIAPRHRAAEDAGVALPLPDMLKATDEEFREMLDKERELLQEQTATTD

SEQ ID NO: 14882 - DNA, 1503 bp, Sorghum bicolor
  misc_feature: Ceres ANNOT ID no. 8632372
  misc_feature: Encodes the peptide sequence at SEQ ID NO 14883
atggagactgtgttcaaggggagagcaagagcaagaacaagagtctctctgatccatttctttgtccgacgttgttttgctgtggccgcagctgccattttcctgctgacagatgggaggcatgctcatgtagatcccgcacctttggagatactcggcggcgctgatgatgtcgatacacttgcccatcagagaccaaatgtgaacggcagcgaggcgatcgacgatgagcagtggcggatggtcaagaccaggggaaaccagttcgtcgtcggcgatcggcccttctacctgaacggcttcaacgcctactggctgatgatcctcgccgtcgacccgtccaccagggggaaggtcaccgaggtgttccagcaggcggcggcggtcggcctcactgtgtgccgcacgtggggcttcaacgacggtggctggagggcgcttcagaagtcgccatctgtctatgatgaggatgtcttcaaggcgttggatttcgtggtgagcgaggcaaggaagtacaggatcaggcttatattgtcactgatcaacaactgggacggctacggcggcaaggcgcagtacgtgaaatgggccagggacgacggcggcggcggcctcatcaacatcacctccgacgatgccttcttctccgaccaaaccgtcaagggctacttcaagaaccacgtcaagaacatgctgacgagggtgaactcgtacacgagtgtgatgtacaaggacgacccgaccatcttggcgtgggagctcatgaacgagccgcgctgcacgtcggacccaaccgggaacacgctgcaggagtggatccaagagatggcgttccatgtcaagtccatcgatccggatcacctgctcgaagtcggcgcagagggcttctatggcccctcgtcgccggcacggcttccggccaacccaaatgcctatgccggcgaggtcggcaccgacttcatccgcaaccaccgcgtcctcggcgtcgacttcgcctccgtccatatctacccagacacctggatgtcgggcgcggcgactctggaggcacagctcaagtttgtggcttcgtggatgcaggcgcacatcgccgacggcgagggcacgctaggcggcatgccggtggtgttcacggagttcggggcgtccaccaaagcccggtcgagcgccgccttcaacgcgaccacgagagaccagttcatccaggcggtgtacggtcacctcctgaactcgacgcggcgtggcggcgccggagcgggggcactgctctggcaggtgttcccggaggggaccgactacatggacgatggctacggcgtcgtgcttcccagggcggccgccactgcccggatcatgtccgcgcactccaagaagctagccgttttcaattctaggtgcgcttggagctgccgctgggggtgcaggaggagcgagcagcagtcggaggatgatgatgacgacctgccgttcgtttcgaggatgaacagagcagagcatatatag

SEQ ID NO: 14883 - protein, 500 aa, Sorghum bicolor
  misc_feature: The sequence is a functional homolog of SEQ ID NO 2 in US patent 7148399
  misc_feature: Ceres ANNOT ID no. 8632372
  misc_feature (57)..(474): SWISSPROT Homolog: EC 3.2.1.78 Mannan endo-1,4-beta-mannosidase
  misc_feature (87)..(434): Pfam ID: Cellulase Pfam Description: Cellulase (glycosyl hydrolase family 5)
METVFKGRARARTRVSLIHFFVRRCFAVAAAAIFLLTDGRHAHVDPAPLEILGGADDVDTLAHQRPNVNGSEAIDDEQWRMVKTRGNQFVVGDRPFYLNGFNAYWLMILAVDPSTRGKVTEVFQQAAAVGLTVCRTWGFNDGGWRALQKSPSVYDEDVFKALDFVVSEARKYRIRLILSLINNWDGYGGKAQYVKWARDDGGGGLINITSDDAFFSDQTVKGYFKNHVKNMLTRVNSYTSVMYKDDPTILAWELMNEPRCTSDPTGNTLQEWIQEMAFHVKSIDPDHLLEVGAEGFYGPSSPARLPANPNAYAGEVGTDFIRNHRVLGVDFASVHIYPDTWMSGAATLEAQLKFVASWMQAHIADGEGTLGGMPVVFTEFGASTKARSSAAFNATTRDQFIQAVYGHLLNSTRRGGAGAGALLWQVFPEGTDYMDDGYGVVLPRAAATARIMSAHSKKLAVFNSRCAWSCRWGCRRSEQQSEDDDDDLPFVSRMNRAEHI

SEQ ID NO: 14884 - DNA, 1539 bp, Sorghum bicolor
  misc_feature: Ceres ANNOT ID no. 8632393
  misc_feature: Encodes the peptide sequence at SEQ ID NO 14885
atggacggcaatgcgaggtcgtcggcggcgaatcagaagaagcccatcgtcgcggacgacgacctcatcgagctgctgtggcacaacgggagcgtcgtcgcgcagccccaggcgcaccacaggccggcgccggcgccggcgccgccgccctccgaccgcgaccgcccggctggcgccagcggcctcaccggcgaggagaccgccgcgtggttcccggacaccctcgacgacgccctcgagaaggacctgtacacgcatctctggtacagcaccatcgccgacgccgccccgcaacacgagggcacgctcctggctaccccgcagccgtcgccgccgccgccgctgccggttgggagcagcggcgtcgagtcgagctgggccggcgacatctgctccaccttctgcggcagcaaccaggtgcccaggacgccggcagggaccagcaggaaggacgctgcattgcagtcggcagggaccagcggtgccggcgggcacgacggcacatcgtcgtccggtgggtctggaagcaactatgggggatccgggctgccaagtgacagcgtccatgtccacaagaggaaggggaggtgtagagacgactcagatagtccgagtgaggatgccgagtgtgaggaggcaactgaggagaccaaaccgtcgcggcgacatgggccgaaacgccggactcgtgcagctgaagttcataatctctcagagaggagaagaagggacaggatcaatgaaaagatgcgcgcgttgcaagagctgatcccgcactgcaacaagactgacaaagcgtcgatattagatgagacgattgagtatctcaagtccctccaaatgcaagttcagatcatgtggatgacttctgggatggcaccaatgatgtttcctggtgctcaccaattcatgccaccaatggctctaggcatgaattcaggttgcatccctgcagcgcaaggcctaagtcagatgccaagattaccatacatgaaccaccccctgccaaatcatatccctctgaactcatctccagctatgaatccactgaatgctgcgaaccagatgatgcaaaacggtcacctcagggaggcaagtaatcacttccttcacctagatgggcgaacagcggtggtacctcagagttcagattggaggccgagggttccctctccagacttttcctatgatgttacagcattcaagtgcatgttacactcacggccctatcagcacatgctacaggcagtccggtgtgatgataggatcagatgctcatatctcctgaggtcttctgtctaccacatttggattggatttggatccctcctctgtactgtacttctccttgctaccctgttgctttcgactcatggttattctccatatgcttatatatgtatatggcttggcgctttgtcgttgcctcgttggaatgttgggctatattacaatcagagctatggctgtttctggatctggacagtgatttttcgtttgctactgtttgtttggcagctgtttcacgggaacatgtag

SEQ ID NO: 14885 - protein, 512 aa, Sorghum bicolor
  misc_feature: The sequence is a functional homolog of SEQ ID NO 1139 in the 10/374,780 US patent application
  misc_feature: The sequence is a functional homolog of SEQ ID NO 1337 in the 10/412,699 US patent application
  misc_feature: Ceres ANNOT ID no. 8632393
  misc_feature (231)..(280): Pfam ID: HLH Pfam Description: Helix-loop-helix DNA-binding domain
MDGNARSSAANQKKPIVADDDLIELLWHNGSVVAQPQAHHRPAPAPAPPPSDRDRPAGASGLTGEETAAWFPDTLDDALEKDLYTHLWYSTIADAAPQHEGTLLATPQPSPPPPLPVGSSGVESSWAGDICSTFCGSNQVPRTPAGTSRKDAALQSAGTSGAGGHDGTSSSGGSGSNYGGSGLPSDSVHVHKRKGRCRDDSDSPSEDAECEEATEETKPSRRHGPKRRTRAAEVHNLSERRRRDRINEKMRALQELIPHCNKTDKASILDETIEYLKSLQMQVQIMWMTSGMAPMMFPGAHQFMPPMALGMNSGCIPAAQGLSQMPRLPYMNHPLPNHIPLNSSPAMNPLNAANQMMQNGHLREASNHFLHLDGRTAVVPQSSDWRPRVPSPDFSYDVTAFKCMLHSRPYQHMLQAVRCDDRIRCSYLLRSSVYHIWIGFGSLLCTVLLLATLLLSTHGYSPYAYICIWLGALSLPRWNVGLYYNQSYGCFWIWTVIFRLLLFVWQLFHGNM

SEQ ID NO: 14886 - DNA, 1338 bp, Sorghum bicolor
  misc_feature: Ceres ANNOT ID no. 8632411
  misc_feature: Encodes the peptide sequence at SEQ ID NO 14887
atgagggagatcctgcacatccagggcgggcagtgcgggaaccagatcggtgccaagttctgggaggtgatctgcgacgagcacgggatcgacgccacgggccgctacgcgggggactcggacctccagctcgagcgcatcaacgtctactacaacgaggccagcggcggccgcttcgtcccgcgcgccgtcctcatggacctcgagccgggcaccatggactccgtgcgctctgggcccttcggccagatcttccgccccgacaacttcgtcttcggccagtccggcgctgggaacaactgggccaagggacactacaccgagggcgccgagctcatcgactccgtcctcgacgtcgtccgcaaggaggccgagaactgcgactgcctccagggttttcaagtttgccattcgttgggaggtggcactggatctggcatgggcacccttcttatttccaagatcagggaggagtaccctgacagaatgatgttgaccttctctgtattcccatcaccaaaggtttctgatactgttgtggagccttacaatgctacactttctgttcaccaacttgttgagaatgctgatgaatgtatggtgcttgacaacgaggctctgtatgacatatgcttccgcacactaaagctcgccacccctacctttggtgacctgaaccatcttatctctgctaccatgagtggtgtgacatgctgcctgaggttccctggtcagctcaactctgatctgcgcaagcttgccgtgaacctgatcccattccctcgtctccacttcttcatggtcggctttgccccgctgacctctcgcgggtcacagcagtaccgtgcgctcacggtccccgagctgacccagcagatgtgggacgccaagaacatgatgtgcgcagcagacccccgccacggccggtacctgacggcgtcggccatgttccgcgggaagatgagcaccaaggaggtggacgagcagatgctgaacgtgcagaacaagaactcgtcctacttcgtggagtggatccccaacaacgtcaagtcgagcgtgtgcgacatcccgcccaggggcctcaagatggcgggcaccttcgtggggaactccacctccatccaggagatgttccgccgggtgagcgagcagttcactgccatgttcaggcgcaaggccttcctgcactggtacacgggggaagggatggacgagatggagttcaccgaggccgagagcaacatgaacgatctggtcgctgagtatcagcagtaccaggacgccaccgccgacgaggagtacgaggacgaggaggacgaggaagctgtggccgaatag

SEQ ID NO: 14887 - protein, 445 aa, Sorghum bicolor
  misc_feature: Useful for making plants with modulated flowering time
  misc_feature: Functional homolog of the protein sequence given in SEQ ID NO 14090
  misc_feature: Ceres ANNOT ID no. 8632411
  misc_feature (45)..(244): Pfam ID: Tubulin Pfam Description: Tubulin/FtsZ family, GTPase domain
  misc_feature (246)..(383): Pfam ID: Tubulin_C Pfam Description: Tubulin/FtsZ family, C-terminal domain
MREILHIQGGQCGNQIGAKFWEVICDEHGIDATGRYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMLNVQNKNSSYFVEWIPNNVKSSVCDIPPRGLKMAGTFVGNSTSIQEMFRRVSEQFTAMFRRKAFLHWYTGEGMDEMEFTEAESNMNDLVAEYQQYQDATADEEYEDEEDEEAVAE

SEQ ID NO: 14888 - DNA, 591 bp, Sorghum bicolor
  misc_feature: Ceres ANNOT ID no. 8632413
  misc_feature: Encodes the peptide sequence at SEQ ID NO 14889
atggccttcatgcgctcccacagatttttgattccctggagggatggacatggtaggtatagtcatattcctgcttccactaagtggagatatttggactatgcctcttacactggactggacaatttgtttgatatcgtagtcctaggtgccttttgcattattgtggggacgtcaaatgcatcttccggcatgggagttgctcctaacattagggagacatttgtcgagctccaaatgaagaaggcataccgatatgtcatcttcaaaatcgaagagaagcagaagcaggtggttgtggagaagacaggggctactactgaaagctatgatgactttttggcctctctcccagagaatgactgccgatatgctctctatgattttgattttgttactggggagaacgtgcagaaaagcaagattttcttcattgcctggtccccatcgacatcccgcatccgtgctaagatgctgtactccacctcaaaggaccgcatcaagcacgagctcgacgggttccactacgagatccaggcgaccgacccgacagaggtggacattgaggttctccgggagcgggctcactga

SEQ ID NO: 14889 - protein, 196 aa, Sorghum bicolor
  misc_feature: Useful for making plants with modulated time to senescence
  misc_feature: Functional homolog of the protein sequence given in SEQ ID NO 13287
  misc_feature: Ceres ANNOT ID no. 8632413
  misc_feature (69)..(196): Pfam ID: Cofilin_ADF Pfam Description: Cofilin/tropomyosin-type actin-binding protein
MAFMRSHRFLIPWRDGHGRYSHIPASTKWRYLDYASYTGLDNLFDIVVLGAFCIIVGTSNASSGMGVAPNIRETFVELQMKKAYRYVIFKIEEKQKQVVVEKTGATTESYDDFLASLPENDCRYALYDFDFVTGENVQKSKIFFIAWSPSTSRIRAKMLYSTSKDRIKHELDGFHYEIQATDPTEVDIEVLRERAH

SEQ ID NO: 14890 - DNA, 1113 bp, Sorghum bicolor
  misc_feature: Ceres ANNOT ID no. 8632428
  misc_feature: Encodes the peptide sequence at SEQ ID NO 14891
atggttgccaaggagtttggaagagaagcagtaataagcatggagaaagttaagagagacggagaggcgctcatcgctgccagagccggagacgaagaggaagatgatgtggtgctcccggggttccggttccacccgaccgacgaggagctcgtcacgttctacctccgccggaaggtggcgaggaagccgctcagcatggagatcatcaaggagatggacatctacaagcatgatccatgggacctccctaaggcaagcacggttggtggagagaaggaatggtacttcttctgtctgagaggaaggaagtaccggaacagcatcaggcccaacagggtcaccggctccggcttctggaaggccaccggcatcgaccgcccgatctactctgccgctgccgctggtgccgccactgcaaactccggcgagtccatcgggctcaagaagtccctcgtgtactaccgcggcagcgccggcaagggcaccaagaccgactggatgatgcacgagttccgcctcccgccggccgccgccgccgccaccgatgcctcccagagcatgcaagaagctgaggtgtggaccatctgcaggatcttcaagaggaacatcgcctacaagaggcagccgcagcagcaccagcagcaggcgtggcggcagcagccggcgggcagcaacggtccgccgccgctgctggcagagtccagctccaacaccgggagcttcgagtccgacggcggtggcgacgagtacatgaactgcctggcagtgccggccaccgctccgggcgtgccccggcagcatcagatcggcagcatactgaacggaggaggtgtcagtgtcactggcagcagcttcttcagagagagcgtgcatggccagcagttccagggtcaatggctgaaccgcttccctgcgccagcagcaatagagcagaaaccgcagctcctggactcgtcagcgatgaccattgcgttccatcagaacgatcagagcgtcgctgccgccgccatgacgaatgatcagtgctacaaggacgggtactgggacgagattgcaaagttcatggaggtcaatgatccaacagtactttacgactgtagatacgcttga

SEQ ID NO: 14891 - protein, 370 aa, Sorghum bicolor
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Ceres ANNOT ID no. 8632428
  misc_feature (38)..(175): Pfam ID: NAM Pfam Description: No apical meristem (NAM) protein
MVAKEFGREAVISMEKVKRDGEALIAARAGDEEEDDVVLPGFRFHPTDEELVTFYLRRKVARKPLSMEIIKEMDIYKHDPWDLPKASTVGGEKEWYFFCLRGRKYRNSIRPNRVTGSGFWKATGIDRPIYSAAAAGAATANSGESIGLKKSLVYYRGSAGKGTKTDWMMHEFRLPPAAAAATDASQSMQEAEVWTICRIFKRNIAYKRQPQQHQQQAWRQQPAGSNGPPPLLAESSSNTGSFESDGGGDEYMNCLAVPATAPGVPRQHQIGSILNGGGVSVTGSSFFRESVHGQQFQGQWLNRFPAPAAIEQKPQLLDSSAMTIAFHQNDQSVAAAAMTNDQCYKDGYWDEIAKFMEVNDPTVLYDCRYA

SEQ ID NO: 14892 - DNA, 564 bp, Sorghum bicolor
  misc_feature: Ceres ANNOT ID no. 8632473
  misc_feature: Encodes the peptide sequence at SEQ ID NO 14893
atgggacactccaacgtgtggaactcgcaccccaagaactacggccctggatccagagtctgccgtgtgtgcgctaacccccacggcctgatccggaagtacgggctcatgtgctgcaggcagtgcttccgcagcaacgccaaggacatcggcttcatcaagatactagcaagactgtggatctcagattttggcattagcaatttggaacctgtgaagtttcttgttatcgcagcacagcacggcacaggtgtcttggaagcttctccgcgcgtcgcagcgacccgcagatgcggccgggcgcccgggacagctggagcggccctgcatgcgctttgctgcgcctgcacggctcggctggcctggcacacaccacacacacgcacgcactgccgctcgcggctcgcctgctccagcgcacgcgcgccagccagccagccagcccgacgcgatccgtccaatcgccgcggcgatttttttctgggagcgaactggaatccgagccgcagcctcccacgtgggccccggcccatagctgttcccagcctggacggacggacatga

SEQ ID NO: 14893 - protein, 187 aa, Sorghum bicolor
  misc_feature: Useful for making plants with modulated nitrogen use efficiency
  misc_feature: Functional homolog of the protein sequence given in SEQ ID NO 14091
  misc_feature: Ceres ANNOT ID no. 8632473
  misc_feature (3)..(56): Pfam ID: Ribosomal_S14 Pfam Description: Ribosomal protein S14p/S29e
MGHSNVWNSHPKNYGPGSRVCRVCANPHGLIRKYGLMCCRQCFRSNAKDIGFIKILARLWISDFGISNLEPVKFLVIAAQHGTGVLEASPRVAATRRCGRAPGTAGAALHALCCACTARLAWHTPHTRTHCRSRLACSSARAPASQPARRDPSNRRGDFFLGANWNPSRSLPRGPRPIAVPSLDGRT

SEQ ID NO: 14894 - DNA, 318 bp, Sorghum bicolor
  misc_feature: Ceres ANNOT ID no. 8632476
  misc_feature: Encodes the peptide sequence at SEQ ID NO 14895
atgggacactccaacgtgtggaactcgcaccccaagaactacggccctggatccagagtctgccgtgtgtgcgctaacccccacggcctgatccggaagtacgggctcatgtgctgcaggcagtgcttccgcagcaacgccaaggacatcggcttcatcaagatactagcaagactgtggatctcagattttggcattagcaatttggaacctgtgaagtttcttgttgctcacaatgtgcattcttattatgcagtaccgctgaagcttgaggagctccaaagcatgacaaaaatggaggcatggatgggaacctaa

SEQ ID NO: 14895 - protein, 105 aa, Sorghum bicolor
  misc_feature: Useful for making plants with modulated nitrogen use efficiency
  misc_feature: Functional homolog of the protein sequence given in SEQ ID NO 14091
  misc_feature: Ceres ANNOT ID no. 8632476
  misc_feature (3)..(56): Pfam ID: Ribosomal_S14 Pfam Description: Ribosomal protein S14p/S29e
MGHSNVWNSHPKNYGPGSRVCRVCANPHGLIRKYGLMCCRQCFRSNAKDIGFIKILARLWISDFGISNLEPVKFLVAHNVHSYYAVPLKLEELQSMTKMEAWMGT

SEQ ID NO: 14896 - DNA, 1353 bp, Sorghum bicolor
  misc_feature: Ceres ANNOT ID no. 8632460
  misc_feature: Encodes the peptide sequence at SEQ ID NO 14897
atgagggagtgcatctccgtccacatcgggcaggccggcatccaagtcggcaacgcgtgctgggaactttactgcctcgagcacggcatccagcctgatggccaagtgcctggagacaagactgcgggacaccacgatgatgccttcagcaccttcttcagccagactggtgcagggaagcatgtgccccgtgcaatcttcgttgatcttgagcccactgtgatcgacgaggtgcgcactggcacttaccgtcagctcttccaccctgagcagctcatcagcggcaaggaggatgctgctaacaactttgcccgtggccactacacaattggaaaggaaattgttgatctgtgccttgaccgcatccgcaagctcgctgacaactgcactggccttcagggcttcctagtcttcaatgctgttggtggtggcaccggctctggacttggttcactcctccttgagcgcctgtctgtggagtacggcaagaaatccaagctgggcttcactgtgtacccatctccccaggtgtcaacctctgttgtggagccctacaacagcgtgctctccacccactccctcctggagcacactgatgtctccatcctgctcgacaacgaggccatctacgacatctgtaggcgctccctggacattgagaggcccaactactccaacctgaatcgccttgtgtctcaggtgatctcatcacttactgcttccctgaggttcgatggtgccctcaatgtggatgtgaatgagttccagaccaacctggttccttacccgaggatccacttcatgctctcctcatacgcgccggtgatctcttcggcgaaggccttccacgagcagctgtcggtggcggagatcacaagcagcgcgttcgagccggcttccatgatggtcaagtgtgacccacggcacgggaagtacatggcgtgctgcctgatgtaccgtggcgacgtggtgcccaaggacgtgaatgctgcggtggccatcatcaagacgaagcgcaccatccagttcgtggactggtgcccgacggggttcaagtgcggcatcaactaccaggcgccgacggtggtgccgggggctgacctcgccaaggtgcagcgcgccgtgtgcatgatctccaactccaccagcgtcgtcgaggtgttctcccgcatcaacagcaagttcgacctcatgtatgccaagcgcgcgttcgtccactggtacgtcggcgagggtatggaggagggggagttctccgaggcacgcgaggacctggctgccctggagaaggactacgaggaggttgctgcagagggcggtggtgatgacggtgaggaagacgaggagtactga

SEQ ID NO: 14897 - protein, 450 aa, Sorghum bicolor
  misc_feature: Useful for making plants with altered cell wall content and/or composition
  misc_feature: Functional homolog of the protein sequence given in SEQ ID NO 14092
  misc_feature: Ceres ANNOT ID no. 8632460
  misc_feature (49)..(246): Pfam ID: Tubulin Pfam Description: Tubulin/FtsZ family, GTPase domain
  misc_feature (248)..(393): Pfam ID: Tubulin_C Pfam Description: Tubulin/FtsZ family, C-terminal domain
MRECISVHIGQAGIQVGNACWELYCLEHGIQPDGQVPGDKTAGHHDDAFSTFFSQTGAGKHVPRAIFVDLEPTVIDEVRTGTYRQLFHPEQLISGKEDAANNFARGHYTIGKEIVDLCLDRIRKLADNCTGLQGFLVFNAVGGGTGSGLGSLLLERLSVEYGKKSKLGFTVYPSPQVSTSVVEPYNSVLSTHSLLEHTDVSILLDNEAIYDICRRSLDIERPNYSNLNRLVSQVISSLTASLRFDGALNVDVNEFQTNLVPYPRIHFMLSSYAPVISSAKAFHEQLSVAEITSSAFEPASMMVKCDPRHGKYMACCLMYRGDVVPKDVNAAVAIIKTKRTIQFVDWCPTGFKCGINYQAPTVVPGADLAKVQRAVCMISNSTSVVEVFSRINSKFDLMYAKRAFVHWYVGEGMEEGEFSEAREDLAALEKDYEEVAAEGGGDDGEEDEEY

SEQ ID NO: 14898 - DNA, 1050 bp, Sorghum bicolor
  misc_feature: Ceres ANNOT ID no. 8632485
  misc_feature: Encodes the peptide sequence at SEQ ID NO 14899
atggatagcttcggggatcttggcggcggaggtgggagaagttcctccaaggctgcttccttcttgcagcttccgctgccggcatcaacatcgtcagcacagcaggtgtttccgccgccggacggccggcagcaccacagctcacgcttcgccttgcaacagttactcgccgacccgtcggcagcgcagcagcatagccatcagaaggacgcggcagcaatagtacagggagagatgtcgtcgccgccggcggatggggatgccgacaccatcaaggccaagatcatgtcgcacccccagtactcggctctcctcgccgcctacttggactgccagaaggtcggcgcgccgccggatgtttcggataggctctcggccatggcggccaagctgggcgcacagccggggccaagccggtggcgcgagccgacgacgcggcctgacccggagctcgaccagttcatggaggcttactgcaacatgctggtgaagttccaggaggagatggcgcggccgatccaggaagcaacggagttcttcaagagcgtggagaggcaactgcagctaggctcgatctccgacagtagtaactgtgaggtggccgggtcgtcagaggatgagcaggacgcgagctgtcctgaagacatcgatccctgcgccgaggacaaggagctcaagcaccagcttctgaggaaatacggcggctacctgggtggccttcgtcaggagttctccaagaggaagaagaaagggaagctccccaaggaggccaggcagaagctgttgcactggtgggagctgcactacaagtggccctatccttctgagacggagaagatggcgctggcagagacgacagggctggaccagaagcagatcaacaactggttcatcaaccagcggaagcggcactggaagccggcgtcggaggacatgccgttcgcgatgatggagggcgggttccacgtcccgcagggcaccgcggcgctgtacatggacaggccgccgccgttcatggctgacggcggcatgtaccggctggggtcgtga

SEQ ID NO: 14899 - protein, 349 aa, Sorghum bicolor
  misc_feature: Useful for biocontainment applications
  misc_feature: Useful for making plants with modulated biomass
  misc_feature: Functional homolog of the protein sequence given in SEQ ID NO 12970
  misc_feature: Useful for making plants with altered lignin content
  misc_feature: Functional homolog of the protein sequence given in SEQ ID NO 13209
  misc_feature: Ceres ANNOT ID no. 8632485
  misc_feature (89)..(133): Pfam ID: KNOX1 Pfam Description: KNOX1 domain
  misc_feature (141)..(192): Pfam ID: KNOX2 Pfam Description: KNOX2 domain
  misc_feature (224)..(245): Pfam ID: ELK Pfam Description: ELK domain
MDSFGDLGGGGGRSSSKAASFLQLPLPASTSSAQQVFPPPDGRQHHSSRFALQQLLADPSAAQQHSHQKDAAAIVQGEMSSPPADGDADTIKAKIMSHPQYSALLAAYLDCQKVGAPPDVSDRLSAMAAKLGAQPGPSRWREPTTRPDPELDQFMEAYCNMLVKFQEEMARPIQEATEFFKSVERQLQLGSISDSSNCEVAGSSEDEQDASCPEDIDPCAEDKELKHQLLRKYGGYLGGLRQEFSKRKKKGKLPKEARQKLLHWWELHYKWPYPSETEKMALAETTGLDQKQINNWFINQRKRHWKPASEDMPFAMMEGGFHVPQGTAALYMDRPPPFMADGGMYRLGS

SEQ ID NO: 14900 - DNA, 1026 bp, Sorghum bicolor
  misc_feature: Ceres ANNOT ID no. 8632546
  misc_feature: Encodes the peptide sequence at SEQ ID NO 14901
atggggctggacgtcggtgagatcgggatgggcctggatctgggtctcgacctcaggctgttcgccgcgcggacagccggcgggatggcggcggccgcggccaagggtgcgccggcggggatcgagtcctgtatcaggagcctcgaggaggagcgcaagaagatcgaggtgttcaggcgcgagctcccgctctgcgcgcgcctcctcgccgacgtgatcgacgagttgaaggaggaggccgccaagagaggcggaggagacgcggacgcgaaggcggacgacggcgacaagcggaaatggatgagcaccgctcagttgtgggtggacagcgaagccaaatcggacgagtctgataaggagcatcagagtgaatcacctcgccggagcccaagttgcttgtggccacccatgcccataagggccgttgcggctgtaccacccctgccgccgccgttcttcaggagagaagacagctctgccggcacttgtctgtcgttggtatcgccggcatctaaggccccgatttctcccgtggctaccagcgataacgccagcggcagattttgtcccaccatgccaccatctggctcttctggggtcaccttgcactctcaggctcagcagcaggctagcaggaaggcgaggcggtgctggtcgccggagcttcaccggcagttcgtcgccgctttgcatcaactcggcggccctcaagttgctactccgaaacaaatcagggaggtgatgcaagtggacggtcttacaaatgatgaagtgaaaagccatctccagaagtaccggctgcacaacagaagatcccccggtgttgctccggtgagccagccgatcatgttggtgggtggcctctgggctccacaggagcaaagcagctccggttcaccccagggtccgcttcagttctcgggatcaggtgtggccatttctacggccaccgtcggcggtgacagcagcggcagcagcagcgacgaagacgacaagtccgaaggctacagccggaaatgcgtgtaa

SEQ ID NO: 14901 - protein, 341 aa, Sorghum bicolor
  misc_feature: Useful for making plants with altered lignin content
  misc_feature: Functional homolog of the protein sequence given in SEQ ID NO 13018
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: Ceres ANNOT ID no. 8632546
  misc_feature (215)..(266): Pfam ID: Myb_DNA-binding Pfam Description: Myb-like DNA-binding domain
MGLDVGEIGMGLDLGLDLRLFAARTAGGMAAAAAKGAPAGIESCIRSLEEERKKIEVFRRELPLCARLLADVIDELKEEAAKRGGGDADAKADDGDKRKWMSTAQLWVDSEAKSDESDKEHQSESPRRSPSCLWPPMPIRAVAAVPPLPPPFFRREDSSAGTCLSLVSPASKAPISPVATSDNASGRFCPTMPPSGSSGVTLHSQAQQQASRKARRCWSPELHRQFVAALHQLGGPQVATPKQIREVMQVDGLTNDEVKSHLQKYRLHNRRSPGVAPVSQPIMLVGGLWAPQEQSSSGSPQGPLQFSGSGVAISTATVGGDSSGSSSDEDDKSEGYSRKCV

SEQ ID NO: 14902 - DNA, 1539 bp, Sorghum bicolor
  misc_feature: Ceres ANNOT ID no. 8632521
  misc_feature: Encodes the peptide sequence at SEQ ID NO 14903
atggccacggcgacttacctctcctccttcccggcagcgccgtcgtcgcgcacccgcctgcggcggcagacgaccagggcgaccgcgtcggcgaccgaccgtccgcgcgaggtggtgtccccgaagcgccggctcccgctgcggaaggtgccgggcgactacggcctgccggtgctgggcgcgatccgcgaccggttcgagtacttctacggtcccggcggccgggacgggttcttcacctcccgcgtgcgcgcgcacggctccaccgtggtgcggctcaacatgccgccgggccccttcgtggcgcgcgacccgcgcgtggtggcgctcctcgacgccgcctccttcccggtgctcttcgacacctcgctcgtcgacaagacggacctcttcacgggcaccttcatgccttccaccgacctcaccggcggctaccgcgtgctctcgtacctcgaccccagcgagcccaaccacgggccgctcaagacgctcctcttctacctcctgtcgcaccggcggcagcacgtgatccccaagttccgcgaggtgtacggcgacctcttcggccacatggagaacgagctggccagggtcggcaaggccgacttcgggcactacaacgacgccgccgccttctccttcctctgccaggcgctgctggggcgcgaccccgccgagtcggcgctccagggcgacgggcccaagctgatcaccaagtgggtgctgttccagctcagcccgctgctcagcctgggcctgcccaagcacgtcgaggactccctgctccactcgttccgcctgccgccggcgctggtcaagaaggactacgaccggctcgccgacttcttccgcgacgcgggcaggagcgtcgtcgacgagggcgagcgcctcggcattgcgcgggaggaggcggtgcacaacatcctgttcgccatgtgcttcaactccttcggcggcatgaagatcctgttcccgtcgctcgtcaagtggctgggccgcgccggcgcgcgcacgcacgggcggctggcgacggaggtgcgcgacgccgtgcgcgcgcacggcggcgaggtgaccatgaaggcgctggcggagatgccgctggtgaagtcggccgtgtacgaggcgctgcggatcgagccccccgtggcgatgcagtacgggcgcgccaagcgggacatggtggtggagagccacgactacggcttcgaggtccgcgagggggagatgctcttcggctaccagcccatggccaccaaggacccgcgcgtcttcgcgcgcgccgaggagtacgtgccggacaggttcctcggcgaggatggcgcgcagctgcttcgacacgtcgtctggtccaacgggcccgagacggtgtcgcccacgctgcaggacaagcagtgcgccggcaaggacttcgtcgtgctcatcgcgcgcctcctcgtcgccgagctcttcctccgctacgactccttcgacgtccaggtcggcgcctccgcgctggggtcgtcggtgaccatcacctcgctcaagaaagccaccttctga

SEQ ID NO: 14903 - protein, 512 aa, Sorghum bicolor
  misc_feature: Useful for biocontainment applications
  misc_feature: Useful for making plants with modulated nitrogen use efficiency
  misc_feature: Functional homolog of the protein sequence given in SEQ ID NO 13988
  misc_feature: Ceres ANNOT ID no. 8632521
  misc_feature: Up-regulated in root tissues in response to aminocyclopropane carboxylic treatment
  misc_feature: Up-regulated in root tissues in response to salicylic acid treatment
  misc_feature (1)..(512): SWISSPROT Homolog: EC 4.2.1.92 Hydroperoxide dehydratase
  misc_feature (50)..(512): Pfam ID: p450 Pfam Description: Cytochrome P450
MATATYLSSFPAAPSSRTRLRRQTTRATASATDRPREVVSPKRRLPLRKVPGDYGLPVLGAIRDRFEYFYGPGGRDGFFTSRVRAHGSTVVRLNMPPGPFVARDPRVVALLDAASFPVLFDTSLVDKTDLFTGTFMPSTDLTGGYRVLSYLDPSEPNHGPLKTLLFYLLSHRRQHVIPKFREVYGDLFGHMENELARVGKADFGHYNDAAAFSFLCQALLGRDPAESALQGDGPKLITKWVLFQLSPLLSLGLPKHVEDSLLHSFRLPPALVKKDYDRLADFFRDAGRSVVDEGERLGIAREEAVHNILFAMCFNSFGGMKILFPSLVKWLGRAGARTHGRLATEVRDAVRAHGGEVTMKALAEMPLVKSAVYEALRIEPPVAMQYGRAKRDMVVESHDYGFEVREGEMLFGYQPMATKDPRVFARAEEYVPDRFLGEDGAQLLRHVVWSNGPETVSPTLQDKQCAGKDFVVLIARLLVAELFLRYDSFDVQVGASALGSSVTITSLKKATF

SEQ ID NO: 14904 - DNA, 1029 bp, Sorghum bicolor
  misc_feature: Ceres ANNOT ID no. 8632525
  misc_feature: Up-regulated in root tissues in response to aminocyclopropane carboxylic treatment
  misc_feature: Up-regulated in root tissues in response to salicylic acid treatment
  misc_feature: Encodes the peptide sequence at SEQ ID NO 14905
atgctgcaaaggaacctaccgaatctctgcctccagataagcccgccagcggcctcgtcggccgtcgttgcatccgacgcaccggtggcggcgtcggcgaagcctccgccgacacaaccaataagcacggcgacgtacgctgaaggaagcggcgaggtagggttctttgcaaaccctagccccggcgcggagcccccggggcttagccttgggctcgccacgccggcgcttggcgacaacgcggccggacggcgaggccaccacctccagccgcagggatgcgcgttcaagcgcgcggccgccagggcttccctgcctgccgccggatcgaagcgaagcgcccgggcgccgcggatgcgctggaccaccgcgctccacgcgcgcttcgtgcacgccgtcgagctcctcggcggacatgagagagcgacgccgaagtcggtgatggagctgatgaacgtcaaggatctaacgctcgcgcatgtcaagagccaccttcagatgtacaggacagtgaagagcacagacagatcgttgcacacagctacagcatgtgacgacatggttgggatctgcagctctccttcggcgggctctgcgccgcctgctatggcgactacttccgctgctcacttcctctgtgcgccagcagcaacaactgctccactggcggcagcaccgtcacctcctccacccattcccccgaggagcaggactactgaccacgcagcagcagtgccggaaaaaggtgttgcaattgttgactcgttgcaccggccagtgcttgaagatactcatcaggctgctcaagaaaaggcaaataatggtcagctgccaatgggactgcacgggtgtgttgacctgcttgaccccatggctacaaactgctcaagtccagcgagctcttctccatctctcgctagcctggagcagctgacggccgacatgtacgcgccgaacctggagatctccctggggaggcaggactggagcatggaccgtccggaaggactttgcctgaaatacctgtga

SEQ ID NO: 14905 - protein, 342 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 12899
  misc_feature: Ceres ANNOT ID no. 8632525
  misc_feature (118)..(169): Pfam ID: Myb_DNA-binding Pfam Description: Myb-like DNA-binding domain
MLQRNLPNLCLQISPPAASSAVVASDAPVAASAKPPPTQPISTATYAEGSGEVGFFANPSPGAEPPGLSLGLATPALGDNAAGRRGHHLQPQGCAFKRAAARASLPAAGSKRSARAPRMRWTTALHARFVHAVELLGGHERATPKSVMELMNVKDLTLAHVKSHLQMYRTVKSTDRSLHTATACDDMVGICSSPSAGSAPPAMATTSAAHFLCAPAATTAPLAAAPSPPPPIPPRSRTTDHAAAVPEKGVAIVDSLHRPVLEDTHQAAQEKANNGQLPMGLHGCVDLLDPMATNCSSPASSSPSLASLEQLTADMYAPNLEISLGRQDWSMDRPEGLCLKYL

SEQ ID NO: 14906 - DNA, 1083 bp, Sorghum bicolor
  misc_feature: Ceres ANNOT ID no. 8632544
  misc_feature: Encodes the peptide sequence at SEQ ID NO 14907
atggcagggccggcgccggatcgggccgccctgactgtggggccgggcatggacatgccgatcatgcacgacagcgaccggtacgagctcgtgcgcgacatcggctccggcaacttcggcgttgcccgcctcatgcgcgaccgccgcaccagcgaactcgtcgccgtcaagtacatagagcgcggcgagaagatagatgagaatgtccagcgtgagataattaaccatagatcattgaaacaccctaacattattaggtttaaagaggttattttaacaccgacccaccttgctattgtcatggaatatgcctctggtggtgagctttttgagagaatatgtaagaacgtgcgattcagtgaagatgagcagctcatttcaggagtaagctactgccattcaatgcaagtatgccaccgtgatctgaagctggagaacacacttctagatgggagtgatgctcctcgcttgaagatatgtgacttcggctattccaagtcatctgttcttcattcccagccgaagtccactgttggaacacctgcttatattgcacctgaagttctgttgaaaaaagaatacgatggcaagattgctgatgtttggtcatgtggtgtaaccctctatgtaatggttgttggtgcatatccttttgaagacccagaagagcctaagaacttccgcaagacaattcagcgcatcttgaacgttcagtacgcaattccagacaacgtgaacatatctccagagtgcaggcatctaatttcgaggatttttgttggagatcctgctatgcgaataacaatccctgaaatccggaatcatagttggttcctgaagaaccttcctgctgatctgatggatgatgatagcatgagcaaccaatatgaggagcctgaccagccaatgcagaccatggatcagatcatgcagattttgacagaggccaccataccacctgcctgttctcgcagtataaatgtcctagctgatggattggacatggacgacgacatggatgatcttgactctgactcagatcttgatgttgacagcagcggtgagattgtgtacgcaatgtga

SEQ ID NO: 14907 - protein, 360 aa, Sorghum bicolor
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 14093
  misc_feature: Useful for making plants with modulated water use efficiency
  misc_feature: Functional homolog of the protein sequence given in SEQ ID NO 14094
  misc_feature: Ceres ANNOT ID no. 8632544
  misc_feature (2)..(360): SWISSPROT Homolog: EC 2.7.11.1 Non-specific serine/threonine protein kinase
  misc_feature (28)..(278): Pfam ID: Pkinase Pfam Description: Protein kinase domain
MAGPAPDRAALTVGPGMDMPIMHDSDRYELVRDIGSGNFGVARLMRDRRTSELVAVKYIERGEKIDENVQREIINHRSLKHPNIIRFKEVILTPTHLAIVMEYASGGELFERICKNVRFSEDEQLISGVSYCHSMQVCHRDLKLENTLLDGSDAPRLKICDFGYSKSSVLHSQPKSTVGTPAYIAPEVLLKKEYDGKIADVWSCGVTLYVMVVGAYPFEDPEEPKNFRKTIQRILNVQYAIPDNVNISPECRHLISRIFVGDPAMRITIPEIRNHSWFLKNLPADLMDDDSMSNQYEEPDQPMQTMDQIMQILTEATIPPACSRSINVLADGLDMDDDMDDLDSDSDLDVDSSGEIVYAM

SEQ ID NO: 14908 - DNA, 1251 bp, Sorghum bicolor
  misc_feature: Ceres ANNOT ID no. 8632555
  misc_feature: Encodes the peptide sequence at SEQ ID NO 14909
atggcctggtgtgccctgcgcagccgcgtccttccgctcccggcctccgccgccaccgccgcgccccacggcctgctcctacgcttcttcctctccaccgcggccccgcgccacgcgcaccaccaccggcgccgccgcctcgcccccacggcctacgccgccgccgcggcagctgcggctgaggcgccgctccccatgacgccgcgcttcggccgggccacgcggcaccccggggccgtcgcctccgtggcgcgcgtctacgccgacgccaacgcccagcggcccaaggagtactgggactacgagtcgcttgacatccagtggggggagcaggatgggtacgaggtgctgaggaaagtgggaaaggggaagtacagcgaggtgttcgaaggctaccgggctgggagcgacgagagatgcgtcattaagatcctcaagcctgtgaagaagaagaagataaagagggaaataaagatacttcagaacttatatggagggcctaacattgtaaagctacttgatgttgtcagagatgatgaatcaaagacgcctagtttgatctttgaacatgtcaacaacactgacttcaaagtgctctaccctgtgttatctgattatgatatcagatattatatttttgaattattaaaggcactagattattgtcattcacgaggtataatgcaccgagatgtcaaaccccacaatgtcatgattgaccatgaaaaacgccagcttcgtcttattgattggggtcttgcagagttctatcatcccaagatggaatataatgctagagttgcttcaagatgctacaagggtcctgaactacttgtggatttgttagattatgattactcattggatttgtggagccttggttgcatgttcgcagcaatgatattccgagtggaccctttctttagtggccaggataattatgatcaattagtgaaaatagctgaggttcttggcacaggagatttgtataactaccttgaaaaatatggcctccagcttgacccacagcttgaaagacttgttggaagacataataggaaaccatggcccaagtttgtcaatgctaggaacagacacctgcgacacctgagtttctaccttttacaggctattgatttggtagataaactcctccgatatgatcaccaggaaaggcctacagccaaggaaaccatggctcacccgtatttcaatccagtaagaagttccgaaagcaagacaaattcataa

SEQ ID NO: 14909 - protein, 416 aa, Sorghum bicolor
  misc_feature: The sequence is a functional homolog of SEQ ID NO 1 in US patent 7038110
  misc_feature: Useful for making plants with modulated flowering time
  misc_feature: Functional homolog of the protein sequence given in SEQ ID NO 14095
  misc_feature: Ceres ANNOT ID no. 8632555
  misc_feature (82)..(416): SWISSPROT Homolog: EC 2.7.11.1 Non-specific serine/threonine protein kinase
  misc_feature (114)..(404): Pfam ID: Pkinase Pfam Description: Protein kinase domain
MAWCALRSRVLPLPASAATAAPHGLLLRFFLSTAAPRHAHHHRRRRLAPTAYAAAAAAAAEAPLPMTPRFGRATRHPGAVASVARVYADANAQRPKEYWDYESLDIQWGEQDGYEVLRKVGKGKYSEVFEGYRAGSDERCVIKILKPVKKKKIKREIKILQNLYGGPNIVKLLDVVRDDESKTPSLIFEHVNNTDFKVLYPVLSDYDIRYYIFELLKALDYCHSRGIMHRDVKPHNVMIDHEKRQLRLIDWGLAEFYHPKMEYNARVASRCYKGPELLVDLLDYDYSLDLWSLGCMFAAMIFRVDPFFSGQDNYDQLVKIAEVLGTGDLYNYLEKYGLQLDPQLERLVGRHNRKPWPKFVNARNRHLRHLSFYLLQAIDLVDKLLRYDHQERPTAKETMAHPYFNPVRSSESKTNS

SEQ ID NO: 14910 - DNA, 1158 bp, Sorghum bicolor
  misc_feature: Ceres ANNOT ID no. 8632572
  misc_feature: Encodes the peptide sequence at SEQ ID NO 14911
atgatcggtgcgccgcccccttggaaccgcctgcctaccggcatcgccaagcccgccgccgcggctgccgtcgtcgtagcggcgctcgcgtcctccttcctcgccctcccgcgcccacgcgccgccgctccgccccccgcgggatccgggcccctcatgtcgaaggcgagggtctacaccgacgtcaacgtcctgcgccccaaggagtactgggactacgaggcgctcaccgtccaatggggtgagcaggatgactatgaagttgtcaggaaagttggaagaggtaaatatagtgaggtctttgaaggcatcaatgttaacaataatgagaaatgcatcattaagatccttaagcctgtcaagaaaaagaagatcaagagggagatcaaaatacttcagaatctctgtggaggtccaaacattgtgaagttgctcgatattgtcagagatcagcattcaaagactcccagtttgatatttgaatttgtcaacaacacagacttcaaagttttgtaccccacattgacggattatgacatccgctactacatatatgagctactcaaggctctagattactgccattctcaaggtatcatgcatcgagatgtcaagccccacaatgtaatgatagatcacgagctccggaaacttcgcttgatagactggggcttagctgagttctaccatccaggcaaggaatataatgtccgtgttgcatcgaggtatttcaagggacctgaactccttgttgatttacaagactatgattattctttggacatgtggagtcttggttgcatgtttgctggaatgatatttcgcaaggaaccattcttttatggccatgacaaccatgaccaacttgtgaagattgcaaaggtccttggaacagatgggctgaatgcttatttgaacaagtatcacattgagctggaccctcaacttgaagctcttgttggaaggcatagtagaaaaccctgggcgaaattcatcaatgctgataaccaacatctagtatcgcctgaggccattgattttctcgataagcttctgcgctatgatcaccaagataggcttactgcacgtgaagctatggcacatccctacttcctccaagtcagagctgtggagaacagtaggtcgagaccacaataa

SEQ ID NO: 14911 - protein, 385 aa, Sorghum bicolor
  misc_feature: The sequence is a functional homolog of SEQ ID NO 1 in US patent 7038110
  misc_feature: Useful for making plants with modulated flowering time
  misc_feature: Functional homolog of the protein sequence given in SEQ ID NO 14095
  misc_feature: Ceres ANNOT ID no. 8632572
  misc_feature (53)..(383): SWISSPROT Homolog: EC 2.7.11.1 Non-specific serine/threonine protein kinase
  misc_feature (86)..(371): Pfam ID: Pkinase Pfam Description: Protein kinase domain
MIGAPPPWNRLPTGIAKPAAAAAVVVAALASSFLALPRPRAAAPPPAGSGPLMSKARVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEFVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYHIELDPQLEALVGRHSRKPWAKFINADNQHLVSPEAIDFLDKLLRYDHQDRLTAREAMAHPYFLQVRAVENSRSRPQ

SEQ ID NO: 14912 - DNA, 282 bp, Sorghum bicolor
  misc_feature: Ceres ANNOT ID no. 8632584
  misc_feature: Encodes the peptide sequence at SEQ ID NO 14913
atgaagcttgagacggccgccaccgttgctctcctcctcgtcctcctcctggcgccgccttcgctccgtgtctccatggctggatcagcgttctgcgacggcaagtgcggggtgaggtgctccaaggcgagccggcacgacgactgcctcaagtactgcgggatctgctgcgccagctgcaactgcgtgccgtccggcaccgcgggccacaaggacgagtgcccctgctaccgcgacatgaccaccggccacggcaaccgcaccaggcccaagtgcccttag

SEQ ID NO: 14913 - protein, 93 aa, Sorghum bicolor
  misc_feature: Useful for making plants with altered lignin content
  misc_feature: Functional homolog of the protein sequence given in SEQ ID NO 14096
  misc_feature: Useful for making plants with altered terpenoid content
  misc_feature: Functional homolog of the protein sequence given in SEQ ID NO 14097
  misc_feature: Ceres ANNOT ID no. 8632584
  misc_feature (3)..(93): Pfam ID: GASA Pfam Description: Gibberellin regulated protein
MKLETAATVALLLVLLLAPPSLRVSMAGSAFCDGKCGVRCSKASRHDDCLKYCGICCASCNCVPSGTAGHKDECPCYRDMTTGHGNRTRPKCP

SEQ ID NO: 14914 - DNA, 2295 bp, Sorghum bicolor
  misc_feature: Ceres ANNOT ID no. 8632578
  misc_feature: Encodes the peptide sequence at SEQ ID NO 14915
atgcggcgccatggcgaggtatgcgtgatctttgctgtggccgccgccgccctcttggtggccgcggcgaccccagccgcggctggtcgggaggatcggcagacctacatcgtccacatgtcccattccgccatgccgagtgatttcgtggagcatgaggagtggtacgccgcgtcgcttcaggcggtgtcggacgccgccaccgtgctgtacacctacaacaccctcctccacggctactcggcgcggctgacgcgcgcggaggccgcggcgctggagtcgcagcccggcgtgctcgtcgtcaacccggaggtgcggtacgagctgcacaccacccggacgtgggagttcctggggctggacggcacggacgcgctgttcccgcagtcgggcaccgggtccgacgtcatcgtcggggtgctcgacaccggcgtgtggccggagaggccgagctatgacgacacggggttcggccccgttccggcgggctggaagggcaagtgcgaggacggcaacgacttcaacgccaccgcgtgcaacaagaagctcatcggcgcgaggttcttcctgacgggctacgaggcggccaagggccccgtggacacgtccaaggaatcccggtcgccgagggacaacgacggccacgggacgcacacgtcgagcaccgcggcgggcggcgccgtccagggcgcggacctgctcggctacgccgccggcacggccaagggcatggcgccccgcgctcgcgtcgcgacgtacaaggtgtgctgggtcggcggctgcttcagctccgacatcctcaaggccatggaggttgcagtgacggacggcgtcgacgtgctctccctctccctcggcggcggcacggcggagtactaccgtgacagcatcgcggtgggcgctttcagcgccatggaaaaggggatcttcgtgtcctgctccgcgggcaatgccggcccgggcgccgcgacgctgtcgaacggcgcgccgtggatcaccaccgtgggcgccggcaccatcgaccgcgacttccccgcctacgtcatgctcggcaacggcaagaactacacgggcgtgtccctctacagcggcaagctattgcccaccacgccggtgcctttcatctacgcggggaacgcgtccaacagcagcatgggccagctctgcatgtccggcagcctcatcccggagaaggtggccggcaagatcgtgctctgcgaccgcggcaccaacgccagggtccagaagggcttcgtcgtcaaagacgccggcggcgctggcatggttctcgccaacaccgccgccaacggcgaggagctcgtcgctgacgcgcacgttctcccgggctccggcgtgggggagaaagccggcaacgccatgagggactacgccatgtcggatccgaaggcgacggccaccattgtgttcgccggcacgaaggtcggcatcaagccgtctcccgtcgttgcggccttctcctccaggggccccaacactgtgacgtcgagcatcctgaagccggacgtcatcgcgcccggcgtgaacattctggcggcgtggtcggggtccgtcggcccctcggggctccccggcgacagccgccgcgtgggcttcaacatcatctccgggacgtccatgtcgtgcccgcacgtgagcgggcttgcggcgctgctccgcgcggcgcacccggagtggagcccggcagccatccggtcggcgctgatgacgacggcgtacaacgattacccaggcggcgctggcatcctggacgtggccacgggccggccggccacgccgctggacgtgggcgccggccacgtcgaccccgcgaaggccgtggacccggggctggtgtacgacatcaccgcggcggactacatcgacttcctctgcgccaacaactacgagccggcgcagatcgcggcgctcaccaggcagcacccgtccgaggggtgcagcgccaaccgcacgtacacggtgaccgcgctcaactacccgtccttctccgtggcgttcccggccgccggcggcacggtgaagcacacccgcacggtgaccaacgtcgggcagcctggaacgtacaaggtgaccgccagcgccgccgccggcagcgccccggtgacggtgtccgtggagccgtcgacgctgagcttcagcaaggccggcgagaagcagagctacacggtgagcttcacggcgggcgggatggcgtcgggcaccaacgggttcggacggctcgtctggtccagcgaccaccacgtggtcgccagcccgatcgcggcgacatggacctaa

SEQ ID NO: 14915 - protein, 764 aa, Sorghum bicolor
  misc_feature: Useful for making plants with modulated flowering time
  misc_feature: Functional homolog of the protein sequence given in SEQ ID NO 14098
  misc_feature: Ceres ANNOT ID no. 8632578
  misc_feature (31)..(578): SWISSPROT Homolog: EC 3.4.21.25 Cucumisin
  misc_feature (365)..(464): Pfam ID: PA Pfam Description: PA domain
  misc_feature (34)..(110): Pfam ID: Subtilisin_N Pfam Description: Subtilisin N-terminal Region
MRRHGEVCVIFAVAAAALLVAAATPAAAGREDRQTYIVHMSHSAMPSDFVEHEEWYAASLQAVSDAATVLYTYNTLLHGYSARLTRAEAAALESQPGVLVVNPEVRYELHTTRTWEFLGLDGTDALFPQSGTGSDVIVGVLDTGVWPERPSYDDTGFGPVPAGWKGKCEDGNDFNATACNKKLIGARFFLTGYEAAKGPVDTSKESRSPRDNDGHGTHTSSTAAGGAVQGADLLGYAAGTAKGMAPRARVATYKVCWVGGCFSSDILKAMEVAVTDGVDVLSLSLGGGTAEYYRDSIAVGAFSAMEKGIFVSCSAGNAGPGAATLSNGAPWITTVGAGTIDRDFPAYVMLGNGKNYTGVSLYSGKLLPTTPVPFIYAGNASNSSMGQLCMSGSLIPEKVAGKIVLCDRGTNARVQKGFVVKDAGGAGMVLANTAANGEELVADAHVLPGSGVGEKAGNAMRDYAMSDPKATATIVFAGTKVGIKPSPVVAAFSSRGPNTVTSSILKPDVIAPGVNILAAWSGSVGPSGLPGDSRRVGFNIISGTSMSCPHVSGLAALLRAAHPEWSPAAIRSALMTTAYNDYPGGAGILDVATGRPATPLDVGAGHVDPAKAVDPGLVYDITAADYIDFLCANNYEPAQIAALTRQHPSEGCSANRTYTVTALNYPSFSVAFPAAGGTVKHTRTVTNVGQPGTYKVTASAAAGSAPVTVSVEPSTLSFSKAGEKQSYTVSFTAGGMASGTNGFGRLVWSSDHHVVASPIAATWT

SEQ ID NO: 14916 - DNA, 2520 bp, Sorghum bicolor
  misc_feature: Ceres ANNOT ID no. 8632597
  misc_feature: Encodes the peptide sequence at SEQ ID NO 14917
atggctagaagcatgcttgagtggaagagagtaccaatgtttatcatcctctccatccttggtatcactagtgtaaccagcaccaatgcaattgcatcacagaagggtccgtttgtacctcaagacaactacctcattagctgcggagcttctggttctgtgcagcttgatgatggcaggacattccgctctgatccagagtcagtatcttttctgtccaccccagtggacatcaagatcacagctaacaattctccaactgctgcttcaccattatccccactctacctatctgcaagagttttctctgatgtttcaacttatagcttctttgtctcgcagcctggccgccattggatccgtctctacttcttacctattcctgacaaaaaatacaacctcacttcagcaacattctctgtgttcactgacaatatggttcttctccatgacttctccttcatagccagtcctcttaaccccatccttaaggagtatattgttgtaacacagggagaaaccttgaagatcattttcaccccaaagaaggactcaatagcattcatcaatgctattgaaattgtctcggtgccacccaccctaattccaaataccaccaatggcctgcctcgtcaagaacaatttgatatctccaacaatgcattgcaggtagtctaccggctcaacatggggggtgcacttgtgacagccttcaatgacacactagggaggacctggttaccagatgcaccttttttgaagcttgagacagcagcacaggcggcttgggttcctcctagaaccatcaagtaccctgatgacaaggcagtcacaccactcattgctccagcaaacatatactcaacagcacagcagacagcatcgacaaatacctcacaagcaagattcaacataacctgggaaatggaagcagagccaggattcaagtacctcatccgcctacatttctgtgatattataagcaaggcactcaatagcctctacttcaatgtgtacataaatggcatgatgggtgtatccaaccttgacctctcaagcttgacaatgggccttgcagtagcctactaccaggacttcaccgtggactcatccagcatcatcaactccacccttctagtgcaggttggcccaagcacaaccgactccagcaatactgatgccatccttaatggtcttgaagtcatgaaaataagcaaccaagcaaacagcttagatggcctattttcaccaaaaacaagctcacatcttggtaagaggatactaactggcataggtctttctttggcagtgattgcagctgcattggtcatagttatgtgctgcaggcgaaaccaaaggccagagtggcagaagacagacagcttttggttccttcgactcaactccaaccagtccagcttcatgaacagctgcagcaggctctccagaagtcgctttggctccacaaggaccaagagtggtttttctagcctgtttgcatctagtgcttatggactgggccgctatttcaccttcgctgaaattcagaaagccacaaaaaactttgaagaaaaggatgtcattggtgtcggtggctttgggaaggtttatcttggtgttcttgaggatggtacaaagctagctatcaagagaggcaatccatcttctgatcaaggtatgaacgaattcctgactgaaattcaaatgttgtcaaagcttcgtcaccgccacctggtttcactcattggttgctgtgatgagaataatgagatgatcctggtttatgagttcatgtcaaacggtccactcagggatcatctatatggtgctacaaacctgaagcctctatcttggaagcaacgcttagaaattagcattggggcagcaaaaggcctgcattatcttcatacaggtgcagctcagggtataattcaccgtgatgtcaagactactaacattctccttgatgaaaattttgtggccaaggttgctgattttggcctatcaaaagctgctccatccctagagcaaactcatgtcagcactgctgtcaaaggaagttttggctaccttgatccagagtacttcagacgtcaacaactaacagagaaatcagatgtatactcattcggggtggtactctttgaggtactgtgtgcaaggccagccatcaatccagcacttccaagagaccaggtgaacctcgcagaatgggcccttacatggtaccgcaagggagagctcagcaaaataattgatcctcacattgcaggtcaaatcaggcctgattcacttgagatgtttgctgaggctgctgaaaaatgccttgctgactatggagtcgaccgtccatcaatgggagatgttttgtggaaacttgaatttgccttgcaacttcaagaaaagggtgatgttgttgatggaaccagcagcgggataccaatgaagcacttcaatgactcagtgtatgatgacatggagaaatctagaagtgcagggccacctgttcaaggaagataa

SEQ ID NO: 14917 - protein, 839 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8632597
  misc_feature (510)..(800): SWISSPROT Homolog: EC 2.7.11.1 Non-specific serine/threonine protein kinase
  misc_feature (522)..(793): Pfam ID: Pkinase Pfam Description: Protein kinase domain
MARSMLEWKRVPMFIILSILGITSVTSTNAIASQKGPFVPQDNYLISCGASGSVQLDDGRTFRSDPESVSFLSTPVDIKITANNSPTAASPLSPLYLSARVFSDVSTYSFFVSQPGRHWIRLYFLPIPDKKYNLTSATFSVFTDNMVLLHDFSFIASPLNPILKEYIVVTQGETLKIIFTPKKDSIAFINAIEIVSVPPTLIPNTTNGLPRQEQFDISNNALQVVYRLNMGGALVTAFNDTLGRTWLPDAPFLKLETAAQAAWVPPRTIKYPDDKAVTPLIAPANIYSTAQQTASTNTSQARFNITWEMEAEPGFKYLIRLHFCDIISKALNSLYFNVYINGMMGVSNLDLSSLTMGLAVAYYQDFTVDSSSIINSTLLVQVGPSTTDSSNTDAILNGLEVMKISNQANSLDGLFSPKTSSHLGKRILTGIGLSLAVIAAALVIVMCCRRNQRPEWQKTDSFWFLRLNSNQSSFMNSCSRLSRSRFGSTRTKSGFSSLFASSAYGLGRYFTFAEIQKATKNFEEKDVIGVGGFGKVYLGVLEDGTKLAIKRGNPSSDQGMNEFLTEIQMLSKLRHRHLVSLIGCCDENNEMILVYEFMSNGPLRDHLYGATNLKPLSWKQRLEISIGAAKGLHYLHTGAAQGIIHRDVKTTNILLDENFVAKVADFGLSKAAPSLEQTHVSTAVKGSFGYLDPEYFRRQQLTEKSDVYSFGVVLFEVLCARPAINPALPRDQVNLAEWALTWYRKGELSKIIDPHIAGQIRPDSLEMFAEAAEKCLADYGVDRPSMGDVLWKLEFALQLQEKGDVVDGTSSGIPMKHFNDSVYDDMEKSRSAGPPVQGR

SEQ ID NO: 14918 - DNA, 1275 bp, Sorghum bicolor
  misc_feature: Ceres ANNOT ID no. 8632600
  misc_feature: Encodes the peptide sequence at SEQ ID NO 14919
atggacgaccgccgcgggcgccgcgacgccatgggccagaggccgttcgcgtctgctgctcagggacaggaaagggtgttcgacggtggaggcggtggcggtggcggcggccctgggccagcgtttggcggtgagtttgatcagggatcgtcgtccctcatggctcttctcggagctggtggtgcagtcagctcccagccaccgccgccgacgtggggcgtcgaggaggtgacagcggcgcctgccattaacctggtgcctcaatcattattctccatggcgaactacgcgccaccgccgccgtcctaccagcaacccacctcgttcgccccatcgccgctgggcggcagagtggatccatacccgccgtaccttgtcgcggaccagccgccgcaatggcctcctccccgaccggcggctgctgattcctccatgccgcactccaacttcaccgtcttcttccccaggaatccatacgaccatgacatgcagctgcgagcgaccgcgctcttcggcggcagcagcggcttgcacgcgcacgccctgccgccgccgccgccagccatcgagcagccggcgaaggacggttacagctggcgcaagtacgggcagaagcagctcaaggacgccgagtcgccgcggagctactacaagtgcacccgcgacgggtgccccgtcaagaaggtcgtggagcgctccttcgacgggttcatcaaggagatcacctacaagggccgccacaaccacccgcgcccccaggagcgcggcctcgccggcggcgggaacgatgccctcgccgccgccgaggaggacgtggacggccccagcgacgacgacgacgatgacgtcgacggggctcccggccgggccgcggacggcgttgtggccgggcagagggtggtgaagaagcccaagatcatcctccaaacgccgagcgaggtggatctcctggacgacggctaccggtggcgcaagtacgggcagaaggtggtcaagggcaaccaccggccaaggagctactacaagtgcatcgccgacaagtgcaacgtgcgcaagcagatcgagagggcgtccaccgaccccaggtgcgtcctgacgacgtacaccggccgccacaaccacgacccaccgggccaaggcaacgaagccgccgccgccaccgtcgccgcaggcggctcttctgctgatccgggccctccgtccaggaacacggctagtggaagtggggcgtttcaggagaactggggggctcggcagctgaaggaggagtgctag

SEQ ID NO: 14919 - protein, 424 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: The sequence is a functional homolog of SEQ ID NO 86 in the 10/412,699 US patent application
  misc_feature: Ceres ANNOT ID no. 8632600
  misc_feature (317)..(376): Pfam ID: WRKY Pfam Description: WRKY DNA -binding domain
  misc_feature (193)..(251): Pfam ID: WRKY Pfam Description: WRKY DNA -binding domain
MDDRRGRRDAMGQRPFASAAQGQERVFDGGGGGGGGGPGPAFGGEFDQGSSSLMALLGAGGAVSSQPPPPTWGVEEVTAAPAINLVPQSLFSMANYAPPPPSYQQPTSFAPSPLGGRVDPYPPYLVADQPPQWPPPRPAAADSSMPHSNFTVFFPRNPYDHDMQLRATALFGGSSGLHAHALPPPPPAIEQPAKDGYSWRKYGQKQLKDAESPRSYYKCTRDGCPVKKVVERSFDGFIKEITYKGRHNHPRPQERGLAGGGNDALAAAEEDVDGPSDDDDDDVDGAPGRAADGVVAGQRVVKKPKIILQTPSEVDLLDDGYRWRKYGQKVVKGNHRPRSYYKCIADKCNVRKQIERASTDPRCVLTTYTGRHNHDPPGQGNEAAAATVAAGGSSADPGPPSRNTASGSGAFQENWGARQLKEEC

SEQ ID NO: 14920 - DNA, 996 bp, Sorghum bicolor
  misc_feature: Ceres ANNOT ID no. 8632616
  misc_feature: Encodes the peptide sequence at SEQ ID NO 14921
atggccggcgccgccggcgacagatcggaggacgtcggcgccgactggccattcggtggcggcgccgccgacgccttcacggagtactcgtccgtgttcgcggagctcggctggccgggcggccttctagccagcggggagctcccggtgctggatctgcccgacccagcagcaccgctgccgtcgtcgtcgcagctgctgtccatagagccgtcggaggacccggcgcccgcccggtcgggcgacgccggcgcgtcgtcgagctcgagcggggacggcgacggcgccgcgccgggcaacgacgacgacgatcggaaggcggcgccggccgccgaggcagcgggtaggaagccggcggcggcgacggcgaagaaggggcagaagcggccgcgacagccgcggttcgcgttcatgacaaagagcgagatcgatcacctcgaggacggctacagatggaggaagtatggccagaaagctgtcaagaacagccctttcccaaggagttactacagatgcaccaacagcaaatgcacggtgaagaagcgcgtggagcggtcctccaccgatccctccgtggtcatcaccacctacgagggccagcactgccaccacattggtccattccaacgcggcggcggcggcggcggcggaggcgcagccacggcgcgctaccacagcgcggcggccgtggcactagcggagcaaatgtcttcatcgtcgtcgttcatcccagcgcggcagctctacagcttgccgccgttgcacccaccacagagctccctgtcctcagaagccgtcgttagctcggcggcgactacatcttttcatcagcatgttaacgacggcgacgagctgcggcaggctagctacagctcgagggtgtccatggcgcagtcgccatcaactccatcgtcggtgcctccggccatttcagttgagaaggccgggctactggacgatatggtgccccatggtgtgaggcatggaacaccatga

SEQ ID NO: 14921 - protein, 331 aa, Sorghum bicolor
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: Ceres ANNOT ID no. 8632616
  misc_feature (146)..(205): Pfam ID: WRKY Pfam Description: WRKY DNA -binding domain
MAGAAGDRSEDVGADWPFGGGAADAFTEYSSVFAELGWPGGLLASGELPVLDLPDPAAPLPSSSQLLSIEPSEDPAPARSGDAGASSSSSGDGDGAAPGNDDDDRKAAPAAEAAGRKPAAATAKKGQKRPRQPRFAFMTKSEIDHLEDGYRWRKYGQKAVKNSPFPRSYYRCTNSKCTVKKRVERSSTDPSVVITTYEGQHCHHIGPFQRGGGGGGGGAATARYHSAAAVALAEQMSSSSSFIPARQLYSLPPLHPPQSSLSSEAVVSSAATTSFHQHVNDGDELRQASYSSRVSMAQSPSTPSSVPPAISVEKAGLLDDMVPHGVRHGTP

SEQ ID NO: 14922 - DNA, 1374 bp, Sorghum bicolor
  misc_feature: Ceres ANNOT ID no. 8632618
  misc_feature: Encodes the peptide sequence at SEQ ID NO 14923
atggccgcggctcctcctcctcctcctcctcctccccggcctcgtctcatggtgctgcccttccctgcccagggtcatatcatgccgctcatggagctgtcccaccgcctcgtcgaccatggcttcgaggtcgacttcgtgaacaccgacttcaaccacgcccgcatcctcacggccttggcgacaggaggagacaccggagcagctgtccatgccgggatccacttggtctctttcccggacggcatgggccccgacggcgaccgcgcagacatcgttcggctggctcagggcttgccggcggcgatgctcggccaagttgaagagctgatcagagctcataagattcggtgggtggtggctgatgtctccatgagctgggtgctggacctggccggcacggcaggcgtgcgcgtcgccttgttctcgaccttctcggccgccaccttcgccgtaaggatgcgtattcccaagatggtagaggatggcatcattgacgaaaatgcgaatgtgaagaggaatgagaggatcaagctgagccccaacacgccagccttcgacgccgccgacatcccctgggtcaggcttcgaagccccatgataaagggcatgatcaagaccaaccaaatgttcgcgctcgctgacaccattgtctgcaacacgttccatgccatcgagtccgaggcgctggcgctcctccccaaggcggcactggccatcggccccctcgaggcgccggcatcgaactcagccagccatctctggcccgaagacatggcctgcctcgcctgcctcgacgcccaggcacccagatcagttgtctatgtggcattcgggagctttacagtcttcgacactgcaaggctccaggagctcgccgacgggctggcactcaccggacgcccgttcctgtgggtggtccggccgaactttgccaacggcgtcgatgaaggctggctggaccagttcagacgccgcgttggagacaaggggctagtcgtcggctgggcgccccagcagcgcgtgctctcgcacccttcggtggcatgcttcatctcgcactgtggatggaactccaccatggaaggggtgcgtcacggcgtcccgttcctgtgttggccatactttgccgaccagttcatgaaccagaactacatctgcgacgcgtggggcacgggcttgaggattgacgccgacgagcggggcatcttcaccaaggaggagatcagggacaaggtcgaccagctgctcggcgatgatgggatcagaacgagggcactgtctttgaagagagcagcgtgcgagagtatcacagatggagggtcctcgcatcaggatctgctcaagcttgtaaacctgctgagagaacaataa

SEQ ID NO: 14923 - protein, 457 aa, Sorghum bicolor
  misc_feature: Useful for making plants with altered carbohydrate content
  misc_feature: Functional homolog of the protein sequence given in SEQ ID NO 14100
  misc_feature: Ceres ANNOT ID no. 8632618
  misc_feature (261)..(451): SWISSPROT Homolog: EC 2.4.1.238 Anthocyanin 3'-O-beta-glucosyltransferase
  misc_feature (14)..(457): Pfam ID: UDPGT Pfam Description: UDP-glucoronosyl and UDP-glucosyl transferase
MAAAPPPPPPPPRPRLMVLPFPAQGHIMPLMELSHRLVDHGFEVDFVNTDFNHARILTALATGGDTGAAVHAGIHLVSFPDGMGPDGDRADIVRLAQGLPAAMLGQVEELIRAHKIRWVVADVSMSWVLDLAGTAGVRVALFSTFSAATFAVRMRIPKMVEDGIIDENANVKRNERIKLSPNTPAFDAADIPWVRLRSPMIKGMIKTNQMFALADTIVCNTFHAIESEALALLPKAALAIGPLEAPASNSASHLWPEDMACLACLDAQAPRSVVYVAFGSFTVFDTARLQELADGLALTGRPFLWVVRPNFANGVDEGWLDQFRRRVGDKGLVVGWAPQQRVLSHPSVACFISHCGWNSTMEGVRHGVPFLCWPYFADQFMNQNYICDAWGTGLRIDADERGIFTKEEIRDKVDQLLGDDGIRTRALSLKRAACESITDGGSSHQDLLKLVNLLREQ

SEQ ID NO: 14924 - DNA, 1380 bp, Sorghum bicolor
  misc_feature: Ceres ANNOT ID no. 8632621
  misc_feature: Encodes the peptide sequence at SEQ ID NO 14925
atggcggcgcctcatgtcctggccctgccgttccctgcccaggggcacgtcatccctctgatgcagctctcccaccggctggtcgagaatggcatcgaggtcaccttcgtcaacaccgagctcaaccacgcgctcgtgctagacgcgatgccggctgacggcactggccggtcgctcgacggcatccacctggtgggcgtcccggacgggctggccgacggcgacgaccgcaaggacctcggcaagctcgtcgacgggttctcacggcacatgccgggctacctggaggagcttgtcggtaggactgaggcgtccgggggcacaaagatcagttggctcatcgccgacgaggccatggggtgggcgttcgaggtcgccatgaagctcggcatcagggccgccgccttctggcccgggtcggcggccttcctcgccacaattttgagaattcctcagatgatacaggacggcatcatcgacgagaaagggtggccaaatcggcaggagacattccagttcgcgccggggatgccaccgctccacacgtcgcagctgccgtggaacaactccggcttgccggagggccaaccggccatattccagctcctcacccggaacaacgaggccagagacctcgccgaggtcatcgtctgcaactcgttccgggacgcggaacctgaagcgttcaagctgtaccccgacgtcatgcccatcggccccctgttcgcggaccgtcagttccacaagccggtggggcagttcttgccggaggacaccgggtgcctcgagtggctcgacgcgcaggccgaccgctccgtcgtgtacgtggcgttcggcagcttcaccgtcttcaacccgcggcagttcgaggagcttgcgctggggctggagctcgctggccggccgttcctgtgggtggtgcggccggacttcaccgctgctggcctgagcaaagcgtggctcgacgagttccgggaccgtgtcggcggcaggggcatgatcgtgagctggtgcccccagcagcaggtgctggctcaccgtgcggtggcgtgcttcgtgtcgcactgcgggtggaactcgacgatggaaggggtgaggaacgcggtgccgttcctgtgctggccctacttcacggaccagttccagaacgagagctacatctgcaacgtgtggaggaccggcttggcggtggcgccggggccggacggcgtcgtgacgaaggaggagctgagcggcaaagtggagcgagtccttggagacgacgggatcagggagagggtgagcgcgctcagggatgcggcgtgcaggtccatcgccgagggtgggtcgtcgcgtgacaacttcaagaagtttgtggagctcctgaaactgaaagactaa

SEQ ID NO: 14925 - protein, 459 aa, Sorghum bicolor
  misc_feature: Useful for making plants with altered carbohydrate content
  misc_feature: Functional homolog of the protein sequence given in SEQ ID NO 14101
  misc_feature: Ceres ANNOT ID no. 8632621
  misc_feature (5)..(453): SWISSPROT Homolog: EC 2.4.1.210 Limonoid glucosyltransferase
  misc_feature (4)..(459): Pfam ID: UDPGT Pfam Description: UDP-glucoronosyl and UDP-glucosyl transferase
MAAPHVLALPFPAQGHVIPLMQLSHRLVENGIEVTFVNTELNHALVLDAMPADGTGRSLDGIHLVGVPDGLADGDDRKDLGKLVDGFSRHMPGYLEELVGRTEASGGTKISWLIADEAMGWAFEVAMKLGIRAAAFWPGSAAFLATILRIPQMIQDGIIDEKGWPNRQETFQFAPGMPPLHTSQLPWNNSGLPEGQPAIFQLLTRNNEARDLAEVIVCNSFRDAEPEAFKLYPDVMPIGPLFADRQFHKPVGQFLPEDTGCLEWLDAQADRSVVYVAFGSFTVFNPRQFEELALGLELAGRPFLWVVRPDFTAAGLSKAWLDEFRDRVGGRGMIVSWCPQQQVLAHRAVACFVSHCGWNSTMEGVRNAVPFLCWPYFTDQFQNESYICNVWRTGLAVAPGPDGVVTKEELSGKVERVLGDDGIRERVSALRDAACRSIAEGGSSRDNFKKFVELLKLKD

SEQ ID NO: 14926 - DNA, 735 bp, Sorghum bicolor
  misc_feature: Ceres ANNOT ID no. 8632612
  misc_feature: Encodes the peptide sequence at SEQ ID NO 14927
atggacgtcgatagagccgggggcggggagaggcggccatcggagaaggagctcttccgtgccgcggaatccggcgacgccgccgccttcgcctccctcgcccccgcagacctctccctgcgcaacgaggatggccgctccctcctccacgtcgccgccgctgccggccatccccaggcacgcaaaggggtggtgctcgcgcttgcgcagtgcggtggtgacgccgcggcgaacgtgctgaacgcgaaggatgaagaggggtgggcgccgatccactctgcggcgagctctggcaactcccaaatcatcgacatcctgcttgagcgaggtgctgatgttaacctggtcactgatggtggccgaactgctcttcattatgctgcgagtaaagggaggcttaacatagctgaaaaattaatagccaatggtgctaatgtcaacaagaaagacaagtttggctgcacacctttgcatagagctgcaagcacaggaaatgcagagctgtgtgaattcctcatcgaggaaggcgcggaagttgatgctgttgacaagacaggacaaacacctcttatgcatgctgttatatgtgagaacaaaggggttgctcttctgctaattagacatggcgctgatgttgatgttgaggacaaggaaggctacactgtccttggccgagcatcgaacagcttcagacctgcactgatcgatgcagccaaagcaatgcttgaaggttga

SEQ ID NO: 14927 - protein, 244 aa, Sorghum bicolor
  misc_feature: The sequence is a functional homolog of SEQ ID NO 1841 in the 10/374,780 US patent application
  misc_feature: The sequence is a functional homolog of SEQ ID NO 184 in the 10/225,068 US patent application
  misc_feature: The sequence is a functional homolog of SEQ ID NO 382 in the 10/374,780 US patent application
  misc_feature: The sequence is a functional homolog of SEQ ID NO 972 in the 10/225,066 US patent application
  misc_feature: Ceres ANNOT ID no. 8632612
  misc_feature (42)..(227): SWISSPROT Homolog: EC 2.7.11.1 Non-specific serine/threonine protein kinase
  misc_feature (119)..(151): Pfam ID: Ank Pfam Description: Ankyrin repeat
  misc_feature (152)..(184): Pfam ID: Ank Pfam Description: Ankyrin repeat
  misc_feature (86)..(118): Pfam ID: Ank Pfam Description: Ankyrin repeat
  misc_feature (185)..(217): Pfam ID: Ank Pfam Description: Ankyrin repeat
MDVDRAGGGERRPSEKELFRAAESGDAAAFASLAPADLSLRNEDGRSLLHVAAAAGHPQARKGVVLALAQCGGDAAANVLNAKDEEGWAPIHSAASSGNSQIIDILLERGADVNLVTDGGRTALHYAASKGRLNIAEKLIANGANVNKKDKFGCTPLHRAASTGNAELCEFLIEEGAEVDAVDKTGQTPLMHAVICENKGVALLLIRHGADVDVEDKEGYTVLGRASNSFRPALIDAAKAMLEG

SEQ ID NO: 14928 - DNA, 507 bp, Sorghum bicolor
  misc_feature: Ceres ANNOT ID no. 8632628
  misc_feature: Encodes the peptide sequence at SEQ ID NO 14929
atggccgacgcagctcgtctcttcctgctggtggcggtgaccgccgctctcgccggccgctcagacgccgcgtggtgcgtgtgccgcacggacctggcggacaccgcgctgcagaagacgctggactacgcgtgcggcggcggcgccgactgcaagcccatcctgcagaacggcgcctgcttcgcgccggacaccgtcaaggcgcactgctcctacgccgtcaacagcttctaccagcgcaacaaccagaacccgcaggcctgcgtcttctccggcaccgccacgctctccaacaacgaccccagcggcaatggctgcacgtaccctgcgaccccaagcgccgccgcgacaagctcacccggcgtgtacagccctcccacaatgggtccgtcagccctcaacgacaacagtggtgctgctggcgtcctcccgacggccgccggactggccacacggctggtgatcctagcctgctgctcgctcgtcgctctctacctcggcgcgtga

SEQ ID NO: 14929 - protein, 168 aa, Sorghum bicolor
  misc_feature: Useful for biocontainment applications
  misc_feature: Functional homolog of the protein sequence given in SEQ ID NO 14102
  misc_feature: Ceres ANNOT ID no. 8632628
  misc_feature (25)..(106): SWISSPROT Homolog: EC 3.2.1.39 Glucan endo-1,3-beta-D-glucosidase
  misc_feature (24)..(108): Pfam ID: X8 Pfam Description: X8 domain
MADAARLFLLVAVTAALAGRSDAAWCVCRTDLADTALQKTLDYACGGGADCKPILQNGACFAPDTVKAHCSYAVNSFYQRNNQNPQACVFSGTATLSNNDPSGNGCTYPATPSAAATSSPGVYSPPTMGPSALNDNSGAAGVLPTAAGLATRLVILACCSLVALYLGA

SEQ ID NO: 14930 - DNA, 1377 bp, Sorghum bicolor
  misc_feature: Ceres ANNOT ID no. 8632619
  misc_feature: Encodes the peptide sequence at SEQ ID NO 14931
atggcatcgtctcctcagcggcctcgtgtaatgatgctgccgttggccgcgcagggccatgtcatgcccctcatggagctctcccacctgctcgtcgagcacggattcgaggtcgtcttcgtgaacacggacttcaaccatgcccgcatcatcacggccctggaaggagcggcccctgcccccgtcgggatcgacctgatctccttcccggacggcatggcccccgacggtgaccgcaccgacatcggcaagctgctcgacggcctgccggcggcgatgctcggcggcctcgaggagacgatcaggtccaggaacatcaggtgggtggtggccgacgtgtccatgagcttcgtgctggagctagtccccaaagtgggcgtgcgtgtcgccttgttctccactttctccgccgccaacttcgcgctgaggatgcaccttcccaagatgctagaggatggcatcatcgacgaaacggggaatgtgaaaaggaacgagagggtccagctaaaccccaagatgccggccatcgacgcctccaagcttccatggatcactattggcaagagccccgagtcacggagagccatgatccagagcgccatcacgaccatcccgacactagcgctcgccgaaactattgtctgcaacactttccaggagatcgagtccgtggcgctggcccacctccccataccggcggtcgccatcggcccgctggaggcgcccaagtcgacgtcgtcggcatcggcggcgactggccatttctgggcgcaagacgtaacctgcctccgctggctcgacgcgcaggctcccggctccgtcgtctacgtggcgttcgggagcctcacggtgttcgacgtggaacggctccaggagctggccgacggcctggtgctcaccgggcggccgttcctgtgggtggtccggcccaacttcgcctacggtgtcggcgagggctggatcgacgggttccggcgccgcgtcgccggcaaggggctcatcgtcggctgggctccccagcagcgcgtgctctcgcacccctcggtggcgtgcttcgtgacgcactgcgggtggaactcgaccatggaagcggtgcggcacggcgtcccgctcctctgctggccctacttcgccgaccagttcttcaaccagacctacatctgcgacctgtggggcgttgggctgaaggtctgcgccgacgggaggggaattgtcaccaaggaggagatcagggacaaggtggagcggctgcttggggacgaagagatcaaggcgaggacgctggccttgaagagcgcggcgtgcgccagcgtcgcggatggagggtcctcgcatcaggatctgctcaagttagtgaatttgctaagagaaaattag

SEQ ID NO: 14931 - protein, 458 aa, Sorghum bicolor
  misc_feature: Useful for making plants with altered carbohydrate content
  misc_feature: Functional homolog of the protein sequence given in SEQ ID NO 14100
  misc_feature: Ceres ANNOT ID no. 8632619
  misc_feature (213)..(452): SWISSPROT Homolog: EC 2.4.1.238 Anthocyanin 3'-O-beta-glucosyltransferase
  misc_feature (8)..(456): Pfam ID: UDPGT Pfam Description: UDP-glucoronosyl and UDP-glucosyl transferase
MASSPQRPRVMMLPLAAQGHVMPLMELSHLLVEHGFEVVFVNTDFNHARIITALEGAAPAPVGIDLISFPDGMAPDGDRTDIGKLLDGLPAAMLGGLEETIRSRNIRWVVADVSMSFVLELVPKVGVRVALFSTFSAANFALRMHLPKMLEDGIIDETGNVKRNERVQLNPKMPAIDASKLPWITIGKSPESRRAMIQSAITTIPTLALAETIVCNTFQEIESVALAHLPIPAVAIGPLEAPKSTSSASAATGHFWAQDVTCLRWLDAQAPGSVVYVAFGSLTVFDVERLQELADGLVLTGRPFLWVVRPNFAYGVGEGWIDGFRRRVAGKGLIVGWAPQQRVLSHPSVACFVTHCGWNSTMEAVRHGVPLLCWPYFADQFFNQTYICDLWGVGLKVCADGRGIVTKEEIRDKVERLLGDEEIKARTLALKSAACASVADGGSSHQDLLKLVNLLREN

SEQ ID NO: 14932 - DNA, 621 bp, Sorghum bicolor
  misc_feature: Ceres ANNOT ID no. 8632630
  misc_feature: Encodes the peptide sequence at SEQ ID NO 14933
atggtttccggctccggcgtgtgcgcgaagcgcatcgtggtggacgcgcgccaccacatgctcggacgcctgtcgtcgattatcgccaaggagctgctgaatgggcagaaggtggtcgtcgtccgctgcgaggagatctgcatgtcgggcggcctcgtccgccagaagatgaagtacctccgcttcctccgcaagaggatgaacaccaagccgtctcacggccccattcacttccgtgcccccagcaagatcctgtggcgcaccatccgtgggatgattccgcataagaccaagaggggagaggcggctcttgcaaggctcaagacctacgagggcgtcccgccgccgtacgacaagaccaagcgcgtggtcatccctgacgctcttaaggttctgaggctgcagcctgggcacaagtactgcctcctcggcgagctctctaaggaggtcggatggaactaccatgacaccatcagggagcttgaggagaagaggaaggagaaggccaaggttgcctatgagaggaggaagcaactggccaagctgcgtgtcaaggctgagaagacagccgaggagaagctgggatctcagctggagattcttgccccgatcaaatactga

SEQ ID NO: 14933 - protein, 206 aa, Sorghum bicolor
  misc_feature: Useful for making plants with modulated nitrogen use efficiency
  misc_feature: Functional homolog of the protein sequence given in SEQ ID NO 14103
  misc_feature: Ceres ANNOT ID no. 8632630
  misc_feature (11)..(127): Pfam ID: Ribosomal_L13 Pfam Description: Ribosomal protein L13
MVSGSGVCAKRIVVDARHHMLGRLSSIIAKELLNGQKVVVVRCEEICMSGGLVRQKMKYLRFLRKRMNTKPSHGPIHFRAPSKILWRTIRGMIPHKTKRGEAALARLKTYEGVPPPYDKTKRVVIPDALKVLRLQPGHKYCLLGELSKEVGWNYHDTIRELEEKRKEKAKVAYERRKQLAKLRVKAEKTAEEKLGSQLEILAPIKY

SEQ ID NO: 14934 - DNA, 1377 bp, Sorghum bicolor
  misc_feature: Ceres ANNOT ID no. 8632623
  misc_feature: Encodes the peptide sequence at SEQ ID NO 14935
atggccaaggctcacgtcctggtgctgccgatgccgtgccagggccacgtcacgccgctcatggagctctcccaccgtctggtcgaccaaggcttcgaggtcaccttcgtcaacaccgatgtggaccacgccttggtggtaaccgcgctggacgccaccggcggcggcgtggcggcgctaggcggcggcatccacctggcgtccatcccggacgggctggccgacgacgaggaccgcaaggacatcaacaagctcgtcgacgcctactcgcgccacatgccgggctacctggagagcctcctcgccgacatggaggccgccgggcggcccagggcgaagtggctcgtcggcgacgtcaacatgggctggtcctttgaggtcgccaagaagttcggcatccgggtcgtgtccttctggccggcggcctcggcgtgcttggccttcatgctcaagattcccaacctgatagaggaaggactcataaacgacaaggggttgccagtccggcaggagacgttccagctggccccggggatgccgccgctgcactcgtcgcagctgtcgtggaacaacgccggcgagcccgaggggcagcacatcatcttcgacctggtgaccctgaacaacaagctgaacgagctcgcggagatggtggtgagcaactccttctacgaggcggaggccggcgcgttcaagctcttccccagcatcctgcccatcggcccgctgttcgccgacccggcgttccggaagcccgtggggcacttcctgccggaggacgagaggtgcatcaagtggctggacacgcagccggacgcgtccgtcgtgtacgtggccttcggcagcatcaccatcttcgacccgcgccagttcgaggagctcgccgaggggctggagctcaccggccggccgttcctgtgggtggtgcgcccggacttcacccccggcctcagcaaggcgtggctccacgagttccagcagcgcgtcgctggcaagggcatgatcgtcagctggtgctcacaacaacaggttctggctcaccgcgcggtggcatgcttcgtgtcgcactgcgggtggaactcgaccatggagggggtgaggaacggcgtgccgttcctgtgctggccctacttctgcgaccagtacctgaaccggagctacattatcaacgtgtggaggacgggcctggcggtgacgcccgacgcagacgggatcgtaacgcaggaggagctgaggagcaaggtggagcaggtcgtcggcgacgccgacataaaggacagggcgctggtgttcaaggatgcagcccgccggtgcatcgccgaagggggatcctcgaatgacaacttcaaaaagctcgtcaacctgctcagtgaatga

SEQ ID NO: 14935 - protein, 458 aa, Sorghum bicolor
  misc_feature: Useful for making plants with altered carbohydrate content
  misc_feature: Functional homolog of the protein sequence given in SEQ ID NO 14101
  misc_feature: Ceres ANNOT ID no. 8632623
  misc_feature (5)..(454): SWISSPROT Homolog: EC 2.4.1.210 Limonoid glucosyltransferase
  misc_feature (4)..(457): Pfam ID: UDPGT Pfam Description: UDP-glucoronosyl and UDP-glucosyl transferase
MAKAHVLVLPMPCQGHVTPLMELSHRLVDQGFEVTFVNTDVDHALVVTALDATGGGVAALGGGIHLASIPDGLADDEDRKDINKLVDAYSRHMPGYLESLLADMEAAGRPRAKWLVGDVNMGWSFEVAKKFGIRVVSFWPAASACLAFMLKIPNLIEEGLINDKGLPVRQETFQLAPGMPPLHSSQLSWNNAGEPEGQHIIFDLVTLNNKLNELAEMVVSNSFYEAEAGAFKLFPSILPIGPLFADPAFRKPVGHFLPEDERCIKWLDTQPDASVVYVAFGSITIFDPRQFEELAEGLELTGRPFLWVVRPDFTPGLSKAWLHEFQQRVAGKGMIVSWCSQQQVLAHRAVACFVSHCGWNSTMEGVRNGVPFLCWPYFCDQYLNRSYIINVWRTGLAVTPDADGIVTQEELRSKVEQVVGDADIKDRALVFKDAARRCIAEGGSSNDNFKKLVNLLSE

SEQ ID NO: 14936 - DNA, 1278 bp, Sorghum bicolor
  misc_feature: Ceres ANNOT ID no. 8632641
  misc_feature: Encodes the peptide sequence at SEQ ID NO 14937
atggcgacgggcggcagactggccgtcacttgctccgccgccgtgctgctcgccgtggcgctgctgatctccgcaccggacgccgcagaggcttatgattctctagatccaaacggcaacatcactataaaatgggatgttatgcaatggactcctgatggatatgtcgctgttgtcacaatgtacaattaccaacaatttcggcacattgggccacccggatggcagcttgggtggacatgggcaaagaaggaggttatatggtcaatggttggggctcaggccaccgaacagggtgactgctcaaagttcaagggcaacattcctcacagctgcaagaaagatcccgtgatcgttgatttacttccaagcacaccatatgacatgcaaattgccaattgctgcaaggcaggagttataagtacaattagtcaggatccagcaaatgctgcttcctcatttcagctcagtgtaggtctttctgggtctaccactaagactgtcaaggtgccgaagaacttcacccttaggactcctggccccggttacacctgtgggcgtgctattgttggcaagcctactatatttttctctgcagatggccgcagggcaaccaaagctctaatgacatggaatgtgacctgcacgtattcccaatttcttgctcagaagactccgtcctgctgtgtatctctttcatcgttttataacaacactactgtgaactgcccaacatgctcctgtggctgccagaacccaagtggatcaaactgtgtgaataagggttcgcctcgcctacgatctgctattgatggccctggcaaatggagtggcgagcctcttgtggagtgcacttcccacatgtgccccgtaaaaatcaactggcacgtgaagcagaacagcaaggactactggagagtgaagatcaccatcacaaacctcaacttccgaatgaactacagcgagtggaacctggttgttcagcatccaaacttcgataacatcactcagttgttcggcctcaactacaaaccactcactccatatgggggtgacataaatgacacggcaatgttctggggtgtgaagtcctacaatgatgtgctgatgcaagacggtaagcttgggatggtgcagtcagagctccttctccgtaaagactcccggactttcacattcgaaaagggatgggccttcccacgccgggtgtacttcaatggtgataactgtgtcatgccagctcctgaaaattacccatcgttgccaatgcaagcctag

SEQ ID NO: 14937 - protein, 425 aa, Sorghum bicolor
  misc_feature: Useful for making plants with altered carbohydrate content
  misc_feature: Functional homolog of the protein sequence given in SEQ ID NO 14104
  misc_feature: The sequence is a functional homolog of SEQ ID NO 4 in US patent 7109001
  misc_feature: Useful for making plants with altered cell wall content and/or composition
  misc_feature: Useful for making plants with altered lignin content
  misc_feature: Functional homolog of the protein sequence given in SEQ ID NO 13349
  misc_feature: Ceres ANNOT ID no. 8632641
  misc_feature: Up-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (55)..(219): Pfam ID: Phytochel_synth Pfam Description: Phytochelatin synthetase-like conserved region
MATGGRLAVTCSAAVLLAVALLISAPDAAEAYDSLDPNGNITIKWDVMQWTPDGYVAVVTMYNYQQFRHIGPPGWQLGWTWAKKEVIWSMVGAQATEQGDCSKFKGNIPHSCKKDPVIVDLLPSTPYDMQIANCCKAGVISTISQDPANAASSFQLSVGLSGSTTKTVKVPKNFTLRTPGPGYTCGRAIVGKPTIFFSADGRRATKALMTWNVTCTYSQFLAQKTPSCCVSLSSFYNNTTVNCPTCSCGCQNPSGSNCVNKGSPRLRSAIDGPGKWSGEPLVECTSHMCPVKINWHVKQNSKDYWRVKITITNLNFRMNYSEWNLVVQHPNFDNITQLFGLNYKPLTPYGGDINDTAMFWGVKSYNDVLMQDGKLGMVQSELLLRKDSRTFTFEKGWAFPRRVYFNGDNCVMPAPENYPSLPMQA

SEQ ID NO: 14938 - DNA, 1350 bp, Sorghum bicolor
  misc_feature: Ceres ANNOT ID no. 8632643
  misc_feature: Up-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 14939
atggcggcgggcggcagatccgtcgcgtgctgtgccgccgtgctgctcgcggccgcgctgctcctctccgcaccgactaccacagaggcttatgattcgctggatccaaccggcaacatcactataaaatgggatattatgcagtggactcctgacggatatgtcgctgttgtcacaatgtataattttcaacaatttcggcacatcggcgcacctggttggcagcttgggtggacatgggcaaagaaggaggttatatggtcaatggttggggctcagaccactgaacagggtgactgctcaaagttcaagggcaacaccccccattgctgcaagaaagatccaacaattgtcgatttactaccaggcactccatacaacatgcaaattgccaattgctgcaaggcaggagtcataaatacctttaaccaggacccagcaaatgctgcttcctccttccagatcagtgttggtcttgccggaactaccaataaaactgttaaggtgccaaagaacttcactcttaagactccaggccctgggtacacatgtgggcgtgccattgttggcaggccgacaaagttttggagcgcagatgggcgcagggcaacccaagctctaatgacatggaatgtgacctgcacatattcccaatttcttgctcagaagactccatcctgctgtgtctctctctcatcgttttataatgacacaattgtgaactgcccaacatgctcatgtggctgccagaacccaagtgggtcaaactgtgtgaatgaggattcacctaatctacaagctgcaattgatggtcctggcaaatggactggccagcctcttgtacaatgcacttcccacatgtgcccgataagaatccactggcatgtgaagctcaactacaaggaatactggagagtgaaaatcactatcacaaacttcaacttccgcatgaattacacgcagtggaacttagtagctcagcatccaaactttgataacatcactcagttgttcagcttcaactacaaaccacttactccatatgggggtggcataaatgatacggcaatgttctggggtgtaaaattctacaatgatttgctgatgcaagccggcaaacttggaaatgtgcaatcggaactgcttctccgcaaggactcccggactttcaccttcgataaggggtgggccttcccacgccgggtgtacttcaatggtgataattgtgtcatgccatctcctgaaaattatccatggctgccgaatgcaagccctctaacaagacaaccattgacactcccactcttggtattctgggttgccttggctgctctgttggcttatgcatga

SEQ ID NO: 14939 - protein, 449 aa, Sorghum bicolor
  misc_feature: Useful for making plants with altered carbohydrate content
  misc_feature: Functional homolog of the protein sequence given in SEQ ID NO 14104
  misc_feature: The sequence is a functional homolog of SEQ ID NO 4 in US patent 7109001
  misc_feature: Useful for making plants with altered cell wall content and/or composition
  misc_feature: Useful for making plants with altered lignin content
  misc_feature: Functional homolog of the protein sequence given in SEQ ID NO 13349
  misc_feature: Ceres ANNOT ID no. 8632643
  misc_feature: Up-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (54)..(218): Pfam ID: Phytochel_synth Pfam Description: Phytochelatin synthetase-like conserved region
MAAGGRSVACCAAVLLAAALLLSAPTTTEAYDSLDPTGNITIKWDIMQWTPDGYVAVVTMYNFQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFWSADGRRATQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKEYWRVKITITNFNFRMNYTQWNLVAQHPNFDNITQLFSFNYKPLTPYGGGINDTAMFWGVKFYNDLLMQAGKLGNVQSELLLRKDSRTFTFDKGWAFPRRVYFNGDNCVMPSPENYPWLPNASPLTRQPLTLPLLVFWVALAALLAYA

SEQ ID NO: 14940 - DNA, 3408 bp, Sorghum bicolor
  misc_feature: Ceres ANNOT ID no. 8632660
  misc_feature: Up-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 14941
atgtcgtcgccgttgaacaaccgggggacgtgctcccggagcagctctgcgcggtccaggcacagcgcgcgggtggtggcgcagacgcccgtggacgcgcagctgcacgccgagttcgagagctcccagcgcaacttcgactactcctcgtcggtgagcgccgccatccgaccgtcggtcagcaccagcaccgtctccacctaccaccagaccatgcagcggggcctctacatccagcccttcggctgcctgctcgccgtccacccggacaccttcacgttgctcgcctacagcgagaacgcgcccgagatgctcgacctcacgccacacgcggtccccaccatcgaccagcgggacgcgctcgccgtcggcgccgacgtgcgcacgctcttccgctcgcagagctccgtcgcgctgcacaaggccgccaccttcggggaggtcaacctgctcaaccccatcctcgtgcatgccaggacgtcggggaagcccttctacgccatattgcaccggatcgacgtcggccttgtcatcgaccttgagccggtcaacccagttgacgtgccagtcactgctgcgggtgcgcttaagtcgtacaagctcgccgccaaggccatctccaggctgcagtcgctgcccagcgggaacctgtcgctgctgtgcgatgtgcttgtccgtgaggtgagcgagctcacgggctatgaccgggtcatggcgtacaagttccatgaggatgagcatggtgaggtcatttccgagtgcaggaggtctgatctggagccgtatcttggcctgcactacccagccaccgacatcccgcaggcgtccaggttcttgtttatgaagaacaaagtgaggatgatatgtgattgctctgccactctggtgaagatcattcaggatgatagcctagcacagcctctcagcctctgtggttccaccctcagggcttcccatggttgccatgcacagtacatggcaaacatgggttctgttgcatcgcttgtgatgtcagtgactataagcaatgatgaggaggaagatgttgataccgggagtgaccaacaaccgaaaggcaggaaactgtgggggctggtcgtctgccatcatacaagcccgaggttcgtccctttcccactaaggtacgcttgcgagtttctcttgcaagtatttggcatacagctaaacaaggaggtggaattggctgctcaggcaaaggagaggcacatcctcagaacgcaaacccttctttgtgatatgctcctgcgggatgctcctgttgggatatttacccagtcacctaatgtgatggatctagtaaagtgcgatggagctgcattgtattaccagaaccagcttttgttgctcggatcaacaccctccgagtcagagataaagagcattgccacatggctgcaggagaaccatgatggttcaactgggctgagtactgacagcttagtggaagcaggttatcctggtgctgctgcacttcgtgaagttgtgtgtggcatggcggctataaagatctcttccaaagattttatcttctggttccgatcgcacacaacaaaggagatcaagtggggtggggctaagcatgaaccggttgacgcagatgacaatggcaggaagatgcatccacgatcttcattcaaggccttcttggaggtggttaaatggagaagtgttccctgggaggatgttgaaatggatgctattcattctttgcagttaatattacgtggctccctgcaagatgaagatgccaacagaaacaatgtaaggtccattgtaaaagctccacctgatgatacgaagaagatacaggggctacttgaactaagaacagttacaaacgagatggtccgcttaattgagacagcaaccgcccctgtcttggctgtcgacattgccggtaacataaatggatggaacaataaagctgcagaactaacagggttacctgtaatggaagccatagggaggcctctgatagatcttgttgttgttgattctattgaagtggttaagcggattttggactcagctttacaaggaattgaagagcaaaatctggaaatcaagcttaaagcattccatgaacaggaatgcaatggtccaataatcttgatggttaactcctgctgtagtcgggacctttcagagaaagtcattggagtttgctttgtaggacaagatttgaccacgcagaagatgattatggataagtatactaggatacaaggagactatgttgccatagtaaagaaccccagtgagctcatccctcccatatttatgatcaatgatcttggttcctgcttagagtggaataaagctatgcagaagattaccggtatacagagggaagatgtgatagataagttgttaattggggaggtcttcacccttcatgattatggctgtagggtgaaagatcatgctactctaacgaaacttagcatactgatgaatgcagtgatttctggtcaggatcctgagaagctcctttttggtttcttcgacacagatgggaagtatattgaatccttgctgacagtgaacaagagaataaatgctgagggtaagatcactggcgctatttgctttctgcatgtggccagtccagagcttcagcatgctctccaggtgcagaaaatgtctgaacaagctgccacaaacagttttaaggaattaacttacattcatcaagaattaaggaacccactcaatggcatgcaatttacttgcaacttattggagccttccgaattgacagaggagcagaggaaacttctttcatctaatattctctgtcaggaccagctgaaaaagattttacatgacactgatcttgaaagcattgaacagtgctatatggagatgaacacagtagagttcaaccttgaggaagctcttaatacggtcctaatgcaaggcattcctttgggcaaggaaaagcgaatttctattgaacgtgattggccggtggaaatatcacgcatgtacctttacggggacaatttaaggcttcagcaggtcctagcagactatctggcatgcgcccttcaattcacacaaccagctgaaggacctatcgtgctccaggtcattcccaagaaggaaaacattgggtctggcatgcagattgctcatttggagttcaggattgtccatccagctccaggcgtccccgaggccctgatacaggagatgttccggcacaacccagaggtgtccagggagggcctcggcctgtacatatgccagaagctggtgaaaacgatgagtggcacggtacagtacctacgagaagccgatacctcatcgttcatcatcctgatagagttcccagtcgcccagctcagcagcaagcggtccaagccttcgacgagtaaattctga

SEQ ID NO: 14941 - protein, 1135 aa, Sorghum bicolor
  misc_feature: Useful for making plants with modulated biomass
  misc_feature: Useful for making plants with modulated light quality response
  misc_feature: Useful for making plants with modulated light quality sensitivity
  misc_feature: Functional homolog of the protein sequence given in SEQ ID NO 14105
  misc_feature: Useful for making plants with altered low light response
  misc_feature: Useful for making plants with modulated flowering time
  misc_feature: Functional homolog of the protein sequence given in SEQ ID NO 14106
  misc_feature: Ceres ANNOT ID no. 8632660
  misc_feature (26)..(782): SWISSPROT Homolog: EC 2.7.11.1 Non-specific serine/threonine protein kinase
  misc_feature (410)..(590): Pfam ID: Phytochrome Pfam Description: Phytochrome region
  misc_feature (67)..(183): Pfam ID: PAS_2 Pfam Description: PAS fold
  misc_feature (620)..(735): Pfam ID: PAS Pfam Description: PAS fold
  misc_feature (750)..(875): Pfam ID: PAS Pfam Description: PAS fold
  misc_feature (216)..(399): Pfam ID: GAF Pfam Description: GAF domain
  misc_feature (1007)..(1121): Pfam ID: HATPase_c Pfam Description: Histidine kinase-, DNA gyrase B-, and HSP90-like ATPase
  misc_feature (896)..(959): Pfam ID: HisKA Pfam Description: His Kinase A (phosphoacceptor) domain
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLCDMLLRDAPVGIFTQSPNVMDLVKCDGAALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 14942 - DNA, 465 bp, Sorghum bicolor
  misc_feature: Ceres ANNOT ID no. 8632679
  misc_feature: Encodes the peptide sequence at SEQ ID NO 14943
atgactggactgtcgacggccagcgccgacgagcaaggagaggaaagaatgctgaagcagacagcagtagtagcaagtcaaaggaggccgaagaggcgaacgaaagagaagaggaagatggtggcgccgatggatccgatgctgtggcacaaggtggctgccgtctccgggatcgctgctttggggctcggcacctacggcgcgcacatgttccgccccaagaaccccgcgtacaaagaggtttggcacaccgcgtccctgtaccatctcgtccacaccgccgcgctgctcggggcgcccatcaccaagcgccccaacgtcttcggagggctcctaactgctggaatcgtgctcttttctggaacgtgctacaccgtggcttatcttgaagacaggaagctttcttcaccggcaccattgggtggctttgccttcatagctgcttgggccagcctcctcttctga

SEQ ID NO: 14943 - protein, 154 aa, Sorghum bicolor
  misc_feature: Useful for biocontainment applications
  misc_feature: Useful for making plants with modulated biomass
  misc_feature: Functional homolog of the protein sequence given in SEQ ID NO 14107
  misc_feature: Ceres ANNOT ID no. 8632679
MTGLSTASADEQGEERMLKQTAVVASQRRPKRRTKEKRKMVAPMDPMLWHKVAAVSGIAALGLGTYGAHMFRPKNPAYKEVWHTASLYHLVHTAALLGAPITKRPNVFGGLLTAGIVLFSGTCYTVAYLEDRKLSSPAPLGGFAFIAAWASLLF

SEQ ID NO: 14944 - DNA, 879 bp, Sorghum bicolor
  misc_feature: Ceres ANNOT ID no. 8632698
  misc_feature: Encodes the peptide sequence at SEQ ID NO 14945
atggaggagatggggaagagggtggtgaggacggtgcgggtgcggaacatctcagatctggcgactgagcgggaggtgcgcgagttcttctctttctccggtgaaatcgagcacgtcgacatcagatttgacacagtggcgtcggggaggacggcctacgtcacattcaaagatcccaaggccctcgaaattgcgcttctcctgtcgggagcaacaattgtggaccaaattgtgaacataacccctgctgaagattacatatacatccctgttactgaacagcaacttatggtccatgaggtgacaagtacaagttcagctcctaatgcagaattggagtactcctcagaggccaataccagtcccaatagccgtgtctatgtgagcaaggcccatgatgtcatgacaaatgtgattgcaaagggttcagcaatgagacaagatgctgtgaacaaggctaaagcatttgatgagaagcatcagttgagggctaatgcatcagcgaggatcaattcctttgataagcgtgttggcctttcggagaagataaacaatgggttgtcagttgtcaatgaaaaggtgaaatcagtagaccaaagattgcaggtttctgataaaacaatggctgctttgctggctgcagagcgcaagctaaatgatacaggctctgctgtgaaaaccaacaggtatgtgtctgctggaacaagctggctgaatggtgcttttagcaaggtcgccaaggctggtcatgttgctggctcaagaaccagagaaaagttccagttagctgtgtcgaatctaacagccaaatggaagtttatatgttgtctacatatggcacgtacatatggtggtgtcgtgttgattcaatccaagtga

SEQ ID NO: 14945 - protein, 292 aa, Sorghum bicolor
  misc_feature: Useful for making plants with modulated biomass
  misc_feature: Functional homolog of the protein sequence given in SEQ ID NO 13029
  misc_feature: Ceres ANNOT ID no. 8632698
  misc_feature (12)..(80): Pfam ID: RRM_1 Pfam Description: RNA recognition motif. (a.k.a. RRM, RBD, or RNP domain)
MEEMGKRVVRTVRVRNISDLATEREVREFFSFSGEIEHVDIRFDTVASGRTAYVTFKDPKALEIALLLSGATIVDQIVNITPAEDYIYIPVTEQQLMVHEVTSTSSAPNAELEYSSEANTSPNSRVYVSKAHDVMTNVIAKGSAMRQDAVNKAKAFDEKHQLRANASARINSFDKRVGLSEKINNGLSVVNEKVKSVDQRLQVSDKTMAALLAAERKLNDTGSAVKTNRYVSAGTSWLNGAFSKVAKAGHVAGSRTREKFQLAVSNLTAKWKFICCLHMARTYGGVVLIQSK

SEQ ID NO: 14946 - DNA, 2247 bp, Sorghum bicolor
  misc_feature: Ceres ANNOT ID no. 8632707
  misc_feature: Encodes the peptide sequence at SEQ ID NO 14947
atgacggtggagaagtccagtggcggcacgtcaacttcctccaccatggaccgtttccaaaagattgtcctaagctgggattacctccgcctcgtcaccgaatccaagggcggcaagcaggccaaggtgctgcagcgtgtgaagaacacgtacgactcggtggctgagtacctcggtgtctttgagccactgctcttcgaggaggtcaaggcgcagatcatccagggacgcagtgatgaggaggaagaatctgggatggactggcggaggggcgcagtgggatcttgcacagagtctgaggggttccacaagctctctgtggcggtggaagacagttttcaggataatgtgtcagagaatgacctactgcttctctccaaggagaaatttgaggagggatcgacccctaatgcatacgcctttgcattggtggaacagcgtggtggtggcttacatatttcgcttagaacttttgtggcaggtgaaattgtaaatctgaatgttgcaaagcctgtgaagtctacaaggctgcaacattttgcttccaccattgcaagtcaaaacagcttgctgtggatattgaaggtctgcagcttgtctacaataatgcgggagttcacagctatgcattctgtagcttctataccttttaaggatttgattctttcagctactgagaagcacaaggatggtgacgatcaaagtcgtgcgtggaatgttccggagccacttatggattacctcaaaactaatcttaataactcccagctagaagcagtcaatgcaggtctttcacgcagatcctttgttcttatccaggcatctccttggttacttggtgcaaatcctcgagatttgattatgcctgttgatggtgatgatggattttacccaacaggaaatgaactgaaacctgaagtcgtaagttccaatcgcaagtatcgggcccatgtgttggtctgtgctccatccaactcagcacttgatgagatcgtgttgcgtgttcttaagacaggaatccgagatgaaaataacaacacttacaaccctaaaattgtgcgcattggagtgaaggcccttcattctgttaaagcagtttccatggattaccttattcaacaaaaactttctggtgtagatcgcacattagatggtgggagacgaggtgctggtgaatatgatcgtattagagcttcaatactggacgaagcagccattgtattttctactctgagtttcagtggatcctcaattttcagcaggatgtcccgtgcttttgatgttgttataattgatgaagctgcacaagcggttggtgacccagttcagttgcctgcaactgtcatttcacagactgctcagaagttgggatatggaacaagcttgttcaaaagatttcaagctgctggctttccggtgcaaatgcttaaaatccaatatcgcatgcatccagagattagtatgttcccttcaaaagaattttatgaaggtgtactacaagatggggagggtctcagcaggaaacgtccatggcattcctacagctgctttggaccattttgtttctttgatgttgatggcattgaatcccagccatctggaagtggttcttgggtaaaccaggatgaagtggaattcataactctcctgtatcaccaattggcaatgcgctatccagaactcaaatctagtcctgaagtgggtgttatatcaccatacaggcatcaagtaaaactattgaaggacagttttcgatcaacctttggggatcaatcaaaggaattgatagatgtaagcaccgttgatggatttcagggacgcgaaaaagaaatagtaattttttcatgtgtaagatgcaatgaggagcaaaagattggctttgtttctgattttcgacgaatgaatgttgccatcacaagagcaaaatctgctgtactggttgtaggttctgcttcaacattgaagcaagataaacactggaacaaccttgtcgagagtgccaaggaacgaaatcgcttcttcaaggtcccgaagccattcaccacattctttggagaggataacctgaaggctatgaaggttgaaaagtatcttctgccagtgccgaatgctcaagtactggaagaaatcaatcaagaagttgtaaggcaggagctcatgaatgtcgacgatgctgccgaccatgcagatgcaggggatgacgatgatgctgctatggatgctgacgatggaggtggcgatgattga

SEQ ID NO: 14947 - protein, 748 aa, Sorghum bicolor
  misc_feature: Useful for making plants with modulated salt sensitivity
  misc_feature: Functional homolog of the protein sequence given in SEQ ID NO 13507
  misc_feature: Ceres ANNOT ID no. 8632707
MTVEKSSGGTSTSSTMDRFQKIVLSWDYLRLVTESKGGKQAKVLQRVKNTYDSVAEYLGVFEPLLFEEVKAQIIQGRSDEEEESGMDWRRGAVGSCTESEGFHKLSVAVEDSFQDNVSENDLLLLSKEKFEEGSTPNAYAFALVEQRGGGLHISLRTFVAGEIVNLNVAKPVKSTRLQHFASTIASQNSLLWILKVCSLSTIMREFTAMHSVASIPFKDLILSATEKHKDGDDQSRAWNVPEPLMDYLKTNLNNSQLEAVNAGLSRRSFVLIQASPWLLGANPRDLIMPVDGDDGFYPTGNELKPEVVSSNRKYRAHVLVCAPSNSALDEIVLRVLKTGIRDENNNTYNPKIVRIGVKALHSVKAVSMDYLIQQKLSGVDRTLDGGRRGAGEYDRIRASILDEAAIVFSTLSFSGSSIFSRMSRAFDVVIIDEAAQAVGDPVQLPATVISQTAQKLGYGTSLFKRFQAAGFPVQMLKIQYRMHPEISMFPSKEFYEGVLQDGEGLSRKRPWHSYSCFGPFCFFDVDGIESQPSGSGSWVNQDEVEFITLLYHQLAMRYPELKSSPEVGVISPYRHQVKLLKDSFRSTFGDQSKELIDVSTVDGFQGREKEIVIFSCVRCNEEQKIGFVSDFRRMNVAITRAKSAVLVVGSASTLKQDKHWNNLVESAKERNRFFKVPKPFTTFFGEDNLKAMKVEKYLLPVPNAQVLEEINQEVVRQELMNVDDAADHADAGDDDDAAMDADDGGGDD

SEQ ID NO: 14948 - DNA, 129 bp, Sorghum bicolor
  misc_feature: Ceres ANNOT ID no. 8632727
  misc_feature: Encodes the peptide sequence at SEQ ID NO 14949
atggctgaaatttcatcgtcagatgattgtggtgaccgttctcattcagatactataagagctatttgcttcagtgtgagtggagctttgtttgcatccgctggtccgctggtgatgacaaacttgtga

SEQ ID NO: 14949 - protein, 42 aa, Sorghum bicolor
  misc_feature: Useful for making plants with altered protein content
  misc_feature: Functional homolog of the protein sequence given in SEQ ID NO 13459
  misc_feature: Ceres ANNOT ID no. 8632727
MAEISSSDDCGDRSHSDTIRAICFSVSGALFASAGPLVMTNL

SEQ ID NO: 14950 - DNA, 1116 bp, Sorghum bicolor
  misc_feature: Ceres ANNOT ID no. 8632744
  misc_feature: Encodes the peptide sequence at SEQ ID NO 14951
atggatcccttccacggcggcattgtgaaggaggaggagttcgacttcgacttcgacttcaccggcgtttctgcgggggacgcggcggtggcggcggcggcgtcctcgtgggccgtcgccttgccggagctgccccggccgatggaaggactcggcgaggtgggccccaccccattcctgaccaagacctacgacgtcgtggacgaccccaataccgacaccgtcgtctcctgggggttcgccggcaacagcttcgtggtctgggacgctaacgccttcgccacggtgatcctcccgcgctacttcaagcatagcaacttctccagcttcgtccgccagctcaacacctacgggttcaggaaggttgacccggacaggtgggagttcgcgaacgaggggttccagcgtggccagaaggagctcctgagaacgatcaagcgccggcgcccgccgtcgagcccgtcggcgcagcaggggcaggcgccatcgtcgtgtctggagatgggacgattcgggctcgacggcgaggtgcaccggctgcagcgcgacaagcgcatcctgctcgcggaggtggtgaagctgcggcaggagcagcaggcgacgcgcgcgcagatgcaggccatggaggagcgcatcaccacggcggagcagaagcagctgcagatgacggtgttcctggcgcgcgccttgaagaacccgagcttcatccggatgctggtcgaccggcagggccttggtggccgccgtagggagctcgaggacgcgctctccaagaagcgccgccgccccatcgagtaccacctcccgcccgacggcgagagcagcggcaccgctacggaggcggcggtgaacgactacatttgcggccttccggtcggcgttaatggcgtggcggaggcggacgacgacgggagccggctggaggggagcggcggcggcggggacacggagagcttctgggtggagttgctcagcctcggcctggaggagaagcacctggagggcggcggcggcagcgaggaggggagcggagctgacgtggacgacgacgtggatgtgctggtgcagagcatctaccacttgaacccgaacccgggcagccccagtgggaagtga

SEQ ID NO: 14951 - protein, 371 aa, Sorghum bicolor
  misc_feature: The sequence is a functional homolog of SEQ ID NO 1686 in the 10/412,699 US patent application
  misc_feature: The sequence is a functional homolog of SEQ ID NO 1687 in the 10/412,699 US patent application
  misc_feature: The sequence is a functional homolog of SEQ ID NO 1685 in the 10/412,699 US patent application
  misc_feature: Useful for making plants with modulated heat sensitivity
  misc_feature: Functional homolog of the protein sequence given in SEQ ID NO 13699
  misc_feature: Ceres ANNOT ID no. 8632744
  misc_feature (57)..(226): Pfam ID: HSF_DNA-bind Pfam Description: HSF-type DNA-binding
MDPFHGGIVKEEEFDFDFDFTGVSAGDAAVAAAASSWAVALPELPRPMEGLGEVGPTPFLTKTYDVVDDPNTDTVVSWGFAGNSFVVWDANAFATVILPRYFKHSNFSSFVRQLNTYGFRKVDPDRWEFANEGFQRGQKELLRTIKRRRPPSSPSAQQGQAPSSCLEMGRFGLDGEVHRLQRDKRILLAEVVKLRQEQQATRAQMQAMEERITTAEQKQLQMTVFLARALKNPSFIRMLVDRQGLGGRRRELEDALSKKRRRPIEYHLPPDGESSGTATEAAVNDYICGLPVGVNGVAEADDDGSRLEGSGGGGDTESFWVELLSLGLEEKHLEGGGGSEEGSGADVDDDVDVLVQSIYHLNPNPGSPSGK

SEQ ID NO: 14952 - DNA, 1467 bp, Sorghum bicolor
  misc_feature: Ceres ANNOT ID no. 8632759
  misc_feature: Encodes the peptide sequence at SEQ ID NO 14953
atggcgacgcaggctgctttcctcgcggggttatcgcagctcgccgcacagccgggccgggaccgcgccgtggcgccggcgcgggtggccgtggcggcggtgggtgtgggtagcgccaaggtgggtgtgcgggtgggcgtgaaggcggggaccgccgaggccaaagcggtggcgcagcgccgcggggtgcggtgccgggccagcctgatcgagcccgacggcgggcggctggtggacctggtggcgcccgaggagggcgggcggcgcgcggcgctgcggcgggaggcggccgagctgccgcaccgcctgcgcctcagccgcgtcgacaaggaatgggtccacgtcctcagcgaagggtgggcgagcccgctgcaagggttcatgcgcgagcatgagttcctccaagcacttcatttcaatgccatccgcggcgcggatggcaggatggtcaacatgtccgtccccatcgtgctctcccttggggacgcacagcggagggccatccaggccgacggcgccacgcgcgtcgcgctcgtcgaccaacgcgaccgccccatcgccgtcctcagcgacatcgagatctataagcataataaggaagaaagaatagcaaggacatgggggacaactgcacctggattaccttatgtcgaggaggcaattaccaatgctggtgactggttgattggtggggacttggaggttatagaaccaatcaagtacaatgatggtctagatcagtatcgcctgtctccagcacagctgcgtgaagagtttgccaggcgcaatgctgatgcggtatttgcctttcagcttcgcaatcctgtacacaatgggcatgctctgcttatgaccgacacacgtaaacgcctccttgagatgggttataaaaatcctgttcttctgctccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaaccgaggttcagtggcatgctaaggctcgtattaatgctggcgcaaatttctatattgttggaagggatcctgctggtatgagccatcccacagagaaaagggacctctatgatgcggatcatggaaagaaggttttgagcatggctcctggtcttgagaggctcaacatccttccattcaaggtggctgcatatgacacaaagcaaaagaaaatggatttctttgatccatcaaggaaagatgatttcctcttcatctctggcacaaagatgcgcactcttgccaagaaccgcgagaatcccccagatggttttatgtgcccgggtggctggaaagtactcgttgaatactatgacagcttggtgccatctgagggcagcagcaagctgcgagaaccagttgcagcctaa

SEQ ID NO: 14953 - protein, 488 aa, Sorghum bicolor
  misc_feature: The sequence is a functional homolog of SEQ ID NO 4 in US patent 7038109
  misc_feature: Ceres ANNOT ID no. 8632759
  misc_feature: Up-regulated in shoot tissues in response to methyl jasmonate treatment
  misc_feature: Down-regulated in root tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature (113)..(470): SWISSPROT Homolog: EC 2.7.7.4 Sulfate adenylyltransferase
  misc_feature (142)..(474): Pfam ID: ATP-sulfurylase Pfam Description: ATP-sulfurylase
MATQAAFLAGLSQLAAQPGRDRAVAPARVAVAAVGVGSAKVGVRVGVKAGTAEAKAVAQRRGVRCRASLIEPDGGRLVDLVAPEEGGRRAALRREAAELPHRLRLSRVDKEWVHVLSEGWASPLQGFMREHEFLQALHFNAIRGADGRMVNMSVPIVLSLGDAQRRAIQADGATRVALVDQRDRPIAVLSDIEIYKHNKEERIARTWGTTAPGLPYVEEAITNAGDWLIGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRENPPDGFMCPGGWKVLVEYYDSLVPSEGSSKLREPVAA

SEQ ID NO: 14954 - DNA, 807 bp, Sorghum bicolor
  misc_feature: Ceres ANNOT ID no. 8632757
  misc_feature: Up-regulated in shoot tissues in response to methyl jasmonate treatment
  misc_feature: Down-regulated in root tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 14955
atgagggcgctacccgtcgcccacaagctcgctctgacggccccgttgctcccgtgccaccgccggcccgcggctcacggccggcgccggcggtacggagccgtggtggcgtacatggagccgaaccccaactcgccgggggccatcgcggggcggctcatcggcgccctccccatcgtgggcctcgtcgcgcgcatcctcagcgacgagggcggcgtcggcggcgacatcatcgacttcgccgagttccgccgccgcgtcagcaagaagtgcaccgtcatggactccaaggccttctacgacttcaaccagcgccgcgggaagccaggagatcccttctacgttctgctctgctgctggctggccgccattggcgccgggctgctcaaaacagaggagatcttggaaggcgtggcgcgtctccgcatctccaacgatatcgagttcgaggaggagacgttcatcgacatgatgagggcggcaagggagaaaagggcgaagctgaaggctccagcaccgcagataccgatggaaacgcgggcggagaaggcgctcgaagccatctacgtgtgctgcttcgggcaggacatggtggaggaagaggacgagaagctgctccggacgatcctgaacgcggtcttcccttccgtcgggaggccggcggtggagaggatggtggcgtccatggccaagcaggtggcctccggcgagaggaagcgggacgggaggaccgtgtccaaggaagtgcagcagcggcagctcaaggacctggagtttctgaagcagaataagctggagtcatcgtga

SEQ ID NO: 14955 - protein, 268 aa, Sorghum bicolor
  misc_feature: Useful for making plants with altered cell wall content and/or composition
  misc_feature: Functional homolog of the protein sequence given in SEQ ID NO 14108
  misc_feature: Ceres ANNOT ID no. 8632757
MRALPVAHKLALTAPLLPCHRRPAAHGRRRRYGAVVAYMEPNPNSPGAIAGRLIGALPIVGLVARILSDEGGVGGDIIDFAEFRRRVSKKCTVMDSKAFYDFNQRRGKPGDPFYVLLCCWLAAIGAGLLKTEEILEGVARLRISNDIEFEEETFIDMMRAAREKRAKLKAPAPQIPMETRAEKALEAIYVCCFGQDMVEEEDEKLLRTILNAVFPSVGRPAVERMVASMAKQVASGERKRDGRTVSKEVQQRQLKDLEFLKQNKLESS

SEQ ID NO: 14956 - DNA, 708 bp, Sorghum bicolor
  misc_feature: Ceres ANNOT ID no. 8632766
  misc_feature: Encodes the peptide sequence at SEQ ID NO 14957
atggctggcgccgacgtcgacgtcgggacggagctccggctcggcctgccgggaggaggcgccgaggcggccaaggccgcgaagaggggcttcgaggacaccatcgacctcaagctgaagctgcccaccgccggcatggaggaagctgccgccgccaagccggagccggcagccgagaaggccaagaggcccgccgaggcgccggcagctgatgccgagaagccacctgcacccaaggcacaagctgtgggttggccaccagtccgatcataccgcaggaacgtcatgaccgtccagtctgtgaagagcaagaaggaagaggaacctgagaagcagcagtcggccgctgccaacgccagcggcaacagctccgccttcgtgaaggtcagcatggacggcgcgccctacctgcgcaaggtggacctgaagatgtacaacagctacaaggacctctctattgctctgaagaagatgttcagcaccttcaccacatctgggaacaacatgaatgaggggaaattggttgatccagtcagcggtgctgatgtggtcactacttacgaagacaaggacggcgactggatgcttgttggtgacgtcccatgggagatgtttgtcgagtcatgcaagcgtctgaggatcatgaagagttctgaagccataggtcttgcaccaagaacgaaggacaagtgcaagaacaagagctga

SEQ ID NO: 14957 - protein, 235 aa, Sorghum bicolor
  misc_feature: The sequence is a functional homolog of SEQ ID NO 739 in the 10/374,780 US patent application
  misc_feature: The sequence is a functional homolog of SEQ ID NO 2006 in the 10/374,780 US patent application
  misc_feature: The sequence is a functional homolog of SEQ ID NO 288 in the 10/412,699 US patent application
  misc_feature: The sequence is a functional homolog of SEQ ID NO 664 in the 11/479,226 US patent application
  misc_feature: Useful for making plants with modulated nitrogen use efficiency
  misc_feature: Functional homolog of the protein sequence given in SEQ ID NO 13612
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: Useful for making plants with altered terpenoid content
  misc_feature: Functional homolog of the protein sequence given in SEQ ID NO 13610
  misc_feature: Useful for making plants with altered alkaloid content
  misc_feature: Functional homolog of the protein sequence given in SEQ ID NO 13611
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: The sequence is a functional homolog of SEQ ID NO 890 in the 10/412,699 US patent application
  misc_feature: The sequence is a functional homolog of SEQ ID NO 738 in the 10/374,780 US patent application
  misc_feature: The sequence is a functional homolog of SEQ ID NO 736 in the 10/374,780 US patent application
  misc_feature: The sequence is a functional homolog of SEQ ID NO 652 in the 11/479,226 US patent application
  misc_feature: The sequence is a functional homolog of SEQ ID NO 656 in the 11/479,226 US patent application
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 667 in the 11/479,226 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: Ceres ANNOT ID no. 8632766
  misc_feature (10)..(227): Pfam ID: AUX_IAA Pfam Description: AUX/IAA family
MAGADVDVGTELRLGLPGGGAEAAKAAKRGFEDTIDLKLKLPTAGMEEAAAAKPEPAAEKAKRPAEAPAADAEKPPAPKAQAVGWPPVRSYRRNVMTVQSVKSKKEEEPEKQQSAAANASGNSSAFVKVSMDGAPYLRKVDLKMYNSYKDLSIALKKMFSTFTTSGNNMNEGKLVDPVSGADVVTTYEDKDGDWMLVGDVPWEMFVESCKRLRIMKSSEAIGLAPRTKDKCKNKS

SEQ ID NO: 14958 - DNA, 1536 bp, Sorghum bicolor
  misc_feature: Ceres ANNOT ID no. 8632808
  misc_feature: Encodes the peptide sequence at SEQ ID NO 14959
atggcgacggccctccgcaagctctccgccaacgcgctgcgccgccagccgctctcccgcatgacgccgctccactacatggcgtcccttccggcgacagaggagagatccggaatcacctggccgaagcagctgaacgcgccgctcgaagaggtcgaccccgagatttttgacattatcgagcacgagaaggcccgccaatggaaggggctggagctcatcccgtcagagaatttcacgtcggtgtcagtgatgcaggcagttggttccgtcatgaccaacaagtacagcgaggggtaccctggcgcaagatactacggtggaaatgaatttattgatatggctgaatccttgtgtcagaaacgtgctttggaggctttccgtttggacccagcgaagtggggagtgaatgtgcaacctctatccggttcgcctgccaatttccaagtatacactgcgctcttgaagccacatgaaaggataatggctttggatcttcctcacggtggacatctttctcatggttaccagactgacactaagaagatatctgcaacctcgatattctttgagacaatgccttacagattggatgaaagcactggattgattgattatgatcagttggagaaaagcgctattcttttcaggccaaagttgatagttgctggtgctagtgcatatgctcggctatacgattatgaccgtatgcggaagatatgcaacaagcagaaggcagtacttctagcagacatggcacatatcagtgggcttgttgcagctggtgttattccatctccttttgattatgcagatgtagtgactaccactactcacaaatcactccgtgggccacgtggagccatgatcttttataggaaggggttgaaagaaataaataagcaagggaaagaggttatgtatgattttgaggacaagatcaatgctgccgtctttcctggtctgcaaggtgggcctcataatcataccattactggcttggctgttgcgcttaaacaggcaactactccagagtacagagcttaccaagagcaagttatcactaactgtgctaaatttgcgcagagcctgactgcaaaaggatatgaactcgtctccggtgggactgacaaccatttagttctggtgaatctcaagaataaggggatagatggttcgagggtggagaaggttttagaaagcgtgcatattgcagcaaacaagaacacagttcctggtgatgtttcggctatggtaccaggaggcatcaggatgggaaccccagctcttacgtccagaggatttgttgaggaagatttcgctaaggttgctgacttcttcgatgcagcagtgaatctggctgtgaagattaaggctgcaacgacaggtggaacaaagctgaaggactttgttgctactttgcaatctgatagcatccaagctgagattgcaaagcttcgccatgatgtggaggaatatgcaaaacagttcccaacaattggatttgagaaggagaccatgaaatacaagaactga

SEQ ID NO: 14959 - protein, 511 aa, Sorghum bicolor
  misc_feature: Useful for making plants with modulated nitrogen use efficiency
  misc_feature: Functional homolog of the protein sequence given in SEQ ID NO 13702
  misc_feature: Ceres ANNOT ID no. 8632808
  misc_feature: Down-regulated in shoot tissues in response to salicylic acid treatment
  misc_feature (1)..(511): SWISSPROT Homolog: EC 2.1.2.1 Glycine hydroxymethyltransferase
  misc_feature (49)..(447): Pfam ID: SHMT Pfam Description: Serine hydroxymethyltransferase
MATALRKLSANALRRQPLSRMTPLHYMASLPATEERSGITWPKQLNAPLEEVDPEIFDIIEHEKARQWKGLELIPSENFTSVSVMQAVGSVMTNKYSEGYPGARYYGGNEFIDMAESLCQKRALEAFRLDPAKWGVNVQPLSGSPANFQVYTALLKPHERIMALDLPHGGHLSHGYQTDTKKISATSIFFETMPYRLDESTGLIDYDQLEKSAILFRPKLIVAGASAYARLYDYDRMRKICNKQKAVLLADMAHISGLVAAGVIPSPFDYADVVTTTTHKSLRGPRGAMIFYRKGLKEINKQGKEVMYDFEDKINAAVFPGLQGGPHNHTITGLAVALKQATTPEYRAYQEQVITNCAKFAQSLTAKGYELVSGGTDNHLVLVNLKNKGIDGSRVEKVLESVHIAANKNTVPGDVSAMVPGGIRMGTPALTSRGFVEEDFAKVADFFDAAVNLAVKIKAATTGGTKLKDFVATLQSDSIQAEIAKLRHDVEEYAKQFPTIGFEKETMKYKN

SEQ ID NO: 14960 - DNA, 1140 bp, Sorghum bicolor
  misc_feature: Ceres ANNOT ID no. 8632811
  misc_feature: Down-regulated in shoot tissues in response to salicylic acid treatment
  misc_feature: Encodes the peptide sequence at SEQ ID NO 14961
atggcgaccgcggggaaggtgatcaagtgcaaagctgcggtggcatgggaggccggcaagccgctgtcgatcgaggaggtggaggtagcgcctccgcaggctatggaggtgcgcgtcaagatcctcttcacctcgctctgccacaccgacgtctacttctgggaggccaaggggcagactccggtgttccctcggatcttcggtcatgaggctggaggtatcatagagagtgttggagagggtgtgactgacgtagctcccggtgaccatgtccttcctgtgttcactggggagtgcaaggagtgcgcccactgcagatcggcagagagcaacatgtgtgatctgctcaggatcaacactgaccggggtgtgatgattggcgatggcaagtcacggttttcaatcaatggaaagcctatctaccattttgttgggacttcaaccttcagcgagtacactgtcatgcatgttggttgtgttgcaaagatcaaccctgaggctccccttgataaagtttgtgttcttagttgtggtatttctactggtcttggtgcatcaattaatgttgcaaaaccaccaaagggttctacagtggctattttcggtctaggagcagttggtcttgccgctgcagaaggtgcaaggattgctggagcatcaaggatcattggtgttgacctgaaccccagcagattcgaagaagctaggaagtttggttgtactgaatttctgaacccaaaagaccacaagaagcccgtgcaggaggtacttgctgagatgaccaacggaggggttgaccgcagtgtggaatgcactggcaacatcaatgctatgatccaagcatttgaatgtgttcacgatggctggggtgttgctgtgctagtgggtgtgccacacaaggatgctgagttcaagacccacccaatgaacttcctgaacgagaggaccctgaagggaaccttctttggcaacttcaaaccacgcactgatctgccaaatgtggtggagctgtacatgaaaaaggagctggaggtggagaagttcatcacacacagcgttccgttcacggagatcaacaaggccttcgacctgatggctaagggagaaggcatccgctgcatcatccgcatggagaactag

SEQ ID NO: 14961 - protein, 379 aa, Sorghum bicolor
  misc_feature: Useful for making plants with modulated heat sensitivity
  misc_feature: Functional homolog of the protein sequence given in SEQ ID NO 14109
  misc_feature: Ceres ANNOT ID no. 8632811
  misc_feature: Up-regulated in root tissues in response to methyl jasmonate treatment
  misc_feature (1)..(379): SWISSPROT Homolog: EC 1.1.1.1 Alcohol dehydrogenase
  misc_feature (194)..(336): Pfam ID: ADH_zinc_N Pfam Description: Zinc-binding dehydrogenase
  misc_feature (34)..(163): Pfam ID: ADH_N Pfam Description: Alcohol dehydrogenase GroES-like domain
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFTEINKAFDLMAKGEGIRCIIRMEN

SEQ ID NO: 14962 - DNA, 1866 bp, Sorghum bicolor
  misc_feature: Ceres ANNOT ID no. 8632829
  misc_feature: Up-regulated in root tissues in response to methyl jasmonate treatment
  misc_feature: Encodes the peptide sequence at SEQ ID NO 14963
atgttcgggagggacccctggggcgggccgctggagatctccaacgccgactcggcgacggatgacgaccggagccgggacctggacagggcggcgctgatgcggcagctggacgagacgcagcagagctggctcctggcggggcccggcgaccaggccggcaagaagaagaagaagtacgtcgacctgggatgcgtcgtcgtcgaccgcaagatcttcatgtggaccgtcggcaccatcctcggcctcggcgtcttcatcggattcatcatgatgatcgtcaagctcgtcccgcacaagcggcccccgccgccgccccccgaccagtacacgcaggcgctgcacaaggcgctcatgttcttcaacgcgcagcgatccggtccgttgccaaagcacaatggcgtcagctggaggggcaattcctgcatgaaggatggcctctccgacagcaccgtccgccggagcttggttgggggctactacgatgcaggggacgccatcaagttcaactatcccatggcctggtccatgaccatgctcagctggagtgtgatcgagtacagggctaagtatgaggccatcggtgagctcgaccatatcaaggagctgatcaagtggggaacagactacatcctcaaaacattcaattcatctgccgacacgatagacaggattgtcgctcaggtgggtgtaggtgacacctctaaaggtggcagtcagcctaatgaccattactgctggatgagaccagaggacatcgattacaaaaggccagtcactgagtgtcactcttgctcagatctagcatctgaaatggctgccgccctggctgcagcttccatagtgttcaaggacagcaaaacctactctgacaagctcgtcaaaggtgcaaaagctctgtacaaatttggcaggctgcagcgcgggcgatacagccccaatggatccgatcaggcaattttctacaattccaccagctactgggatgagtttgtgtggggtggtgcgtggatgtacttcgccacagggaacaattcatatctcacagtcgccacagccccaggaatggcaaagcatgctggagcctattggtttggaagtccaaactatggagtatttacctgggatgacaaacttccaggagctcaggtccttctcagcaggctgcgactcttcctaagtccagggtacccttacgaagaaatactgaggacattccacaaccaaactgacaacgttatgtgctcgtatttacctctattcaattcattcaacttcactaaaggaggattaatacaactcaaccatggaaggcctcaaccacttcagtatgctgtcaatgcagctttccttgcttctttatacagtgattatcttgaagctgcagacacgcctgggtggtactgtggacctaatttctacaccacagaagtcctccgcaagtttgccaggtcacagcttgattacatccttggaaagaacccattaaagatgagctacgttgtgggttttggaaacaagtacccgaagcgccctcatcacagaggtgcatcaatacctcataatggcgtcaagtatggatgcaaaggaggttacaaatggagggatacaaaaaaggcaaaccctaatatccttgttggagcaatggtggctggccctgacaggcatgatggctacaaagatgtccgcacaaactacaattactcagagcctactcttgcagcaaatgctggtttggttgcagcactgatttctatatctgatatcaaaactggacggttcggcattgataagaacaccatcttctctgcaattcctccaatgttcccaacacccccaccaccgccatcagcatggaaaccataa

SEQ ID NO: 14963 - protein, 621 aa, Sorghum bicolor
  misc_feature: Useful for making plants with altered cell wall content and/or composition
  misc_feature: Functional homolog of the protein sequence given in SEQ ID NO 13773
  misc_feature: Useful for making plants with altered carbohydrate content
  misc_feature: Functional homolog of the protein sequence given in SEQ ID NO 13774
  misc_feature: Ceres ANNOT ID no. 8632829
  misc_feature: Up-regulated in shoot tissues in response to methyl jasmonate treatment
  misc_feature: Down-regulated in root tissues in response to methyl jasmonate treatment
  misc_feature (1)..(605): SWISSPROT Homolog: EC 3.2.1.4 Cellulase
  misc_feature (109)..(584): Pfam ID: Glyco_hydro_9 Pfam Description: Glycosyl hydrolase family 9
MFGRDPWGGPLEISNADSATDDDRSRDLDRAALMRQLDETQQSWLLAGPGDQAGKKKKKYVDLGCVVVDRKIFMWTVGTILGLGVFIGFIMMIVKLVPHKRPPPPPPDQYTQALHKALMFFNAQRSGPLPKHNGVSWRGNSCMKDGLSDSTVRRSLVGGYYDAGDAIKFNYPMAWSMTMLSWSVIEYRAKYEAIGELDHIKELIKWGTDYILKTFNSSADTIDRIVAQVGVGDTSKGGSQPNDHYCWMRPEDIDYKRPVTECHSCSDLASEMAAALAAASIVFKDSKTYSDKLVKGAKALYKFGRLQRGRYSPNGSDQAIFYNSTSYWDEFVWGGAWMYFATGNNSYLTVATAPGMAKHAGAYWFGSPNYGVFTWDDKLPGAQVLLSRLRLFLSPGYPYEEILRTFHNQTDNVMCSYLPLFNSFNFTKGGLIQLNHGRPQPLQYAVNAAFLASLYSDYLEAADTPGWYCGPNFYTTEVLRKFARSQLDYILGKNPLKMSYVVGFGNKYPKRPHHRGASIPHNGVKYGCKGGYKWRDTKKANPNILVGAMVAGPDRHDGYKDVRTNYNYSEPTLAANAGLVAALISISDIKTGRFGIDKNTIFSAIPPMFPTPPPPPSAWKP

SEQ ID NO: 14964 - DNA, 1740 bp, Sorghum bicolor
  misc_feature: Ceres ANNOT ID no. 8632838
  misc_feature: Up-regulated in shoot tissues in response to methyl jasmonate treatment
  misc_feature: Down-regulated in root tissues in response to methyl jasmonate treatment
  misc_feature: Encodes the peptide sequence at SEQ ID NO 14965
atggcgatcaggacttgggcatcggtggttttcctgctactcgcgctcctgtcgtcgtcgtcctcgtgccgtgcggcagaggcgccgtcgccgtcgccgtccgccgacgccgacctcgccgtcggcgacgcgcaccgcaccggctaccacttccagcctcccaagaactggatcaacgatcctaatggcgtgatgtactacaagggcgtgtaccacctgttctaccagtacaaccccaagggcgcggtgtggggcaacatcgtgtgggcgcacgccgtgtcgacggacctcgtcgactgggtcatgctgccgccggcgatctacccgacggcgccgttcgacgtcaacggctgctggtcaggctccgcgaccgtgctgcccgacggcacgccggtgatcatgtacaccggcattgacggcgagaaccggcaggtgcagaacgtcgcgtaccccaaggacctctccgacccgtacctccgagagtgggtcaagcccgactacaaccccgtcatcgcgccggggccagggatgaacgccaccgcgttccgtgacccgacgacggcgtggcagggccccgacgggctctggcgcctggtgatcgggaccaaggacaaccaccggggcctcgccatgctgtaccgcagcagggacttcaagcgttgggcgccggcgcgtcgtgcgctgcactccggcgacaccggcatgtgggagtgcccggacttctatcccgtgaactccgcgggcgtcggtgtcagcggcagcggcggcaggaagcacgtgctcaaggtgagcctcgacttgacacggttcgagtactacacgttcggcgagtacgacgacgccaccgacacgtacgttccggacgcggcgatcgccgacggcaacgacgggctccggtacgactacggcaacttctacgcgtccaagacgttcctcgacacggcgaagcagcggcgcatcctgtgggggtgggccaacgagtcggactccaccgccgacgacctccgcaagggctgggccggcgtgcaggcggtcccgaggaaggtctggctggcgccggacggcaagcagctggtgcagtggccggtcgccgagatcgagtccctccgtggcaaccacgtcaacgtcacggacacgctcgtcaaggccgggcagcacttcgaggtgtcggggctcgcgtcgccggcgcaggccgacgtggaggcggcgttccaggtgatggacctggacaaggccgagccgttcgacccggcgtggcgcggcgcggacgcggagacggtgtgcgcggcgcggggcgcggaagccaagggcggcgtcggcccgttcgggctgtgggtgctcgcgtccgacgacctcaaggaacggaccgccgtgttcttcagggtgttcaagggcggcggcggcggcgacggcggcaagcacgtcgtgctcatgtgcaacgacccctccatgtcgtcgcacgccgacaacctctacaagccgaccttcgccggcttcgtcgacgtcgaagtcgctcagaccggtggcaagatccctctaaggactctgattgaccactcggttgtggagagcttcggggcgcacggcaagacttgcatcctgtcgagggtgtacccgaccaaggccgtcggcgacaaggcacggctctacgtgttcaacaacggcgagtcggacgtcaaggtcacccacctgaatgcgtacgagatgcggtcggctaagatcaccgctgacgtgaagtag

SEQ ID NO: 14965 - protein, 579 aa, Sorghum bicolor
  misc_feature: Useful for making plants with altered carbohydrate content
  misc_feature: Functional homolog of the protein sequence given in SEQ ID NO 13829
  misc_feature: Useful for making plants with modulated biomass
  misc_feature: Functional homolog of the protein sequence given in SEQ ID NO 13761
  misc_feature: Ceres ANNOT ID no. 8632838
  misc_feature (46)..(577): SWISSPROT Homolog: EC 3.2.1.26 Beta-fructofuranosidase
  misc_feature (50)..(362): Pfam ID: Glyco_hydro_32N Pfam Description: Glycosyl hydrolases family 32 N terminal
  misc_feature (404)..(529): Pfam ID: Glyco_hydro_32C Pfam Description: Glycosyl hydrolases family 32 C terminal
MAIRTWASVVFLLLALLSSSSSCRAAEAPSPSPSADADLAVGDAHRTGYHFQPPKNWINDPNGVMYYKGVYHLFYQYNPKGAVWGNIVWAHAVSTDLVDWVMLPPAIYPTAPFDVNGCWSGSATVLPDGTPVIMYTGIDGENRQVQNVAYPKDLSDPYLREWVKPDYNPVIAPGPGMNATAFRDPTTAWQGPDGLWRLVIGTKDNHRGLAMLYRSRDFKRWAPARRALHSGDTGMWECPDFYPVNSAGVGVSGSGGRKHVLKVSLDLTRFEYYTFGEYDDATDTYVPDAAIADGNDGLRYDYGNFYASKTFLDTAKQRRILWGWANESDSTADDLRKGWAGVQAVPRKVWLAPDGKQLVQWPVAEIESLRGNHVNVTDTLVKAGQHFEVSGLASPAQADVEAAFQVMDLDKAEPFDPAWRGADAETVCAARGAEAKGGVGPFGLWVLASDDLKERTAVFFRVFKGGGGGDGGKHVVLMCNDPSMSSHADNLYKPTFAGFVDVEVAQTGGKIPLRTLIDHSVVESFGAHGKTCILSRVYPTKAVGDKARLYVFNNGESDVKVTHLNAYEMRSAKITADVK

SEQ ID NO: 14966 - DNA, 1416 bp, Sorghum bicolor
  misc_feature: Ceres ANNOT ID no. 8632861
  misc_feature: Encodes the peptide sequence at SEQ ID NO 14967
atgactatggacgccgctccggtggcgaacggcgccgcggccggcgctggcgggggcgcgaatcggcggggcggaaggttgtggtacgcggccgccggcgccctcctcgtggccctcctcgccgtggccgtgagctaccgcagcttcccggacatcccctcctcgtcaccaggaagctgcggctgccctgctgcgaggaagtacacggggatggtggaggactgctgctgcgactatgagacggtggacgccatcaacgaggaggtcctgcatcccatcctacaggaactcgttaagttgcccttcttcaggtacttcaaggttaaattgtggtgtgactgccctttttggcccgatgatggaatgtgcaagcttagagattgtagtgtctgtgagtgcccggagaatgagttccctgaaccattcaggaaaccttacagtggactttctccagatagtatgatgtgccaagaaggaaaaccacaggctgctgttgataaaacccttgacagcaaggttttcaaaggatgggttgaaactgacaatccgtggacatctgatgacgagactgataataatgagatgacttatgtgaatcttcaactgaatcctgaacgatacactggatatactggtgattcagcaagaaggatatgggatgccatttacaaagagaactgtccaaaatatccctctgaagaactgtgccatgagaagaaggccttgtacaagcttatttcagggttgcactcctcaatttcagtgcatattgcttatgattatcttcttgacgaatcgactaactcatggggacaaaatcttcctttgttgtatgaccgtgtcctgaagtacccagaacgtgtccagaatctgtacttcacttacctgtttgttcttcgggccgtgacaaaggcggcagattatcttgagcaggctgagtacaatactgacaaccctgaagacgacttgaagacagaatctcttgtgaagcaattgctttacaattccaagttaagatctgcatgtccattgccttttgatgaagccaaactctggcaaggagaaaatggtcctgagctaaagcaagagattcagaagcaatttagaaacattagtgcaattatggactgtgttggatgcgagaagtgccgtctgtggggaaagctccaagttcttggtcttggaactgcactgaaaattcttttctccgttgatggagacagccatttgaatcagccattgcagctgcagcgaaatgaggtcattgcattgttcaatcttctgaacaggctctcagagtctgtcaaatttgtacatgaaaaaggatcatcaattgaagaagtcattaaggaacagatcccttcaacttttcaaaagggtgcttccaagcccaatcttaaactggacttcctctga

SEQ ID NO: 14967 - protein, 471 aa, Sorghum bicolor
  misc_feature: The sequence is a functional homolog of SEQ ID NO 2 in US patent 7064247
  misc_feature: Ceres ANNOT ID no. 8632861
  misc_feature: Up-regulated in shoot tissues in response to salicylic acid treatment
  misc_feature: Up-regulated in root tissues in response to salicylic acid treatment
  misc_feature (88)..(439): Pfam ID: ERO1 Pfam Description: Endoplasmic Reticulum Oxidoreductin 1 (ERO1)
MTMDAAPVANGAAAGAGGGANRRGGRLWYAAAGALLVALLAVAVSYRSFPDIPSSSPGSCGCPAARKYTGMVEDCCCDYETVDAINEEVLHPILQELVKLPFFRYFKVKLWCDCPFWPDDGMCKLRDCSVCECPENEFPEPFRKPYSGLSPDSMMCQEGKPQAAVDKTLDSKVFKGWVETDNPWTSDDETDNNEMTYVNLQLNPERYTGYTGDSARRIWDAIYKENCPKYPSEELCHEKKALYKLISGLHSSISVHIAYDYLLDESTNSWGQNLPLLYDRVLKYPERVQNLYFTYLFVLRAVTKAADYLEQAEYNTDNPEDDLKTESLVKQLLYNSKLRSACPLPFDEAKLWQGENGPELKQEIQKQFRNISAIMDCVGCEKCRLWGKLQVLGLGTALKILFSVDGDSHLNQPLQLQRNEVIALFNLLNRLSESVKFVHEKGSSIEEVIKEQIPSTFQKGASKPNLKLDFL

SEQ ID NO: 14968 - DNA, 1395 bp, Sorghum bicolor
  misc_feature: Ceres ANNOT ID no. 8632877
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 14969
atggcgaccatcacgacgccgctccgcgccgcgctgctctccccggccgccgcctcgtccgcgggacggcgccgcgggggcgggggccggcgccgcgcgccctcctccgtccgctgcgacgcctccccgccctcgtcctcggccgcctcgttcgacccggacttcgacaagaaggcgttccgacacaacctcacacgcagcgacaactacaaccgcaaggggttcggctacaagaaggagacgctcgagctcatgagccaggagtacaccagcgatgtgatcaagacgctcaaggagaacggcaaccagtacacctggggccccgtcaccgtgaagctcgccgaggcctacggattctgctggggagtcgagcgcgccgtgcagatcgcgtacgaggcgcgcaagcagttccccgaggagcgcatctggctcaccaacgaaatcattcacaaccccaccgttaacaagaggttggatgagatgggtgtagatatcattcctgttgacgcgggtatcaaggatttcaatgtggtcgaacaaggtgatgttgttgtgttgcctgcatttggagctgctgtggaggagatgtacacgctaaatgagaagaaagtgcagattgttgatacgacctgcccttgggtttcaaaggtctggaacatggttgaaaaacacaagaagagcgaatatacttcaattattcacggaaaatattcccatgaagaaactgttgccactgcttcttttgctggaaagtacatcattgtgaagaacatggcagaggcgacctatgtgtgtgattacatacttggtggccaacttgatgggtctagctcaacaaaagaggagttccttgagaaattcaagaaagctgtttctccaggatttgatcctgatgttgatcttgatatgttgggaattgcaaatcaaacaacaatgcttaaaggagaaactgaagaaattgggaaacttgttgaaaagactatgatgcaaaaatatggagttgaaaatgtaaacgatcacttcatggccttcaatactatttgtgatgccactcaggaaagacaagatgctatgtatcagctggtgaaagagaaagttgatcttattcttgttattggaggatggaattcaagtaacacctctcatctgcaagaaattggagaactcagtggaatcccatcctactggattgacagtgaacaaaggattggaccaggaaacatgattagctacaagttaaatcatggtgaacttgttgagaaagagaactggttacccgaggggcctattaccattggtgttacttcaggtgcctcaactccggacaaggttgttgaggatgcccttcagaaggtatttgagatcaagcgtcaggaaattttgcaggttgcataa

SEQ ID NO: 14969 - protein, 464 aa, Sorghum bicolor
  misc_feature: Useful for making plants with modulated nitrogen use efficiency
  misc_feature: Functional homolog of the protein sequence given in SEQ ID NO 14110
  misc_feature: Ceres ANNOT ID no. 8632877
  misc_feature (58)..(456): SWISSPROT Homolog: EC 1.17.1.2 4-hydroxy-3-methylbut-2-enyl diphosphate reductase
  misc_feature (111)..(455): Pfam ID: LYTB Pfam Description: LytB protein
MATITTPLRAALLSPAAASSAGRRRGGGGRRRAPSSVRCDASPPSSSAASFDPDFDKKAFRHNLTRSDNYNRKGFGYKKETLELMSQEYTSDVIKTLKENGNQYTWGPVTVKLAEAYGFCWGVERAVQIAYEARKQFPEERIWLTNEIIHNPTVNKRLDEMGVDIIPVDAGIKDFNVVEQGDVVVLPAFGAAVEEMYTLNEKKVQIVDTTCPWVSKVWNMVEKHKKSEYTSIIHGKYSHEETVATASFAGKYIIVKNMAEATYVCDYILGGQLDGSSSTKEEFLEKFKKAVSPGFDPDVDLDMLGIANQTTMLKGETEEIGKLVEKTMMQKYGVENVNDHFMAFNTICDATQERQDAMYQLVKEKVDLILVIGGWNSSNTSHLQEIGELSGIPSYWIDSEQRIGPGNMISYKLNHGELVEKENWLPEGPITIGVTSGASTPDKVVEDALQKVFEIKRQEILQVA

SEQ ID NO: 14970 - DNA, 1356 bp, Sorghum bicolor
  misc_feature: Ceres ANNOT ID no. 8632957
  misc_feature: Encodes the peptide sequence at SEQ ID NO 14971
atgagggagtgcatctcgatccacatcggccaggccggtatccaggttggaaacgcgtgctgggagctctactgcctcgagcatggcattcaggctgatggccagatgcctggtgacaagaccgttgggggaggtgatgatgctttcaacaccttcttcagtgagactggcgctgggaagcatgtcccccgtgctgtgtttgttgaccttgagccaactgtcatcgatgaggtgaggactggcacttaccgccagctcttccaccctgagcagctcatcagtggcaaggaggatgcagccaacaactttgcccgtggtcactacaccattggcaaggagattgttgacctgtgccttgatcgcatcaggaagcttgcagacaactgcactggtctccagggtttccttgtcttcaatgctgttggtggaggaacgggctctggacttggttccctcctcttggagcgtctgtctgttgattatggcaagaagtccaagcttgggttcactgtgtacccatcccctcaggtctctacctcagtggttgagccatacaacagtgtcctgtccacccactctctcctcgagcacactgatgtcgctgtcctccttgacaatgaggccatctatgacatctgccgccgctcccttgacattgagcgcccaacctacaccaacctcaacaggcttgtgtcacaggtcatctcatccctgactgcatccctgaggtttgatggtgctctgaacgttgatgtgaacgagttccagaccaatctggtgccctacccgaggatccacttcatgctttcctcctacgctcctgtgatctcggctgagaaggcctaccacgagcagctgtccgttgctgaaatcaccaatagtgcctttgagccatcctccatgatggccaaatgtgatcctcgccatggcaagtacatggcctgctgcctcatgtaccgtggtgacgtggtccccaaggatgtgaatgccgctgtggccaccatcaagaccaagcgcaccatccagttcgtggactggtgcccgactggcttcaagtgtggcatcaactaccagccacccagtgtggtgcccggcggtgacctcgcaaaggtgcagcgtgccgtgtgcatgatctccaactccaccagcgttgtggaggtgttctcccgcatcgaccacaagtttgacctcatgtacgccaagcgtgccttcgtgcactggtacgttggtgagggtatggaggagggtgagttctctgaggcccgtgaggacctggctgcgcttgagaaggactatgaggaggttggcgctgagtacgacgagggtgaggatggtgacgagggcgacgagtactag

SEQ ID NO: 14971 - protein, 451 aa, Sorghum bicolor
  misc_feature: Useful for making plants with altered cell wall content and/or composition
  misc_feature: Functional homolog of the protein sequence given in SEQ ID NO 14092
  misc_feature: Ceres ANNOT ID no. 8632957
  misc_feature: Down-regulated in root tissues in response to methyl jasmonate treatment
  misc_feature: Down-regulated in shoot tissues in response to methyl jasmonate treatment
  misc_feature: Down-regulated in root tissues in response to aminocyclopropane carboxylic treatment
  misc_feature: Down-regulated in shoot tissues in response to aminocyclopropane carboxylic treatment
  misc_feature: Down-regulated in shoot tissues in response to salicylic acid treatment
  misc_feature (49)..(246): Pfam ID: Tubulin Pfam Description: Tubulin/FtsZ family, GTPase domain
  misc_feature (248)..(393): Pfam ID: Tubulin_C Pfam Description: Tubulin/FtsZ family, C-terminal domain
MRECISIHIGQAGIQVGNACWELYCLEHGIQADGQMPGDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEYDEGEDGDEGDEY

SEQ ID NO: 14972 - DNA, 1116 bp, Sorghum bicolor
  misc_feature: Ceres ANNOT ID no. 8632956
  misc_feature: Down-regulated in root tissues in response to methyl jasmonate treatment
  misc_feature: Down-regulated in shoot tissues in response to methyl jasmonate treatment
  misc_feature: Down-regulated in root tissues in response to aminocyclopropane carboxylic treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 14973
atgacgtcgaggttacacgtctcgacgccgtggcttctgacgtggcagagacctcgacgccgtagatcatggcgtcgagctctctccaacctggaccagaacattgccgtcatcgtgcagaccgtgtactgcttcagggcggctgacgacggcggcgccggcagaagcagcgcctgcgacgtgttgagggagtcgctggcgaaggtgctcgtccactactacccgctcgctgggcggctggcgatctcagacgatgggaagctggtcgtggactgcacgggcgacggcgccgtgttcgtggaggccgaggcggactgcgccatggcggacatcggcgacgtcaccgaccccgacccctccgtcctcggcaggctcgtgtacagcgtccccggcgccaagaacatactcgagatgccgctgcttgcagcccaggtgaccaagttcaagtgtggcggcttcgtgctggggctggccatcaaccactgcatgttcgacggcgtcggcgccatgcagttcgtcaactcgtggggcgagacggcgcgcggcctcccgctgtcgctcccgccggccctcgaccgcgccgtcctccgtgcgcgcgacccgccgcaggtcgacttcccgcaccacgagttcacgcagatcaccgacgacgacgccgacgacggggaggacgaggaggactcggagtccccgctcctgcaccgctcgttccggttcacgccggcgtccatcgcgcgcctcaaggcggcggtgggggcgctggaggagggccgccgcgcgtgcaccacgttcgaggcgctggccgggttcgtgtggagcgcgcgcacgcgggcgctggggatgcgcccgtcgcgccggagcaagttgttgttcgcggtggacgggcggccgaggttctcgccgccgctccccgcggggtacttcggcaacgccatcgtgctgaccagcgcggcgtgccccgcgggggagctggcgtcgtcgctgccgcgcgccgtgcggctggtgcgcggcgccgcggcggccgtgacggacgtctacatgcggtccgcggtggactacttcgaggcgacgcgcgcggccgtcactggcgtcgacactgctcatcacggcatgtag

SEQ ID NO: 14973 - protein, 371 aa, Sorghum bicolor
  misc_feature: Useful for biocontainment applications
  misc_feature: Functional homolog of the protein sequence given in SEQ ID NO 14111
  misc_feature: Ceres ANNOT ID no. 8632956
  misc_feature (61)..(326): SWISSPROT Homolog: EC 2.3.1.162 Taxadien-5-alpha-ol O-acetyltransferase
  misc_feature (11)..(371): Pfam ID: Transferase Pfam Description: Transferase family
MTSRLHVSTPWLLTWQRPRRRRSWRRALSNLDQNIAVIVQTVYCFRAADDGGAGRSSACDVLRESLAKVLVHYYPLAGRLAISDDGKLVVDCTGDGAVFVEAEADCAMADIGDVTDPDPSVLGRLVYSVPGAKNILEMPLLAAQVTKFKCGGFVLGLAINHCMFDGVGAMQFVNSWGETARGLPLSLPPALDRAVLRARDPPQVDFPHHEFTQITDDDADDGEDEEDSESPLLHRSFRFTPASIARLKAAVGALEEGRRACTTFEALAGFVWSARTRALGMRPSRRSKLLFAVDGRPRFSPPLPAGYFGNAIVLTSAACPAGELASSLPRAVRLVRGAAAAVTDVYMRSAVDYFEATRAAVTGVDTAHHGM

SEQ ID NO: 14974 - DNA, 1071 bp, Sorghum bicolor
  misc_feature: Ceres ANNOT ID no. 8632965
  misc_feature: Encodes the peptide sequence at SEQ ID NO 14975
atggcaacacagtggttctccaacatggtgatggacgagccgagcttcttccaccagtggcagtcggacgcgctgctagagcagtacacggagcagcagatcgcggtggcgttcgggcagggggaggtggaccacgccgtggcggcggcgctgtcgacgatgccgcagcagcagcagcagcagcaacccgcggtggcggccgagcaccgcccgcgcaaggcggccaaggtcaacaccagctgggactcgtgcatcacggagcagggctcccccgcggactcctcctcgccgaccatcctctccttcggcggccacgccgcggccgcgttcgccaagccggagccgcacccgcaccaggcgcccagcgccgccgcgtactacggcgccgcggcggcggccgccaaggcgccgaagcaggaggtgctggacgccgccgcgctgccgttcccggctaagcgttcctacgacgacatggccgaggccgccaataaggcgccggccgccaccacacgcccggcgtcgcagaaccaggaccacatcttggccgagcggaagcgccgcgagaagctcagccagcgcttcatcgccctctccaagatcgtccctggcctcaagaagatggacaaggcatcagtgctcggcgacgcgatcaagtacgtgaagcagctgcaggaccaggtgaaggggctggaggacgaggcccggcggaggccggtcgaggcggcggtgctggtcaagaagtcccagctgtccgccgacgacgacgagggctcctcctgcgacgagaacttcgtgggcaccgacgcttccggcacgctgccggagatcgaggcccgggtgtcggaccgcacggtgctggtcaggatccactgcgagaatcgcaagggggtgctcatcgccgcgctttccgagatcgagcgcctcggactctccatcatgaacaccaatgtgctccccttcaccacctcctccctcgacatcaccatcatggccatggctggtgatgacttctgcttgtctgtcaaggatattgtcaagaagctaaatcaagcgttcaaatcatccttctga

SEQ ID NO: 14975 - protein, 356 aa, Sorghum bicolor
  misc_feature: Useful for making plants with altered alkaloid content
  misc_feature: Functional homolog of the protein sequence given in SEQ ID NO 13317
  misc_feature: The sequence is a functional homolog of SEQ ID NO 2194 in the 10/374,780 US patent application
  misc_feature: The sequence is a functional homolog of SEQ ID NO 530 in the 10/666,642 US patent application
  misc_feature: Ceres ANNOT ID no. 8632965
  misc_feature (175)..(224): Pfam ID: HLH Pfam Description: Helix-loop-helix DNA-binding domain
MATQWFSNMVMDEPSFFHQWQSDALLEQYTEQQIAVAFGQGEVDHAVAAALSTMPQQQQQQQPAVAAEHRPRKAAKVNTSWDSCITEQGSPADSSSPTILSFGGHAAAAFAKPEPHPHQAPSAAAYYGAAAAAAKAPKQEVLDAAALPFPAKRSYDDMAEAANKAPAATTRPASQNQDHILAERKRREKLSQRFIALSKIVPGLKKMDKASVLGDAIKYVKQLQDQVKGLEDEARRRPVEAAVLVKKSQLSADDDEGSSCDENFVGTDASGTLPEIEARVSDRTVLVRIHCENRKGVLIAALSEIERLGLSIMNTNVLPFTTSSLDITIMAMAGDDFCLSVKDIVKKLNQAFKSSF

SEQ ID NO: 14976 - DNA, 1521 bp, Sorghum bicolor
  misc_feature: Ceres ANNOT ID no. 8633001
  misc_feature: Encodes the peptide sequence at SEQ ID NO 14977
atgacggagagaagagagcttcggctgctgcttgcgctcttgggagtcctgcacctcgttcgtcttgtacctttggcagctgtctctgcctctctggtctggactcctccatacggccgctttctccgttccttgtctgacagtgaaaggaacaaatgcccgtgccggatagagccgtgtctgcagtctctcgagctttctgaaccacacgaacccatgcccgccgtcaaggcgccagcatgccatcaggtgacggcgacatcgtcgcagtccttcatcggcatcaactacggcgaagtggccgacaacctcccgccgccgtcgtccacggcgcgtctcgtccagtccacaaccatcaccaaggtgcgcctctacgggacggacccggccatcgtctccgcctttgccggcacgggcatctcgctcctgctcggcgccaccaacggcgacatcgccaaccttgcgtcctcgcccgccgccgccgcatcctgggtcgccgcgaacctgccggccaagtcgccggccgtctctaccgtctccgtcggcaacgaggtgctcttcgccgacgcctcgctcgcctcgcagctcgtcccggccatgcagaacctgtacgacgcgctgccgcccaactccagcgtcaaggtctccaccgtgaacgccatggacgtgctcgcgagctccgacccgccctcctccggctcgttcaagccggagctcgcgacggcgctcgacccgctgctggcgttcctgagcaagaccggctcgccgttccttatcaacccgtacccttacttcgcgtacctcagcgacccgcggccggagacgctggccttctgcctgttccagcccaacgccggccggccggacgccgggtccgggctcacgtacaccaacatgttcgacgcgcaggtcgacgccgtgcgcgccgcgctggacgccaaggggtacaaggacgtggagatcgtggtggccgagaccgggtggccgcacaagggcgacaccgacgaggccggcgccacggcagagaacgcgcgcgcgttcgtgtcgggcctcgtgtcccacctcagctcgctggccggcacgccgcgggcgcccggcaagtcggtggagacgtacatctttgccctgtacgacgaggacctcaagcccggcaaggcgtcggagcgctacttcgggctgttccagactagcctcaccgagacgtacccgacggggttgctcaggaacggcacggccggactgataccggcgccggcgccggcgccgacgacgacgtccgccccggcgctaaagccaacgccagggcaacagccacaggtgactccagggcagcagggctcgacggcggcagctgggccttccggcctctgcacgccggcggggccagggacggctacgtcgaaagggaccaccaccaccactgcctgcgctcatcctaatgctgctgaatcgtctcgcacttcctcgatgctccctattattgctggtttttggttcatagctttgcagatgtttatatga

SEQ ID NO: 14977 - protein, 506 aa, Sorghum bicolor
  misc_feature: Useful for making plants with altered carbohydrate content
  misc_feature: Functional homolog of the protein sequence given in SEQ ID NO 14112
  misc_feature: Useful for making plants with altered cell wall content and/or composition
  misc_feature: Functional homolog of the protein sequence given in SEQ ID NO 14113
  misc_feature: Ceres ANNOT ID no. 8633001
  misc_feature (78)..(412): SWISSPROT Homolog: EC 3.2.1.39 Glucan endo-1,3-beta-D-glucosidase
  misc_feature (93)..(406): Pfam ID: Glyco_hydro_17 Pfam Description: Glycosyl hydrolases family 17
MTERRELRLLLALLGVLHLVRLVPLAAVSASLVWTPPYGRFLRSLSDSERNKCPCRIEPCLQSLELSEPHEPMPAVKAPACHQVTATSSQSFIGINYGEVADNLPPPSSTARLVQSTTITKVRLYGTDPAIVSAFAGTGISLLLGATNGDIANLASSPAAAASWVAANLPAKSPAVSTVSVGNEVLFADASLASQLVPAMQNLYDALPPNSSVKVSTVNAMDVLASSDPPSSGSFKPELATALDPLLAFLSKTGSPFLINPYPYFAYLSDPRPETLAFCLFQPNAGRPDAGSGLTYTNMFDAQVDAVRAALDAKGYKDVEIVVAETGWPHKGDTDEAGATAENARAFVSGLVSHLSSLAGTPRAPGKSVETYIFALYDEDLKPGKASERYFGLFQTSLTETYPTGLLRNGTAGLIPAPAPAPTTTSAPALKPTPGQQPQVTPGQQGSTAAAGPSGLCTPAGPGTATSKGTTTTTACAHPNAAESSRTSSMLPIIAGFWFIALQMFI

SEQ ID NO: 14978 - DNA, 1680 bp, Sorghum bicolor
  misc_feature: Ceres ANNOT ID no. 8632996
  misc_feature: Encodes the peptide sequence at SEQ ID NO 14979
atggcgtacatgtgcgccgacagcggcaacctcatggccatcgcgcagcaggtgattcagcagcagcagcaacagcagcagcaccagaggcaccacctgccgccgccgccgatgccgctcccgctcccgccgcgccaggcgccgccgatgccgccgtccccggcgcccccgcacggccagatcccggcggcatccctcccctacggcggcggcgcgtggccccaggcggaccatttcttccccgacgccttcgtcggcacgtccgcggccgacgcggtgttctcggacctcgccggcgccgcggacttcgactccgatgtgtggatggacagcctcatcggggacgcaccggtcttcgcggactccgacctcgagcgcctcatcttcaccaccccgccgccgcccgtccctgcccctgtcgccacccccgccgtggcccccgtcgacgcggcggcccagccagaggccgccactccggcgtcgcttccccagcctgccgccgtcgctaccccggcagcgtgttcctctccgagctccttggacgcctcctgctccgcgcccatcctccagtccctcctcgcctgctcccgtacagcggccgctgacccagggctcgctgccgcggagctcgtccaggtgcgcgctgccgcctccgacgatggggaccccgcagagcgcgtggcgttctacttcgcggacgcgctggcgcgccgcctcgcgtgcggcggcggggcgcaacccacgatggcagtagacgcgcgtttcgcctccgacgagctcacgctctgctacaagacactcaatgacgcctgcccctactccaagtttgcgcacctgaccgccaaccaggccatcctggaggctacgggcacggcgaccaagatccatatcgttgacttcgggatcgtgcagggtatccaatgggcggcgctgctgcaggcgctcgccactcgcccgggggagaagccgtcccgggtacgtatctccggtgtaccctcgccgtacttggggccaaagcctgcgacgtccctcgccgcaaccagtgcccgtctccgcgacttcgccaagcttcttggggtggacttcgagttcgtcccattgctgcggccagtgcacgagctggatcggtcggatttctccgttgagcctgacgagaccgtagccgtcaatttcatgctccagttgtaccaccttcttggcgactccgatgaacccgtgcgacgagtcctccagctggttaagtcactcgatccatcagtggttacccttggggagtatgaggtcagtctgaaccgagctgggttcgttgaccggtttgccaatgcactgttgtattacaagccagtgttcgagtcactggatgtggcgatgccacgggactcaccggagagggtgagggtggagcgatgcatgtttggggagcgcattcgaagggccattgggccagaggaaggcgaagagaggactgataggatggcggctagtagggagtggcagacattgatggagtggtgtggatttgagcctgtcaagctcagcaactatgccatgagtcaggctgatcttttgctttggaattacgattcaaagtacaagtattcacttgttgagttgccaccagcgttcttatctctggcttgggagaagcggccgctgctcaccgtgtctgcttggcggtga

SEQ ID NO: 14979 - protein, 559 aa, Sorghum bicolor
  misc_feature: The sequence is a functional homolog of SEQ ID NO 132 in the 10/225,068 US patent application
  misc_feature: The sequence is a functional homolog of SEQ ID NO 54 in the 10/374,780 US patent application
  misc_feature: The sequence is a functional homolog of SEQ ID NO 966 in the 10/225,066 US patent application
  misc_feature: Useful for biocontainment applications
  misc_feature: Functional homolog of the protein sequence given in SEQ ID NO 14114
  misc_feature: Ceres ANNOT ID no. 8632996
  misc_feature (162)..(465): Pfam ID: GRAS Pfam Description: GRAS family transcription factor
MAYMCADSGNLMAIAQQVIQQQQQQQQHQRHHLPPPPMPLPLPPRQAPPMPPSPAPPHGQIPAASLPYGGGAWPQADHFFPDAFVGTSAADAVFSDLAGAADFDSDVWMDSLIGDAPVFADSDLERLIFTTPPPPVPAPVATPAVAPVDAAAQPEAATPASLPQPAAVATPAACSSPSSLDASCSAPILQSLLACSRTAAADPGLAAAELVQVRAAASDDGDPAERVAFYFADALARRLACGGGAQPTMAVDARFASDELTLCYKTLNDACPYSKFAHLTANQAILEATGTATKIHIVDFGIVQGIQWAALLQALATRPGEKPSRVRISGVPSPYLGPKPATSLAATSARLRDFAKLLGVDFEFVPLLRPVHELDRSDFSVEPDETVAVNFMLQLYHLLGDSDEPVRRVLQLVKSLDPSVVTLGEYEVSLNRAGFVDRFANALLYYKPVFESLDVAMPRDSPERVRVERCMFGERIRRAIGPEEGEERTDRMAASREWQTLMEWCGFEPVKLSNYAMSQADLLLWNYDSKYKYSLVELPPAFLSLAWEKRPLLTVSAWR

SEQ ID NO: 14980 - DNA, 2490 bp, Sorghum bicolor
  misc_feature: Ceres ANNOT ID no. 8633003
  misc_feature: Encodes the peptide sequence at SEQ ID NO 14981
atggtgggaggaatggtagtcgccgtgccgaatggggtgaaggcggatggcgccctagccgccgccgtcgccgccaaggcagattctcctaaatccgttctggaggacgagaaaatttctgagtccaagactgggaacgcctcctttgccacagagtcatttaagcaagagcaagagcactctgacgatcttgtggatgcaagttcgtccctgcctgttgaccatgaaatcgacagtgctggtgtgccccctgttgttaaggcagtcaaggacgaagagcagcttctggagcccgtcaagcaggataaagttgatgatgaggatgcaagtttatctatacctattgaccttgaggccaagaatggtgatgtatccctgatcacagaagcaatgaaaaaggaagaagagcagcttgaggaggcgcggattaaagcagaggaagaagaggaagccaggaagagggaggaagctgcaaaacttgcttttgatcctaaggcgcggtatagcaaattagatgagctgctgacgaagacacagctatattcagagttcctgcttgagaaaatggataaaattgctgatgaagtcgaacctcaaggtgaagagtcaccagtagaggagaagaagaaaggacgtggccgaaagaggaaagctaaggctgcaccacaatacaatgataaaaaggctaagacagcagtggcagccatgcttacaagatcccgtgaagatcgccttgctgatgattctacactctcggaagaagaaaagtgtacaaaagagcaagccaatcttgtgcctttaatgactggtgggaagttgaagtcataccagatcaagggtgtgaagtggctaatttcgttgtggcagaatgggctaaatgggatacttgctgaccaaatgggccttgggaaaacaatccagacaattggatttcttgctcacctgaaggggaaaggcatgcatggtccatacatgataattgctcctctttccactctctcaaattgggtgaatgagatctcgaggtttgttccatctgttaccagtatcatttatcatggagataaagtggcccgggctgagataagaagaaaattcatgcctaaaactgctggtcctgattttcctataatagtgacttcattcgaggttgccatgttagatgcaaggtttcttgctcactatcagtggaagtacgtcgttgtggatgaggggcatcggttgaaaaattctaagtgtaagctatttagggagatgaagcgcataccaatggctaacaagctccttttgactgggacacctcttcagaacaatctggcagagctgtggtcactattgaacttcattttgcctgatatattctcatcgcaccaggaatttgaatcatggtttgacttttctgcgaaaggaagtgaagaaccagaagaaactgaagaaaaaagaagggtccatgttgtttcaaagcttcatgccattttgcgtccattccttctgagacggatgaaggaggatgtagaacagatgcttccacggaagaaagagataatcatttatgctaacatgactgaggttcagaagcgaatccaggatcacttagttgagaaaagttttgatgtctacttgaatgaagaatcagatattgtgttgcggaaacctggcatcaaggcaaagctaaatagtctttgtattcaattgaggaagaactgtgcccatcctgatcttttggaagctgcatttggaacaacaagcttgtatccacctgttaataagcttttagagcaatgtggcaaatttcagcttctggacaggctactaacttccctacttgcacgcaagcacaaggttctaatattctcacaatggacaaaagttttggacattcttgagtattacctagattcaaaaggcctcggggtttgcagaattgatggcagtgttaatttggaagagaggcggcggcagatagcagagtttaatgatgtgaatagcagtctgaatgtcttcattctgagcacgcgggctggtgggcttggtatcaaccttacttctgctgatacatgtatcctatatgacagtgactgggccatggatcgatgccaccggattggtcaaacacgcccagtgcatgtatataggctggcaacctcacattctgttgaggaacgtatcatcaagagagcttttgggaagttaaagctagagcatgtggtgatagggaagggacagtttgaacaagaaagagcaaagcctaatgtcttagcggagggggagctgctggcgctgcttagggacgagcaggacgaagaagaccggatgatccagaccgacatcagcgatgaagacctcttgaagctgatggaccgcagcgacctgtccggaccacctggtgctgccgatgccacaccactgatcccgctgaaaggtcctggctgggaggtcgtggtgccagccaagagcggtggcggtatgctctcgtcgctcaccagctga

SEQ ID NO: 14981 - protein, 829 aa, Sorghum bicolor
  misc_feature: The sequence is a functional homolog of SEQ ID NO 1241 in the 10/666,642 US patent application
  misc_feature: The sequence is a functional homolog of SEQ ID NO 518 in the 10/666,642 US patent application
  misc_feature: Ceres ANNOT ID no. 8633003
  misc_feature: Up-regulated in root tissues in response to methyl jasmonate treatment
  misc_feature: Up-regulated in shoot tissues in response to methyl jasmonate treatment
  misc_feature (272)..(462): SWISSPROT Homolog: EC 3.6.1.15 Nucleoside-triphosphatase
  misc_feature (276)..(575): Pfam ID: SNF2_N Pfam Description: SNF2 family N-terminal domain
  misc_feature (631)..(703): Pfam ID: Helicase_C Pfam Description: Helicase conserved C-terminal domain
MVGGMVVAVPNGVKADGALAAAVAAKADSPKSVLEDEKISESKTGNASFATESFKQEQEHSDDLVDASSSLPVDHEIDSAGVPPVVKAVKDEEQLLEPVKQDKVDDEDASLSIPIDLEAKNGDVSLITEAMKKEEEQLEEARIKAEEEEEARKREEAAKLAFDPKARYSKLDELLTKTQLYSEFLLEKMDKIADEVEPQGEESPVEEKKKGRGRKRKAKAAPQYNDKKAKTAVAAMLTRSREDRLADDSTLSEEEKCTKEQANLVPLMTGGKLKSYQIKGVKWLISLWQNGLNGILADQMGLGKTIQTIGFLAHLKGKGMHGPYMIIAPLSTLSNWVNEISRFVPSVTSIIYHGDKVARAEIRRKFMPKTAGPDFPIIVTSFEVAMLDARFLAHYQWKYVVVDEGHRLKNSKCKLFREMKRIPMANKLLLTGTPLQNNLAELWSLLNFILPDIFSSHQEFESWFDFSAKGSEEPEETEEKRRVHVVSKLHAILRPFLLRRMKEDVEQMLPRKKEIIIYANMTEVQKRIQDHLVEKSFDVYLNEESDIVLRKPGIKAKLNSLCIQLRKNCAHPDLLEAAFGTTSLYPPVNKLLEQCGKFQLLDRLLTSLLARKHKVLIFSQWTKVLDILEYYLDSKGLGVCRIDGSVNLEERRRQIAEFNDVNSSLNVFILSTRAGGLGINLTSADTCILYDSDWAMDRCHRIGQTRPVHVYRLATSHSVEERIIKRAFGKLKLEHVVIGKGQFEQERAKPNVLAEGELLALLRDEQDEEDRMIQTDISDEDLLKLMDRSDLSGPPGAADATPLIPLKGPGWEVVVPAKSGGGMLSSLTS

SEQ ID NO: 14982 - DNA, 1482 bp, Sorghum bicolor
  misc_feature: Ceres ANNOT ID no. 8633026
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 14983
atggtgctgtcacacggtgtcggcggctccgatgagtccgtccactcgacgttcgcgtcccgctacgtccgcgcctccctgcccaggttccggatgccggagcagtcgatccccaaggaggcggcgtaccagatcatcaacgacgagctgatgctggacgggaacccgcggctgaacctggcctccttcgtcaccacgtggatggagcccgagtgcgacaagctcatccaggcctccgtcaataagaactacgtcgacatggacgagtaccccgtcaccaccgagctgcagaaccggtgcgtgaacatgatcgcgcatctcttcaacgctcctctcggggactctgaaactgctgttggagtgggcaccgtcggctcgtccgaggccatcatgctggctgggctggcgttcaagaggcgttggcagaacaagatgaaggccgccggcaagccctgcgacaagccaaacattgtcaccggcgccaatgtccaagtttgctgggagaagttcgcgcgctacttcgaggtggagctgaaggaagtgaagctgagcgacggctactacgtcatggacccgcagaaggccgtggacatggtggacgagaacaccatctgtgtcgcggccatcctcggctccacactgaacggcgagttcgaggacgttaagctgctcaacgacctgcttaccaagaagaacgcggagacaggctgggacacaccgatccacgtggacgcggcgagcggtgggttcatcgcgccgttcctgtacccggaactggagtgggacttccgtctgccgctcgtgaagagcatcaacgtcagtgggcacaagtatggcctggtctacgccggcatcgggtggtgcatctggaggagcaaggaggacctgccggaggagctcatcttccacatcaactacctcggcgccgaccagcccaccttcaccctcaacttctccaaaggctccagccaggtcattgcacagtactaccagctgatccgccttggctttgagggttacaagaacatcatggagaattgccaggagaacgcgatggttctgaagcaaggtctggagaagacgggcaagttcaacatcgtgtccaaggacaatggcgtgccgctggtggccttctccctcaaggacagcagccggcacaacgaattcgagatctccgacttcctgcgccgcttcggctggatcgtgccggcctacaccatgccccccgacgcgcagcacgtgacggtgctccgcgtcgtcatccgcgaggacttcagccgcaccctcgcggagcgcctggtgctcgacatcgagaaggtgctgcacgagctggacgcgctgcccgcccgcgtccccagcggcgacctcgccgcgctcgccgccgccgaggccagcgagaaggcgatggagaagcagcgggaggtgatctcgctctggaagagggccgtcctcgccaagaagaagaccaacggcgtctgctaa

SEQ ID NO: 14983 - protein, 493 aa, Sorghum bicolor
  misc_feature: Useful for making plants with modulated nitrogen use efficiency
  misc_feature: Functional homolog of the protein sequence given in SEQ ID NO 14115
  misc_feature: Ceres ANNOT ID no. 8633026
  misc_feature (1)..(493): SWISSPROT Homolog: EC 4.1.1.15 Glutamate decarboxylase
  misc_feature (33)..(381): Pfam ID: Pyridoxal_deC Pfam Description: Pyridoxal-dependent decarboxylase conserved domain
MVLSHGVGGSDESVHSTFASRYVRASLPRFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPQKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGKFNIVSKDNGVPLVAFSLKDSSRHNEFEISDFLRRFGWIVPAYTMPPDAQHVTVLRVVIREDFSRTLAERLVLDIEKVLHELDALPARVPSGDLAALAAAEASEKAMEKQREVISLWKRAVLAKKKTNGVC

SEQ ID NO: 14984 - DNA, 3396 bp, Sorghum bicolor
  misc_feature: Ceres ANNOT ID no. 8633037
  misc_feature: Encodes the peptide sequence at SEQ ID NO 14985
atgtcttcctcgaggcctgcccactcttccagttcatccagtaggactcgccagagctcccaggcaaggatattagcacaaacaacccttgatgctgaactcaatgcagagtatgaagaatctggtgattcctttgattactccaagttggttgaagcacagcggagcactccatctgagcagcaagggcgatcaggaaaggtcatagcctacttgcagcatattcaaagaggaaagctaatccaaccatttggttgcttgttggcccttgacgagaagagcttcagggtcattgcattcagtgagaatgcacctgaaatgctcacaacggtcagccatgctgtgccaaacgttgatgatcccccaaagctaggaattggtaccaatgtgcgctcccttttcactgaccctggtgctacagcactgcagaaggcactaggatttgctgatgtttctttgctgaatcctatcctagttcaatgcaagacctcaggcaagccattctatgccattgttcatagggcaactggttgtctggtggtagattttgagcctgtgaagcctacagaatttcctgccactgctgctggggctttgcagtcttacaagcttgctgccaaggcaatctccaagatccagtcactgccaggtggaagcatggaggccttatgcaataccgtggttaaggaagtctttgagcttacaggttatgacagggttatggcttacaagttccatgaagatgagcatggggaggtctttgctgagatcaccaaacctggtattgaaccttatctaggcctgcactatccagccactgatatccctcaagctgccaggtttctcttcatgaagaacaaagtcagaatgatctgtgattgccgtgcaaaatctgtgaagattattgaagatgaggcactctccattgatattagcttgtgtggttcaactcttagagcaccacatagctgtcaccttcagtatatggagaacatgaactcgattgcatcccttgtcatggctgttgtggttaatgaaaatgaagaggatgatgaacctgggcccgaacaaccaccacaacagcagaagaagaagagactgtggggtctcattgtttgccaccatgaaagccccagatatgtcccgtttccactgcggtatgcctgtgaattcttggcccaagtgtttgctgtccatgtaaacaaggagtttgaattggagaagcagatacgagagaaaagcattctgcgaatgcaaacaatgctctctgacatgctgttcaaggaagcatctcccttgagtatcgtatctgggagtccaaatatcatggacctagttaagtgtgatggtgctgctcttttgtatggggacaaagtctggcggcttcaaacggctccaaccgagtctcagatacgtgatattgccttctggctttcagaagttcatggggattccactggcttgagtactgatagcctccaggatgctggatatccaggagctgcttcccttggtgacatgatttgtggaatggcagtggctaagatcacgtccaaggacattcttttctggttcaggtcacatacagctgctgaaatcaaatggggaggtgcaaagcatgatccatctgataaggatgacaacagaaggatgcaccctaggttgtcctttaaggctttccttgaggttgtcaagatgaagagtttgccatggagcgactacgagatggatgctattcactcattgcaacttattcttagaggtacactgaatgatgccttgaagccggtccaggcatctggtttagataaccagattggtgatctcaaacttgatgggcttgctgaattgcaagcagtgacaagtgaaatggttcgcctcatggaaacagcaactgttccgatcttggcagtagatggcaatggattggtcaatggatggaatcaaaaggtagcagaattgtcagggttgagagttgatgaagctataggtagacacatacttacacttgtggaggattcttctgtatcaattgttcagaggatgctatatttagctctgcagggcaaagaagagaaggaagttcgatttgagttgaaaacacatggctccaagagggatgatggccctgttatcttggttgtaaatgcttgtgccagtcgtgaccttcatgaccatgttgttggggtgtgctttgtagcccaggatatgactgttcataagttggtcatggacaaatttactcgggttgagggggactacaaggcaatcattcacaacccaaacccgctcattcctcctatatttggtgctgaccaatttggatggtgctctgagtggaatgtagccatgaccaagcttactgggtggcacagagatgaagtgatagataagatgctccttggtgaggtttttgacagtagcaatgcttcctgccttttgaagagcaaagatgattttgtacgtctttgcattatcatcaacagtgcattagccggtgaagaggcagaaaatgctccattcggtttgtttgaccgcaatgggaaatatattgaatgccttctgtcagtgaacagaaaagtaaatgcagatggtgttgtcactggagtgttctgtttcattcatgttcctagtgatgacctgcagcatgcgctacatgtgcagcaagcctctgagcagacagcacaaagaaggttgaaggctttctcgtacatgcgacatgccatcaacaaacctctctcaggtatgctttattctagggaaacactcaagagcacaggtctgaatgaagagcagatgaggcaggtccatgttgcagatagttgtcatcgccagctaaacaagatacttgccgacttagatcaagataacattactgacaagtcaagttgcttggatttggatatggctgaatttgtgttggaagatgtggtggtgtctgctgtaagtcaagtactgataggttgccagggtaaaggtatcagagttgcttgcaacctgccagagagattcatgaagcaaaaagtttacggggatggtatccgactccaacagatcctctccgacttcttatttgtttcggtgaagttctctcctgttggtggctctgttgatatctcttccaaactgactaagaacagcattggggaaaaccttcatctcatagacttcgaacttaggatcaagcaccaaggagcaggagtcccagcagaaatattgtcacaaatgtatgaggaggacaataaagagcagtcagaggagggtttgagccttcttgtttctagaaaccttctgaggctcatgaatggtaacattcgtcacctcagggaagctggcatgtcaaccttcatcctcactgctgaacttgctgctgctccttcagcagttggacaatga

SEQ ID NO: 14985 - protein, 1131 aa, Sorghum bicolor
  misc_feature: Useful for making plants with modulated biomass
  misc_feature: Useful for making plants with modulated light quality response
  misc_feature: Useful for making plants with modulated light quality sensitivity
  misc_feature: Functional homolog of the protein sequence given in SEQ ID NO 14105
  misc_feature: Useful for making plants with altered low light response
  misc_feature: Useful for making plants with modulated flowering time
  misc_feature: Useful for making plants with modulated nitrogen use efficiency
  misc_feature: Functional homolog of the protein sequence given in SEQ ID NO 14116
  misc_feature: Ceres ANNOT ID no. 8633037
  misc_feature: Up-regulated in root tissues in response to salicylic acid treatment
  misc_feature: Up-regulated in shoot tissues in response to salicylic acid treatment
  misc_feature (25)..(784): SWISSPROT Homolog: EC 2.7.11.1 Non-specific serine/threonine protein kinase
  misc_feature (415)..(595): Pfam ID: Phytochrome Pfam Description: Phytochrome region
  misc_feature (70)..(186): Pfam ID: PAS_2 Pfam Description: PAS fold
  misc_feature (752)..(877): Pfam ID: PAS Pfam Description: PAS fold
  misc_feature (622)..(737): Pfam ID: PAS Pfam Description: PAS fold
  misc_feature (219)..(404): Pfam ID: GAF Pfam Description: GAF domain
  misc_feature (1011)..(1123): Pfam ID: HATPase_c Pfam Description: Histidine kinase-, DNA gyrase B-, and HSP90-like ATPase
  misc_feature (897)..(961): Pfam ID: HisKA Pfam Description: His Kinase A (phosphoacceptor) domain
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAENAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEQSEEGLSLLVSRNLLRLMNGNIRHLREAGMSTFILTAELAAAPSAVGQ

SEQ ID NO: 14986 - DNA, 1767 bp, Sorghum bicolor
  misc_feature: Ceres ANNOT ID no. 8633031
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 14987
atggccggcgccgagcgcgtggaggctccctccttggaggagcaagggctcctcgctctagaggaatccaaccaactagtatacactggagatggatcagttgacttttctggaaatcctgttatcaaggaaagaactggtagatggaaggcatgtccattcatattaggtaatgaatgctgtgaacgactggcctattatggcatcgccacgaaccttgttacttacttgacaaaaaagctacatgttggcaatgcctctgctgctagcaacgtgactacatggcagggaacttgctacttgactccgcttattggagcagtcctggctgatgcatactgggggaagtattggataattgcaacatcctccatagtgtacttcatcgggatggtaatactgactctttcagcatcagttcctatgctcatgcctccatcctgtgaaggatccttttgcgcaccagcaagcccttttcagtatactgtcttttttcttggtctttatctgattgcactgggtgctggtggaattaagccatgcgtctcgtcctttggagctgatcaatttgatgatacagatcctgatgagcgaatccagaagggttctttctttaattggttctatctttcaataaatattggtggcctcatatcaagcagctttctggtttgggtgcaagacaatgttggatggggactgggctttggcattccgacagtatccatggggctggcaatcataagcttcttctctggcacatcactttataggttccaaaaacctggaggtagtcctattacacgagtatgccaggtgattgttgcctcgttgcgcaagtggaatgtgcatgtcccagaggacagctctctcttgtatgagcaacctgatggggtatcaacaattgaggggagtcggcaattagagcacacagatgaactcagattttttgacaaggctgctacagttgccaaagttgacgtgaaaactgctgacttcaacaatccatggcggatatgcacagtcacgcaggtggaagaactaaagatactggtaaggatgttccctatatgggcaacaacaatcgtgttttctgttgcatatgctcagatgtcaacaatgtttgtggaacaaggcatggtgcttgacccatccttgggttcattcaagtttcctccagcgtcgttatctacttttgacaccctaaccatcatcatatgtgtcccgatgtacaattacatcatggttccaatagctaggagattcactggcaacgggaggggctttacagagttgcagaggatgggcattggcctggtaatttccatcatagctatgtcagtcgctgcaatccttgaaatcaagcggctagaagttgccagggaagcacacctggtagatcagaacatcccagtcccattgagcatattctggcaaatccctcagtatttcctgatcggtctagcggaggtgttcacattcatcggagcgctcgagttcttttataatcagtcaccggatgccatgaggagcgtctgcagcgcacttaatcttctcaccgtttcctttgggaactatctcaacacgttcattttgacaatggttgcatactttactacaaggggaggtaaccctggatggattcctgacaacttgaacgaagggcatcttgattacttcttctggctcattgctggcctcagttttctgaacctgattgtatatgtcatctgtgctagcaaatacaagagcaagaaggcagcttga

SEQ ID NO: 14987 - protein, 588 aa, Sorghum bicolor
  misc_feature: Useful for making plants with altered carbon content
  misc_feature: Useful for making plants with altered nitrogen content
  misc_feature: Functional homolog of the protein sequence given in SEQ ID NO 14117
  misc_feature: Ceres ANNOT ID no. 8633031
  misc_feature (117)..(521): Pfam ID: PTR2 Pfam Description: POT family
MAGAERVEAPSLEEQGLLALEESNQLVYTGDGSVDFSGNPVIKERTGRWKACPFILGNECCERLAYYGIATNLVTYLTKKLHVGNASAASNVTTWQGTCYLTPLIGAVLADAYWGKYWIIATSSIVYFIGMVILTLSASVPMLMPPSCEGSFCAPASPFQYTVFFLGLYLIALGAGGIKPCVSSFGADQFDDTDPDERIQKGSFFNWFYLSINIGGLISSSFLVWVQDNVGWGLGFGIPTVSMGLAIISFFSGTSLYRFQKPGGSPITRVCQVIVASLRKWNVHVPEDSSLLYEQPDGVSTIEGSRQLEHTDELRFFDKAATVAKVDVKTADFNNPWRICTVTQVEELKILVRMFPIWATTIVFSVAYAQMSTMFVEQGMVLDPSLGSFKFPPASLSTFDTLTIIICVPMYNYIMVPIARRFTGNGRGFTELQRMGIGLVISIIAMSVAAILEIKRLEVAREAHLVDQNIPVPLSIFWQIPQYFLIGLAEVFTFIGALEFFYNQSPDAMRSVCSALNLLTVSFGNYLNTFILTMVAYFTTRGGNPGWIPDNLNEGHLDYFFWLIAGLSFLNLIVYVICASKYKSKKAA

SEQ ID NO: 14988 - DNA, 1764 bp, Sorghum bicolor
  misc_feature: Ceres ANNOT ID no. 8633032
  misc_feature: Encodes the peptide sequence at SEQ ID NO 14989
atggccggcgccgagcgcgcggaggcggtcgctctggaggaagggctcctcgctccggaggaatccaaccaagtagtatacactggagatggatcagtcgacttttcgggaaatcctgttgtcaaggaaacaacgggtagatggaaggcatgtccattcatattaggtaatgaatgctgtgaacgactggcctattatggcatctccacgaaccttgtcacttacttgacaaaaaagctacatgctggcaatgcctctgctgctagcaatgtgactacatggcagggaacttgctacttgactccgcttattggggcaatcctggctgatgcatactgggggaggtattggacgattgcaacattctccacagtatacttcatcgggatgtcaatactgactctttcagcatcagttcctatgctcatgcctccatcttgtgaaggatccttttgcccacaagcaagcccttttcagtatactgtatttttccttggtctttatctgattgccctgggtactggtggaattaagccttgtgtctcatcctttggagcggatcaatttgatgatacagatccagctgagcgaatccagaagggttctttctttaattggttctatttttcaataaacattggtgctctcatatcaagcagctttctggtttgggtgcaagacaatgtaggatggggactgggctttggcattccgactgtattcatggggctggcaatcataagtttcttctctggcacatcactttataggttccaaaaaccaggaggtagtcctattacacgagtatgccaggtgattgttgcctctttgcgcaagtggaatgtgcctgccccagaggacagctctctcttgtatgagctacctaatggggtatcaacaattgaggggagtcggcaaatagagcacacagatgaactcagatgtttagacaaggctgctacagttaccgaagttgatgtgaaaatggctgacttcagcaacccatggcggatatgcactgtcacccaggtggaagaactgaagatactagtaaggatgttccctgtctgggcaacaacaatagtgttttctgctgtatatgctcaaatgtcgacaatgttcgtggaacaagggatggtgcttgacccatcgttgggttctttcaagattcctccagcttcactgtctacctttgacaccctaagtgtcatcgtatgtgtcccgatgtacgattacattgtggttccaatagccaggagattcaccggcaacgagaggggctttacagagttgcagaggatgggcattggcctggtcatttccatccttgctatgtcggtcgctgcaatcctcgaaatcaagcggctagcagttgccagggaagcacacctggtggatcagaatgtcccggtcccactgagcatattctggcaaatccctcagtatttcctgattggtctagcagagattttcacattcatcggagcgcttgagttcttttatgaccagtcaccagacgccatgaggagcctctgcagtgcacttaatcttctcactactgcgggtgggaactatctcagcacgttcattttgacaatggtcgcgtactttactacgaggggaggtaaccctggatggattcctgacaacttgaacgaagggcatcttgattacttcttctggctccttgctggcctcagttttctgaacctgattgtatatgtcatctgtgctggcaaatacaagggcaagaaggcagcttga

SEQ ID NO: 14989 - protein, 587 aa, Sorghum bicolor
  misc_feature: Useful for making plants with altered carbon content
  misc_feature: Useful for making plants with altered nitrogen content
  misc_feature: Functional homolog of the protein sequence given in SEQ ID NO 14117
  misc_feature: Ceres ANNOT ID no. 8633032
  misc_feature: Up-regulated in root tissues in response to salicylic acid treatment
  misc_feature: Up-regulated in shoot tissues in response to salicylic acid treatment
  misc_feature (116)..(520): Pfam ID: PTR2 Pfam Description: POT family
MAGAERAEAVALEEGLLAPEESNQVVYTGDGSVDFSGNPVVKETTGRWKACPFILGNECCERLAYYGISTNLVTYLTKKLHAGNASAASNVTTWQGTCYLTPLIGAILADAYWGRYWTIATFSTVYFIGMSILTLSASVPMLMPPSCEGSFCPQASPFQYTVFFLGLYLIALGTGGIKPCVSSFGADQFDDTDPAERIQKGSFFNWFYFSINIGALISSSFLVWVQDNVGWGLGFGIPTVFMGLAIISFFSGTSLYRFQKPGGSPITRVCQVIVASLRKWNVPAPEDSSLLYELPNGVSTIEGSRQIEHTDELRCLDKAATVTEVDVKMADFSNPWRICTVTQVEELKILVRMFPVWATTIVFSAVYAQMSTMFVEQGMVLDPSLGSFKIPPASLSTFDTLSVIVCVPMYDYIVVPIARRFTGNERGFTELQRMGIGLVISILAMSVAAILEIKRLAVAREAHLVDQNVPVPLSIFWQIPQYFLIGLAEIFTFIGALEFFYDQSPDAMRSLCSALNLLTTAGGNYLSTFILTMVAYFTTRGGNPGWIPDNLNEGHLDYFFWLLAGLSFLNLIVYVICAGKYKGKKAA

SEQ ID NO: 14990 - DNA, 3396 bp, Sorghum bicolor
  misc_feature: Ceres ANNOT ID no. 8633035
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 14991
atgtcttcctcgaggcctgcccactcttccagttcatccagtaggactcgccagagctcccaggcaaggatattagcacaaacaacccttgatgctgaactcaatgcagagtatgaagaatctggtgattcctttgattactccaagttggttgaagcacagcggagcactccatctgagcagcaagggcgatcaggaaaggtcatagcctacttgcagcatattcaaagaggaaagctaatccaaccatttggttgcttgttggcccttgacgagaagagcttcagggtcattgcattcagtgagaatgcacctgaaatgctcacaacggtcagccatgctgtgccaaacgttgatgatcccccaaagctaggaattggtaccaatgtgcgctcccttttcactgaccctggtgctacagcactgcagaaggcactaggatttgctgatgtttctttgctgaatcctatcctagttcaatgcaagacctcaggcaagccattctatgccattgttcatagggcaactggttgtctggtggtagattttgagcctgtgaagcctacagaatttcctgccactgctgctggggctttgcagtcttacaagcttgctgccaaggcaatctccaagatccagtcactgccaggtggaagcatggaggccttatgcaataccgtggttaaggaagtctttgagcttacaggttatgacagggttatggcttacaagttccatgaagatgagcatggggaggtctttgctgagatcaccaaacctggtattgaaccttatctaggcctgcactatccagccactgatatccctcaagctgccaggtttctcttcatgaagaacaaagtcagaatgatctgtgattgccgtgcaaaatctgtgaagattattgaagatgaggcactctccattgatattagcttgtgtggttcaactcttagagcaccacatagctgtcaccttcagtatatggagaacatgaactcgattgcatcccttgtcatggctgttgtggttaatgaaaatgaagaggatgatgaacctgggcccgaacaaccaccacaacagcagaagaagaagagactgtggggtctcattgtttgccaccatgaaagccccagatatgtcccgtttccactgcggtatgcctgtgaattcttggcccaagtgtttgctgtccatgtaaacaaggagtttgaattggagaagcagatacgagagaaaagcattctgcgaatgcaaacaatgctctctgacatgctgttcaaggaagcatctcccttgagtatcgtatctgggagtccaaatatcatggacctagttaagtgtgatggtgctgctcttttgtatggggacaaagtctggcggcttcaaacggctccaaccgagtctcagatacgtgatattgccttctggctttcagaagttcatggggattccactggcttgagtactgatagcctccaggatgctggatatccaggagctgcttcccttggtgacatgatttgtggaatggcagtggctaagatcacgtccaaggacattcttttctggttcaggtcacatacagctgctgaaatcaaatggggaggtgcaaagcatgatccatctgataaggatgacaacagaaggatgcaccctaggttgtcctttaaggctttccttgaggttgtcaagatgaagagtttgccatggagcgactacgagatggatgctattcactcattgcaacttattcttagaggtacactgaatgatgccttgaagccggtccaggcatctggtttagataaccagattggtgatctcaaacttgatgggcttgctgaattgcaagcagtgacaagtgaaatggttcgcctcatggaaacagcaactgttccgatcttggcagtagatggcaatggattggtcaatggatggaatcaaaaggtagcagaattgtcagggttgagagttgatgaagctataggtagacacatacttacacttgtggaggattcttctgtatcaattgttcagaggatgctatatttagctctgcagggcaaagaagagaaggaagttcgatttgagttgaaaacacatggctccaagagggatgatggccctgttatcttggttgtaaatgcttgtgccagtcgtgaccttcatgaccatgttgttggggtgtgctttgtagcccaggatatgactgttcataagttggtcatggacaaatttactcgggttgagggggactacaaggcaatcattcacaacccaaacccgctcattcctcctatatttggtgctgaccaatttggatggtgctctgagtggaatgtagccatgaccaagcttactgggtggcacagagatgaagtgatagataagatgctccttggtgaggtttttgacagtagcaatgcttcctgccttttgaagagcaaagatgattttgtacgtctttgcattatcatcaacagtgcattagccggtgaagaggcagaaaatgctccattcggtttgtttgaccgcaatgggaaatatattgaatgccttctgtcagtgaacagaaaagtaaatgcagatggtgttgtcactggagtgttctgtttcattcatgttcctagtgatgacctgcagcatgcgctacatgtgcagcaagcctctgagcagacagcacaaagaaggttgaaggctttctcgtacatgcgacatgccatcaacaaacctctctcaggtatgctttattctagggaaacactcaagagcacaggtctgaatgaagagcagatgaggcaggtccatgttgcagatagttgtcatcgccagctaaacaagatacttgccgacttagatcaagataacattactgacaagtcaagttgcttggatttggatatggctgaatttgtgttggaagatgtggtggtgtctgctgtaagtcaagtactgataggttgccagggtaaaggtatcagagttgcttgcaacctgccagagagattcatgaagcaaaaagtttacggggatggtatccgactccaacagatcctctccgacttcttatttgtttcggtgaagttctctcctgttggtggctctgttgatatctcttccaaactgactaagaacagcattggggaaaaccttcatctcatagacttcgaacttaggatcaagcaccaaggagcaggagtcccagcagaaatattgtcacaaatgtatgaggaggacaataaagagccgtcagaggagggtttgagccttcttgtttctagaaaccttctgaggctcatgaatggtaacattcgtcacatcagggaagctggcatgtcaaccttcatcctcactgctgaacttgctgctgctccttcagcagttggacaatga

SEQ ID NO: 14991 - protein, 1131 aa, Sorghum bicolor
  misc_feature: Useful for making plants with modulated biomass
  misc_feature: Useful for making plants with modulated light quality response
  misc_feature: Useful for making plants with modulated light quality sensitivity
  misc_feature: Functional homolog of the protein sequence given in SEQ ID NO 14105
  misc_feature: Useful for making plants with altered low light response
  misc_feature: Useful for making plants with modulated flowering time
  misc_feature: Useful for making plants with modulated nitrogen use efficiency
  misc_feature: Functional homolog of the protein sequence given in SEQ ID NO 14116
  misc_feature: Ceres ANNOT ID no. 8633035
  misc_feature: Up-regulated in root tissues in response to salicylic acid treatment
  misc_feature: Up-regulated in shoot tissues in response to salicylic acid treatment
  misc_feature (25)..(784): SWISSPROT Homolog: EC 2.7.11.1 Non-specific serine/threonine protein kinase
  misc_feature (415)..(595): Pfam ID: Phytochrome Pfam Description: Phytochrome region
  misc_feature (70)..(186): Pfam ID: PAS_2 Pfam Description: PAS fold
  misc_feature (752)..(877): Pfam ID: PAS Pfam Description: PAS fold
  misc_feature (622)..(737): Pfam ID: PAS Pfam Description: PAS fold
  misc_feature (219)..(404): Pfam ID: GAF Pfam Description: GAF domain
  misc_feature (1011)..(1123): Pfam ID: HATPase_c Pfam Description: Histidine kinase-, DNA gyrase B-, and HSP90-like ATPase
  misc_feature (897)..(961): Pfam ID: HisKA Pfam Description: His Kinase A (phosphoacceptor) domain
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAENAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHIREAGMSTFILTAELAAAPSAVGQ

SEQ ID NO: 14992 - DNA, 345 bp, Sorghum bicolor
  misc_feature: Ceres ANNOT ID no. 8633071
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 14993
atggagctaacgcaaaattgcaggctgcaaatgagaaaggaaatggtccgaatgcacccccaatctctccccagaaagggtgggagggataagaaattatcaacaactgcaattaaacttccaactcaagagcacttgcgccccactgcaaaaaaaatttcgcgcttgaagaacacgcacctaagggcgctccccggcgcggcggagaggctgacgctgtgcaaggccgacctgctcaactacgacgcgctgcggtcggccgtcgccagctgccacgacgtcttccacaccgtgtcgcccgtcaccgacgatccggtacatatacatgtaacctttagtacttga

SEQ ID NO: 14993 - protein, 114 aa, Sorghum bicolor
  misc_feature: Useful for making plants with altered carbohydrate content
  misc_feature: Functional homolog of the protein sequence given in SEQ ID NO 14118
  misc_feature: Useful for making plants with altered lignin content
  misc_feature: Functional homolog of the protein sequence given in SEQ ID NO 14119
  misc_feature: Useful for making plants with altered cell wall content and/or composition
  misc_feature: Functional homolog of the protein sequence given in SEQ ID NO 14120
  misc_feature: Ceres ANNOT ID no. 8633071
  misc_feature (46)..(104): SWISSPROT Homolog: EC 1.1.1.219 Dihydrokaempferol 4-reductase
MELTQNCRLQMRKEMVRMHPQSLPRKGGRDKKLSTTAIKLPTQEHLRPTAKKISRLKNTHLRALPGAAERLTLCKADLLNYDALRSAVASCHDVFHTVSPVTDDPVHIHVTFST

SEQ ID NO: 14994 - DNA, 1152 bp, Sorghum bicolor
  misc_feature: Ceres ANNOT ID no. 8633087
  misc_feature: Encodes the peptide sequence at SEQ ID NO 14995
atgccaacgcgcgtcgcggccggaatcatcgccaaccagccggtcggtacgttacattacttacccacgcgcctcgcaaacgaagcgacgggaaaatcacgcgccccgcaaagtcgtccttcttcctccgctcgccgacacggcgcaaatccccacataccccaggcgggcgggcggacttcccagttcccacccacctcctcgcgcgcgcgacgtgctcggctcgcttccacccacaccagccgtctcgctcgccgccagcttcgtaatccccgccgcgagatctcgtcccccgggaggatggaggtgaaaacagtaaaagttagcaatctttcattaaacgctttgaaaagagagatcacagagttctttagtttctcaggggatatagaatatgttgaaatgcaaagtgaatctgaatggtcacagcttgcttatgtcacatttaaagactcacagggagcagacactgctgttcttctgtcgggggcaaccattgttgatcgtgctgtcattataactcctgctgagaactatcagctgcctcctgaagcacacaaacaattatcgggagcaaatccctctactgaatcagcagtcaggaaggcagaagatgttgtcagcagcatgttggccaagggctttgtcctcagcaaagacgctctcaacttggcaagatcctttgacgagcgacacaacatcctatccaatgctactgccactgtcgcatctctggaccgccagtatggcctgagtgaaaagatcaatcttggaagggccattgttggcagcaaggtcaaggaggtggatgaacgctatcaggtctcagaactcacaaagtctgccttggctgctgctgagcagaaagccagctttgcgggctctgctatattgagtaaccaatatgtctcggctggtgcctcgtggttaactagtgcattcggtatggtaacgaaggcagcaggtgacatgacctcgatggctaaagataaggtagagagggctgaggaggagaggaaagccatcatgtgggaggagaggaatgggttggtcagcgactatgcaaagatccatcttgacgaaccctcttcatgggagcccgcagttctgcctttggaatcagtggatgagcagaagctccaagctgtctga

SEQ ID NO: 14995 - protein, 383 aa, Sorghum bicolor
  misc_feature: Useful for making plants with altered alkaloid content
  misc_feature: Functional homolog of the protein sequence given in SEQ ID NO 13167
  misc_feature: Useful for making plants with altered lignin content
  misc_feature: Functional homolog of the protein sequence given in SEQ ID NO 13052
  misc_feature: Useful for making plants with modulated biomass
  misc_feature: Functional homolog of the protein sequence given in SEQ ID NO 13029
  misc_feature: Ceres ANNOT ID no. 8633087
MPTRVAAGIIANQPVGTLHYLPTRLANEATGKSRAPQSRPSSSARRHGANPHIPQAGGRTSQFPPTSSRARRARLASTHTSRLARRQLRNPRREISSPGRMEVKTVKVSNLSLNALKREITEFFSFSGDIEYVEMQSESEWSQLAYVTFKDSQGADTAVLLSGATIVDRAVIITPAENYQLPPEAHKQLSGANPSTESAVRKAEDVVSSMLAKGFVLSKDALNLARSFDERHNILSNATATVASLDRQYGLSEKINLGRAIVGSKVKEVDERYQVSELTKSALAAAEQKASFAGSAILSNQYVSAGASWLTSAFGMVTKAAGDMTSMAKDKVERAEEERKAIMWEERNGLVSDYAKIHLDEPSSWEPAVLPLESVDEQKLQAV

SEQ ID NO: 14996 - DNA, 942 bp, Sorghum bicolor
  misc_feature: Ceres ANNOT ID no. 8633098
  misc_feature: Encodes the peptide sequence at SEQ ID NO 14997
atggctctgctctctgatctcatcaacctcgacctctcggactgcaccgagaagatcatcgccgagtacatctgggttggcggttctgggatggatgtgaggagcaaagccaggacgctgtccggacctgttgatgaccctagcaagcttccaaaatggaatttcgacggctccagcaccggccaagctcctggtgacgacagtgaagtcatcctttgccctcgggccatcttcagagacccgttcaggaaggggaagaacatactggtcatgtgcgactgctacgagccaaatggaaagccgattccgagcaacaagcggcacggggcggcgacgatctttagccaccctgatgtcaaggctgaggaaccatggtttgggattgagcaggagtacacccttcttcagaaggacaccaactggcctcttggttggccgctgggcggctaccctggccctcagggaccatactactgcgccgccggagcggacaaatcctacgggcgggagatcgtggacgcgcactacaaggcctgcctctacgccggcatcgacatcagcggcatcaacggggaggtcatgccagggcagtgggagttccaggttggccctgccgtcggcgtctcggccggcgaccagctctgggtggctcgctacattctcgagagaatcaccgagatcgccggtgtggtcgtctcttttgaccccaagccaattccgggagactggaacggcgctggtgctcacaccaactacagcaccaagtcgatgaggagcgacggcgggtacgaggtgatcaagaaggcgatcagcaagctgggcctccgtcaccgggagcacatcgcggcgtacggggacggcaacgagcgccgcctcaccggccgccacgagaccgccgacatcaacaccttcatctgggtgagcacggcgagaccgccgtaa

SEQ ID NO: 14997 - protein, 313 aa, Sorghum bicolor
  misc_feature: Useful for making plants with modulated water use efficiency
  misc_feature: Functional homolog of the protein sequence given in SEQ ID NO 13877
  misc_feature: Ceres ANNOT ID no. 8633098
  misc_feature (16)..(306): SWISSPROT Homolog: EC 6.3.1.2 Glutamate--ammonia ligase
  misc_feature (103)..(313): Pfam ID: Gln-synt_C Pfam Description: Glutamine synthetase, catalytic domain
  misc_feature (17)..(97): Pfam ID: Gln-synt_N Pfam Description: Glutamine synthetase, beta-Grasp domain
MALLSDLINLDLSDCTEKIIAEYIWVGGSGMDVRSKARTLSGPVDDPSKLPKWNFDGSSTGQAPGDDSEVILCPRAIFRDPFRKGKNILVMCDCYEPNGKPIPSNKRHGAATIFSHPDVKAEEPWFGIEQEYTLLQKDTNWPLGWPLGGYPGPQGPYYCAAGADKSYGREIVDAHYKACLYAGIDISGINGEVMPGQWEFQVGPAVGVSAGDQLWVARYILERITEIAGVVVSFDPKPIPGDWNGAGAHTNYSTKSMRSDGGYEVIKKAISKLGLRHREHIAAYGDGNERRLTGRHETADINTFIWVSTARPP

SEQ ID NO: 14998 - DNA, 1263 bp, Sorghum bicolor
  misc_feature: Ceres ANNOT ID no. 8633121
  misc_feature: Encodes the peptide sequence at SEQ ID NO 14999
atgactacgagcgctggggcggcggcaggcgccgcgctaggcgcgcgcacggcgcggtcctgcgacggatgcatgcggcggcgggcgcgctggcactgccccgccgacgacgcgttcctgtgccagacctgcgacgtctccgtccactcggcgaacccgctggcgcgccgccaccaccgcgtccgcctcccctcggcgtcgtgctcctccccaccgtgcgaccccgacgcgcccacgtggctccacggcctcaagcgacggccgcgcacgccgcggtccaagccagggggaggcaagcatgaggcgacgacgcccaattctatggccgcggctgcgtcggcagcggtccccgacctcgaggcggaggagtctggctccggcatcgtgggcgataacgacgaccacgggttcctggtggacgacgacgaggaccttctgtaccgcgtgccggtgttcgaccctatgctcgccgagttctacaaccccgtggcagacgagggggagcagaagccgctcgccgagttctacaacctcgtggccgacgaaggggagcagaagccggcctgcctgatgccgcctctcgtggaaacatcgccggagttcgcctccggcggcttggcggaggcggacgggctctcagggttcgacgtcccggacatggagctcgctagcttcgcggcggacatggagagcctcctcatgggagtccacgacgggtttgatgatctgggtttcttggacgaagagaagcctcaggtgaatgcggacgcgtacttggaggccatggcggcgccggtgcctgaacgagaggacaagaaaaggaagcggccggagatgatactcaagctcaactacgatggcgtcatcgcctcgtgggtccgtgacggcggatcgccgtggttccacggcgagcgtcctcacctcgatccttacgagttatggtctgacttcccggcgggaagccggggactcctcggcggcgccgtcaccgctgtgaccggcggcgagcgtgaggcgcgggtgtcgcggtacagggagaagcggcggacgcggctgttcgccaagaagatccggtacgaggtgcgcaaggtcaacgccgagaagcggccgcggatgaagggccggttcgtgaagcgcaccacgcttccgccgctgccgaggccgccgccgcagcagcagcagaagcagctgccacgggcactgccacacgtgggcatggtgctcgcgccacctccgggagcgaacgggcgcttccagttttga

SEQ ID NO: 14999 - protein, 420 aa, Sorghum bicolor
  misc_feature: The sequence is a functional homolog of SEQ ID NO 1522 in the 10/374,780 US patent application
  misc_feature: The sequence is a functional homolog of SEQ ID NO 1593 in the 10/412,699 US patent application
  misc_feature: Ceres ANNOT ID no. 8633121
  misc_feature (337)..(381): Pfam ID: CCT Pfam Description: CCT motif
  misc_feature (16)..(63): Pfam ID: zf-B_box Pfam Description: B-box zinc finger
MTTSAGAAAGAALGARTARSCDGCMRRRARWHCPADDAFLCQTCDVSVHSANPLARRHHRVRLPSASCSSPPCDPDAPTWLHGLKRRPRTPRSKPGGGKHEATTPNSMAAAASAAVPDLEAEESGSGIVGDNDDHGFLVDDDEDLLYRVPVFDPMLAEFYNPVADEGEQKPLAEFYNLVADEGEQKPACLMPPLVETSPEFASGGLAEADGLSGFDVPDMELASFAADMESLLMGVHDGFDDLGFLDEEKPQVNADAYLEAMAAPVPEREDKKRKRPEMILKLNYDGVIASWVRDGGSPWFHGERPHLDPYELWSDFPAGSRGLLGGAVTAVTGGEREARVSRYREKRRTRLFAKKIRYEVRKVNAEKRPRMKGRFVKRTTLPPLPRPPPQQQQKQLPRALPHVGMVLAPPPGANGRFQF

SEQ ID NO: 15000 - DNA, 2031 bp, Sorghum bicolor
  misc_feature: Ceres ANNOT ID no. 8633130
  misc_feature: Encodes the peptide sequence at SEQ ID NO 15001
atgaggacgacgaaaccaacaattctagctctcgttctgctctctcttctttgctcagggtacttgaccgggctggctgatggcgcggaggcgcggaaggggaagaaagcgtcgggaccggggccggggccggtgatcggcatcgacctgggcaccacgtactcgtgcgtcggggtgtaccggaacgggcacgtggacatcgtcgccaacgaccagggcaaccggatcacgccgtcgtgggtggcattcaccgacgaggagcgcctcgtcggcgaggccgccaagaaccaggcgccgctcaacccgcagcggaccatcttcgacatcaagcgcctcatcggccggaggttcgacgacgaggaggtgcagcgggacgtcaggtacctcccctacaaggtggtgaacaagggcggcaagccgtacgtggaggtgcccatgaagggcggcgagaggaagacgttcagccccgaggagatcagcgccatgatcctgtccaagatgcgggagacggccgagtcctacctcggccaccgcgtcgccgacgccgtcgtcaccgtgccggcctacttcaacgacgcgcagcggcaggcgaccaaggacgccggcaccatcgcggggctcaacgtgccgcggatcatcaacgagcccacggcggcggccatcgcgtacgggctggacaagaagggcgcggagatgatgaacgtgctcgtctacgacctcggcggcggcaccttcgacgtcagcgtgctcagcctcgaccacggcgtcttcgaggtgctcgccaccagcggcgacacgcacctcggcggcgaggacttcgaccagcgcgtcatggaccacttcatccgcctcgtcaagcggaagcacggcaaggacatcagcaaggacggccgcgccatgggcaagctgcggcgcgagtgcgagcgtgccaagcgcgcgctcagcagccagcaccaggtgcgcgtcgagatcgagtccctgttcgacggcgtcgacttctcggagcagctgacgagggctaagttcgaggagctcaacatggacctgttcaagaagacgctgggccccgtcaagaaggccatcgcagacgccaagctcaagaagtccgacatccacgagattgtgctcgtcggcggcagcaccaggatccccaaggtgcaggagctccttacagagatgttcgacggcaaggagcccaccaaggggatcaaccccgacgaggccgtggcctatggagccgccatccaggccagcatcatcagcggcgagggcggcgccgagaccaaagacatcttgctgctcgacgtgacgccgctgacgctggggatcgagacggccggcggcgtgatgacgaagctgatcccgcggaacacgaggatccccgtgaagaagtcgcaggtgttcacgacctacgaggaccaccagacgacggtgtcgatcaaggtgttcgagggggagcggagcctgaccaaggactgccgcgagctggggcggttcgacctgacgggcatcccgccggcgccccgcggcgtgccgcagatcgaggtgaccttcgaggtggacgagaacggcatcctccacgtgaccgcggcggacaaggccggcgggcggtccaagtcgatcaccatcaccaacgacaagggccggctcagccaggaggagatcgaccggatggtgcgcgaggccgaggagttcgcggaggaggaccgccgcgtccgggagcgtgtcgacgcgcggaaccgtctggagaactacgtgtaccgcgtccgcgccacggtgcgggacgccggcggcatggcgaggaagatcggcgacgaggaccgggagcggatggaggctgccctggcggaagcgctggagtggctggaggagcaggacggcgccgcggggcggacggcggagaaggaggagtacgaggagaagctcagggaggtggaggaggtgtgcggcccgatcatcaagcaggtgtacgagaagtcggccgggtcggacgccgccgcggacgaggaggatgacgtgaacgagctgtag

SEQ ID NO: 15001 - protein, 676 aa, Sorghum bicolor
  misc_feature: Useful for making plants with modulated heat sensitivity
  misc_feature: Functional homolog of the protein sequence given in SEQ ID NO 13726
  misc_feature: Useful for making plants with modulated drought sensitivity
  misc_feature: Functional homolog of the protein sequence given in SEQ ID NO 14080
  misc_feature: Ceres ANNOT ID no. 8633130
  misc_feature (45)..(658): Pfam ID: HSP70 Pfam Description: Hsp70 protein
MRTTKPTILALVLLSLLCSGYLTGLADGAEARKGKKASGPGPGPVIGIDLGTTYSCVGVYRNGHVDIVANDQGNRITPSWVAFTDEERLVGEAAKNQAPLNPQRTIFDIKRLIGRRFDDEEVQRDVRYLPYKVVNKGGKPYVEVPMKGGERKTFSPEEISAMILSKMRETAESYLGHRVADAVVTVPAYFNDAQRQATKDAGTIAGLNVPRIINEPTAAAIAYGLDKKGAEMMNVLVYDLGGGTFDVSVLSLDHGVFEVLATSGDTHLGGEDFDQRVMDHFIRLVKRKHGKDISKDGRAMGKLRRECERAKRALSSQHQVRVEIESLFDGVDFSEQLTRAKFEELNMDLFKKTLGPVKKAIADAKLKKSDIHEIVLVGGSTRIPKVQELLTEMFDGKEPTKGINPDEAVAYGAAIQASIISGEGGAETKDILLLDVTPLTLGIETAGGVMTKLIPRNTRIPVKKSQVFTTYEDHQTTVSIKVFEGERSLTKDCRELGRFDLTGIPPAPRGVPQIEVTFEVDENGILHVTAADKAGGRSKSITITNDKGRLSQEEIDRMVREAEEFAEEDRRVRERVDARNRLENYVYRVRATVRDAGGMARKIGDEDRERMEAALAEALEWLEEQDGAAGRTAEKEEYEEKLREVEEVCGPIIKQVYEKSAGSDAAADEEDDVNEL

SEQ ID NO: 15002 - DNA, 1884 bp, Sorghum bicolor
  misc_feature: Ceres ANNOT ID no. 8633163
  misc_feature: Encodes the peptide sequence at SEQ ID NO 15003
atgaagcgcgagtaccaagacgccggcgggagcggcggcgacatgggctcctccaaggacaagatgatggtggcggcggcgggggcaggggagcaggaggaggagctggacgagatgctggcctcgctcggctacaaggtgcgttcgtcggatatggcggacgtcgcacagaagctggagcagctcgagatggccatggggatgggcggcgttggcggcgccggcgctaccgctgatgacggcttcatctcgcacctcgccacggacaccgtgcactacaatccctccgacctgtcgtcctggctcgagagcatgctgtccgagctcaacgcgcccccaccgccgctcccgcccgcgacgacgccgccggccccgaggctcgcgtccacctcgtccaccgtcacaagtggcgccgccgccggtgctggctacttcgatctcccgcccgccgtcgactcgtccagcagcacctacgccctgaagccgatcccctcgccggtggcggtggcgtcggccgacccgtcctccacggactccacgcgggagcccaagcggatgcggactggcggcggcagcacgtcgtcttcgtcttcctcgtcgtcatccatggatggcggccgcactaggagctccgtggtcgaggctgccccgcccgcgacgcaggcgcccgcggcggccaacgggcccgccgtgccggtggtggtgatggacacgcaggaggctgggatccggctcgtgcacgcgctgctggcgtgcgcggaggccgtgcagcaggagaacttctctgcggcggacgcgctggtcaagcagatccccatgctggcctcgtcgcagggcggtgccatgcgcaaggtcgccgcctacttcggcgaggcgcttgcccgccgcgtgtatcgcttccgcccgacgccggacacctccctcctcgacgccgccgtcgccgacttcctgcacgcgcacttctacgagtcctgcccctacctcaagttcgcccacttcaccgcgaaccaggcaatcctcgaggctttcgccggctgccgccgcgtccacgtcgtcgacttcggcatcaagcaggggctgcagtggccggctcttctccaggccctcgccctccgtcctggcggccccccatcgttccgactcaccggcgtcggcccaccgcagcacgacgagaccgacgccttgcaacaggtgggctggaaacttgctcagttcgcgcacaccatccgcgtcgacttccagtatcgtggcctcgtcgccgccacgctcgctgacctggagccgttcatgctgcaaccggagggggacgacaaggatgaggagcccgaggtgatcgccgtcaactcagtgttcgagctgcatcggctgctcgctcagcccggcgccctggagaaggtcctgggcacggtgcgcgcggtgcggccgaggatcgtgaccgtggtcgagcaggaggccaaccacaactccggcacattccttgaccgcttcacggagtccctgcactactactccaccatgttcgattctctcgagggcgccggctccggccaatccaccgatgcctctccggccgcggccggcggcacggaccaggtcatgtccgaggtgtacctgggccggcagatctgcaacgttgtggcatgtgagggcgcggagcgcacggagcgccacgagacgctgagtcagtggcgcggccgcctcgtcggctccgggttcgagcccgtgcacctgggctccaatgcctacaagcaggcgagcacgctgctggcactcttcaacggcggcgacgggtacagggtggaggagaaggacgggtgcctgaccctggggtggcatacgcgcccgctcatcgccacctcggcatggcgcctcgccgctccgtga

SEQ ID NO: 15003 - protein, 627 aa, Sorghum bicolor
  misc_feature: The sequence is a functional homolog of SEQ ID NO 1 in US patent 7268272
  misc_feature: Useful for making plants with modulated biomass
  misc_feature: Functional homolog of the protein sequence given in SEQ ID NO 14121
  misc_feature: The sequence is a functional homolog of SEQ ID NO 218 in the 10/412,699 US patent application
  misc_feature: The sequence is a functional homolog of SEQ ID NO 2290 in the 10/374,780 US patent application
  misc_feature: The sequence is a functional homolog of SEQ ID NO 439 in the 11/479,226 US patent application
  misc_feature: The sequence is a functional homolog of SEQ ID NO 784 in the 10/225,066 US patent application
  misc_feature: The sequence is a functional homolog of SEQ ID NO 216 in the 10/412,699 US patent application
  misc_feature: The sequence is a functional homolog of SEQ ID NO 435 in the 11/479,226 US patent application
  misc_feature: The sequence is a functional homolog of SEQ ID NO 68 in the 10/666,642 US patent application
  misc_feature: Ceres ANNOT ID no. 8633163
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature (219)..(522): Pfam ID: GRAS Pfam Description: GRAS family transcription factor
MKREYQDAGGSGGDMGSSKDKMMVAAAGAGEQEEELDEMLASLGYKVRSSDMADVAQKLEQLEMAMGMGGVGGAGATADDGFISHLATDTVHYNPSDLSSWLESMLSELNAPPPPLPPATTPPAPRLASTSSTVTSGAAAGAGYFDLPPAVDSSSSTYALKPIPSPVAVASADPSSTDSTREPKRMRTGGGSTSSSSSSSSSMDGGRTRSSVVEAAPPATQAPAAANGPAVPVVVMDTQEAGIRLVHALLACAEAVQQENFSAADALVKQIPMLASSQGGAMRKVAAYFGEALARRVYRFRPTPDTSLLDAAVADFLHAHFYESCPYLKFAHFTANQAILEAFAGCRRVHVVDFGIKQGLQWPALLQALALRPGGPPSFRLTGVGPPQHDETDALQQVGWKLAQFAHTIRVDFQYRGLVAATLADLEPFMLQPEGDDKDEEPEVIAVNSVFELHRLLAQPGALEKVLGTVRAVRPRIVTVVEQEANHNSGTFLDRFTESLHYYSTMFDSLEGAGSGQSTDASPAAAGGTDQVMSEVYLGRQICNVVACEGAERTERHETLSQWRGRLVGSGFEPVHLGSNAYKQASTLLALFNGGDGYRVEEKDGCLTLGWHTRPLIATSAWRLAAP

SEQ ID NO: 15004 - DNA, 1113 bp, Sorghum bicolor
  misc_feature: Ceres ANNOT ID no. 8633176
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature: Encodes the peptide sequence at SEQ ID NO 15005
atggacttaccgctttaccaacaactgcagctcagcccgccttccccaaagccggaccaatcaagcagcttctactgctgctacccatgctcccctcccttcgccgccgccgccgccgacgccagctttcacctgagctaccagatcggtagtgccgccgccgccatccctccacaagccgtgatcaactcgccggaggacctgccggtgcagccgctgatggagcaggcgccggcgccgcctacagagcttgtcgcctgcgccagtggtggtgcacaaggcgccggcgtcagcgtcagcctggacagggcggcggccgcggccgccgcgaggaaagaccggcacagcaagatatgcaccgccggcgggatgagggaccgccggatgcggctgtcccttgacgtcgcccgcaagttcttcgcgctccaggacatgcttggcttcgacaaggccagcaagacggtacaatggctcctcaacacgtccaaggccgccatccaggagatcatggccgacgacgtcgacgcgtcgtcggagtgcgtggaggatggctccagcagcctctccgtcgacggcaagcacaacccggcggagcagctgggagatcagaagcccaagggtaatggccgcagcgaggggaagaagccggccaagtcaaggaaggcggcgaccaccccaaagccgccaagaaaatcggggaataatgcgcacccggtccccgacaaggagacgagggcgaaggcgagggagagggcgagggagcgaaccaaggagaagcaccggatgcgttgggtaaagcttgcatcagcaattgacgtggaggcggcggctgcctcggtggctagcgacaggccgagctcgaaccatttgaaccaccaccaccactcatcgtcgtccatgaacatgccgcgtgctgcggaggctgaattggaggagagggagaggtgctcatcaactctcaacaatagaggaaggatgcaagaaatcacaggggcgagcgaggtggtcctaggctttggcaacggaggaggatacggcggcggcaactactactgccaagaacaatgggaactcggtggagtcgtctttcagcagaactcacgcttctactga

SEQ ID NO: 15005 - protein, 370 aa, Sorghum bicolor
  misc_feature: Useful for making plants with modulated biomass
  misc_feature: Functional homolog of the protein sequence given in SEQ ID NO 14122
  misc_feature: Ceres ANNOT ID no. 8633176
  misc_feature (101)..(343): Pfam ID: TCP Pfam Description: TCP family transcription factor
MDLPLYQQLQLSPPSPKPDQSSSFYCCYPCSPPFAAAAADASFHLSYQIGSAAAAIPPQAVINSPEDLPVQPLMEQAPAPPTELVACASGGAQGAGVSVSLDRAAAAAAARKDRHSKICTAGGMRDRRMRLSLDVARKFFALQDMLGFDKASKTVQWLLNTSKAAIQEIMADDVDASSECVEDGSSSLSVDGKHNPAEQLGDQKPKGNGRSEGKKPAKSRKAATTPKPPRKSGNNAHPVPDKETRAKARERARERTKEKHRMRWVKLASAIDVEAAAASVASDRPSSNHLNHHHHSSSSMNMPRAAEAELEERERCSSTLNNRGRMQEITGASEVVLGFGNGGGYGGGNYYCQEQWELGGVVFQQNSRFY

SEQ ID NO: 15006 - DNA, 1515 bp, Sorghum bicolor
  misc_feature: Ceres ANNOT ID no. 8633206
  misc_feature: Encodes the peptide sequence at SEQ ID NO 15007
atggacgctcggtgggcggtgctgctcgcgctgctggtcgccagcggcggcggcggcggtgtccgtgtctgcgccgcgggggcgaagggcgccaactggctgggcgggctgagccgcgcgtcgttccccaaggggttcgtgttcgggacggcgacgtcggcgtaccaggtcgagggcgccgcgtccaccaacggccggggaccctccatctgggattcattcgcgcacgtcccaggaaatattgcggggaatcaaaatggagacgttgcagtggatcaataccatcgctacaaggaagatgttgatctcatgaagagtttgaattttgatgcctaccggttttcaatctcgtggtccaggatcttcccagatggcgaggggaaagtcaatccagaaggtgtagcatattacaataatctgataaactatctgcttcagaaaggcatgactccttacatcaacctttaccactatgatcttcctcttgcgcttgagaagaaatatggagggtggttaagcgctaagatggcggacctgtttacagactatgctgacttctgttttaagacctacggtgatcgcgtaaagcactggtttacattcaatgagccaaggatagcagcgctacttggctatgacgtgggatcaaatcctcctcaaaggtgcaccaaatgtgctgctggtgggaattcagcaaccgaaccttatattgttgctcataattttctcttggcacatgctgctgcagttgcaagataccgtacaaaatatcaggctgcccagaagggtaaggttggaattgtcctggacttcaactggtatgaagctcttacaaactcacctgatgaccaagcagcagcccaaagagctagggacttccacattggctggtttgttgatccattgataaatggacattatccacaaataatgcaagatcttgtgaaagagaggctacccaggttcactcctgagcaagctaaattggtcaagggctcggcagactacattggtatcaatgaatacacatccagctacatgaagggacagaaactgctccagcagacgcccagtagctactctgccgattggcaggtccaatatgtttttgcacgcaatggcaaaccaattggaccaaaggcgaattctaattggctttacatcgtcccgacggggatgtatggatgtgtgaactacctcaaggagaagtatgggaatccaactgtctacattaccgagaatggaatggatcagcctggaaacttgacccgtgaccagtacctgcgcgatgccacaagggtgcggttctacagaagctacattggccagctgaaaaaagccatagatcagggcgcaaacgtggctggctacttcgcctggtctctccttgacaacttcgagtggctgtcaggatactcgtccaagtttggcatcgtctacgttgacttcaatacgctcgaacggcaccccaaggcgtcggcctactggttcagggacatgcttcagaagcattga

SEQ ID NO: 15007 - protein, 504 aa, Sorghum bicolor
  misc_feature: Useful for making plants with altered cell wall content and/or composition
  misc_feature: Functional homolog of the protein sequence given in SEQ ID NO 14123
  misc_feature: Useful for making plants with altered carbohydrate content
  misc_feature: Functional homolog of the protein sequence given in SEQ ID NO 14124
  misc_feature: Ceres ANNOT ID no. 8633206
  misc_feature (34)..(482): SWISSPROT Homolog: EC 3.2.1.21 Beta-glucosidase
  misc_feature (38)..(504): Pfam ID: Glyco_hydro_1 Pfam Description: Glycosyl hydrolase family 1
MDARWAVLLALLVASGGGGGVRVCAAGAKGANWLGGLSRASFPKGFVFGTATSAYQVEGAASTNGRGPSIWDSFAHVPGNIAGNQNGDVAVDQYHRYKEDVDLMKSLNFDAYRFSISWSRIFPDGEGKVNPEGVAYYNNLINYLLQKGMTPYINLYHYDLPLALEKKYGGWLSAKMADLFTDYADFCFKTYGDRVKHWFTFNEPRIAALLGYDVGSNPPQRCTKCAAGGNSATEPYIVAHNFLLAHAAAVARYRTKYQAAQKGKVGIVLDFNWYEALTNSPDDQAAAQRARDFHIGWFVDPLINGHYPQIMQDLVKERLPRFTPEQAKLVKGSADYIGINEYTSSYMKGQKLLQQTPSSYSADWQVQYVFARNGKPIGPKANSNWLYIVPTGMYGCVNYLKEKYGNPTVYITENGMDQPGNLTRDQYLRDATRVRFYRSYIGQLKKAIDQGANVAGYFAWSLLDNFEWLSGYSSKFGIVYVDFNTLERHPKASAYWFRDMLQKH

SEQ ID NO: 15008 - DNA, 918 bp, Sorghum bicolor
  misc_feature: Ceres ANNOT ID no. 8633204
  misc_feature: Encodes the peptide sequence at SEQ ID NO 15009
atggttgctgctcggtgggcgggggcgctgctgctcgcgctgctggtggtggcgtgcggcggcgcgcgtgcaggtgcagcggcagcggcggcggccgggggaggaggagccggagcgagctggctgggcgggctcagccggccggcgttccccaggggcttcgtgttcgggaccgcgacgtcggcgtaccaggtcgagggcgccgcgtccaccaacggccgcggcccctccacctgggacccgttcgtgcacaccccaggaaatattgtagggaatcagactgcagacgtcgcagtggatcagtatcatcgctacagggaagatgttgacctcatgaaaagtttgaattttgatgcctaccggttttcaatctcatggtccaggatcttcccagatggcgagggaagagtcaatccagaaggtgttgcttattacaaaaatttgataagctacctgcttcagaaaggcattactccatacgccaatctttaccactccgatcttcctcttgcgcttcagaacaaatatggaggatggttaaaccccaagatggcgaaactgttcacagactatgctgacttctgttttaagtcttttggagatcatgtaaagcattggtttacattcaatgagccaaggatagtagcactacttggttatgatggtgggtcgattcctcctcaaaggtgtaccaaatgtgctgctggtgggaattcagcaacggaaccttatatcgttgctcataattttctcttgtcacatgctgctgcggtggcaagataccgtaataagtatcaggctgctcagaaaggaaaggttggaatagttctggacttcaattggtacgaacctctcacaaactcaactgaagaccaagcagcggctcagagagcaagggatttccatgttggttggtaa

SEQ ID NO: 15009 - protein, 305 aa, Sorghum bicolor
  misc_feature: Useful for making plants with altered cell wall content and/or composition
  misc_feature: Functional homolog of the protein sequence given in SEQ ID NO 14123
  misc_feature: Useful for making plants with altered carbohydrate content
  misc_feature: Functional homolog of the protein sequence given in SEQ ID NO 14124
  misc_feature: Ceres ANNOT ID no. 8633204
  misc_feature: Down-regulated in shoot tissues in response to salicylic acid treatment
  misc_feature (47)..(304): SWISSPROT Homolog: EC 3.2.1.21 Beta-glucosidase
  misc_feature (46)..(305): Pfam ID: Glyco_hydro_1 Pfam Description: Glycosyl hydrolase family 1
MVAARWAGALLLALLVVACGGARAGAAAAAAAGGGGAGASWLGGLSRPAFPRGFVFGTATSAYQVEGAASTNGRGPSTWDPFVHTPGNIVGNQTADVAVDQYHRYREDVDLMKSLNFDAYRFSISWSRIFPDGEGRVNPEGVAYYKNLISYLLQKGITPYANLYHSDLPLALQNKYGGWLNPKMAKLFTDYADFCFKSFGDHVKHWFTFNEPRIVALLGYDGGSIPPQRCTKCAAGGNSATEPYIVAHNFLLSHAAAVARYRNKYQAAQKGKVGIVLDFNWYEPLTNSTEDQAAAQRARDFHVGW

SEQ ID NO: 15010 - DNA, 1704 bp, Sorghum bicolor
  misc_feature: Ceres ANNOT ID no. 8633203
  misc_feature: Down-regulated in shoot tissues in response to salicylic acid treatment
  misc_feature: Encodes the peptide sequence at SEQ ID NO 15011
atgggcgccgccgccgcggggcctgctgcggctccgccggcgacgacgcattgccgctgcatccagctactgctgctggcgctggccgtcgtgccgctcggcagccgcgggcttcgcgtccgagccgtcggggcggacacgggagggctgagccgggacgcgttccccaaggggttcatcttcgggacggcgacgtccgcgttccaggtcgagggcgcggccacgtccggcggccgcgggccctgcatctgggatcccttcgtccacacccccggaaagattgctgaagacgggaacgcagatgttacaacagatgaatatcatcgctacaaggaagatgttgatctcatgaaaagcctaaattttgatgcataccggttttcaatctcctggtccaggatcttcccagatggcgaagggaaagttaatgaagaaggagtgcagtattacaacgatcttatagactacatgattaagcaaggtcttactccttacgccaaccttaaccactatgatcttccacttgcgcttcagaaaaagtaccaaggctggttaggcccaaaaattgtggatatattcgctgactatgccgatttttgtttcaagacttttggcgatcgagtcaagaactggttcacattaaatgagccaaggatagtatcattccttggttatgataaagggattgacccccctaatcggtgcacacaatgcactgccggtgggaactcatcgacagaaccttacattgttgttcataacatcctcttatctcatgctactgctgttgcaagataccgcaataaataccaggcaactcagaaaggcaaggttgggatagttctagacttcaactggtatgaacctcttaccaactcaaccgaagatcaagcagcagcgcaaagggccagggatttccatattggttggtttcttgatccattaataaatggacaatatccaaagacaatgcaggacattgtgaaagatcggctaccaagtttcacacctgaacaggctaagctagtcaagggctcatcagactatttcgggatcaatcaatatacaacaaactacatttcaaatcaacaaactactcagcaaggaccaccaagctactcgtctgactggggtgttcaatataactttgaaagaaatggcgtgcagattggacagctggcacactcagtctggctttacatcgtcccaacgggcatgtatggagtcgtcacctacctaaaggaaaagtaccagaatccaaccatcatcatatcggaaaacgggatggatcaacctggagacctgacacgcgaggagtaccttcacgacacggttcggatcgacttctacaagaactacctgacggagctgaagaaagggatcgacgacggcgcaaacgtggtgggctacttcgcgtggtccctcctggacaacttcgagtggctgtcgggctacacgtccaagttcggcatcgtctacgtcgacttcacgacgctgaagcggtaccccaaggactcggcgtactggttcagggacatgctctcagggacgggctcgaaggccgccgccgccccgcagaccggttcaggcacccgtccggctgtctcggcttcggccacctcgaatggcgctgcccttctggtctctctgttcgtctccttgtgtgtcctgcttccatccgtcttcatggtttcctcagtttaa

SEQ ID NO: 15011 - protein, 567 aa, Sorghum bicolor
  misc_feature: Useful for making plants with altered cell wall content and/or composition
  misc_feature: Functional homolog of the protein sequence given in SEQ ID NO 14123
  misc_feature: Useful for making plants with altered carbohydrate content
  misc_feature: Functional homolog of the protein sequence given in SEQ ID NO 14124
  misc_feature: Useful for making plants with altered oil content
  misc_feature: Functional homolog of the protein sequence given in SEQ ID NO 14125
  misc_feature: Ceres ANNOT ID no. 8633203
  misc_feature (46)..(495): SWISSPROT Homolog: EC 3.2.1.21 Beta-glucosidase
  misc_feature (51)..(519): Pfam ID: Glyco_hydro_1 Pfam Description: Glycosyl hydrolase family 1
MGAAAAGPAAAPPATTHCRCIQLLLLALAVVPLGSRGLRVRAVGADTGGLSRDAFPKGFIFGTATSAFQVEGAATSGGRGPCIWDPFVHTPGKIAEDGNADVTTDEYHRYKEDVDLMKSLNFDAYRFSISWSRIFPDGEGKVNEEGVQYYNDLIDYMIKQGLTPYANLNHYDLPLALQKKYQGWLGPKIVDIFADYADFCFKTFGDRVKNWFTLNEPRIVSFLGYDKGIDPPNRCTQCTAGGNSSTEPYIVVHNILLSHATAVARYRNKYQATQKGKVGIVLDFNWYEPLTNSTEDQAAAQRARDFHIGWFLDPLINGQYPKTMQDIVKDRLPSFTPEQAKLVKGSSDYFGINQYTTNYISNQQTTQQGPPSYSSDWGVQYNFERNGVQIGQLAHSVWLYIVPTGMYGVVTYLKEKYQNPTIIISENGMDQPGDLTREEYLHDTVRIDFYKNYLTELKKGIDDGANVVGYFAWSLLDNFEWLSGYTSKFGIVYVDFTTLKRYPKDSAYWFRDMLSGTGSKAAAAPQTGSGTRPAVSASATSNGAALLVSLFVSLCVLLPSVFMVSSV

SEQ ID NO: 15012 - DNA, 1908 bp, Sorghum bicolor
  misc_feature: Ceres ANNOT ID no. 8633223
  misc_feature: Encodes the peptide sequence at SEQ ID NO 15013
atggacggatgtgattgcatcgagccactatggcctactgatgatcttctcgtcaagtatcagtacatctcagacttcttcatagctctcgcgtacttctcaatcccattggagctcatctattttgtgaagaagtcgtccttcttcccgtacagatgggtcttgatccagtttggtgcgtttatagttctctgtggggcgacccatctgataaacctgtggactttcaccacacatacaaagaccgttgcgatggtcatgaccatagcaaaggtttctacagcagttgtgtcctgtgcaactgctttgatgcttgttcatatcatccccgacttgttgagtgtgaaaactagggagttgttcctcaagaataaagctgaacagcttgatagagagatgggactgataaggacgcaggaggagaccggtaggcatgttaggatgcttacacatgaaatcagaagtactcttgataggcatacaattttgaagactactcttgttgagctaggaaggaccttgggtctggaagaatgtgcattgtggatgccatctcgaagtggttcaagccttcagctttctcatactctgcgccaccagattactgtcggatcatcagtgccaattaatcttcctgtcgtcaatcaagtgttcagtagcaaccgagcaattataataccccacacatctcctttggcgcggattcgacctcttgcagggcgatatgttccgccagaagtggctgcagtccgtgtacctcttctacacctttcaaacttccaaataaatgattggcctgagctttcagcgaaaagctttgcaatcatggttttgatgcttccatctgatagtgcaagaaaatggcatgtgcatgaattggagctggttgaggtcgttgctgatcaggtagcagttgcactatctcatgcagcgattcttgaagagtccatgagagcacgtgatttactaatggagcagaatgttgccttggatttagctcgaagagaggccgagatggctatccgtgctcgcaatgatttcctagctgttatgaatcacgaaatgagaacacccatgaatgcaataatagccctttcctccttgcttttggaaactgagcttactcctgagcagcgtctaatggtggaaacagtactgaaaagcagcaatctgttagcaacactcatcaatgatgtgctggatctttccaaacttgaggatggaagccttgaattggagattaaagcattcaatcttcatgctgttttcaaagaagtgatgagtttcattaaaccaattgcatctatcaagaggctatctgtatcggttatgttggcaccagatttgccgttatgtgctattggtgatgaaaagagactcatgcaaactattctgaacatatctggcaacgctgtaaagtttaccaaggagggacacatcacgcttgtagcttccattgtgaaggctgactctctgagagagttcagaaccccagaatttcatccaactgcaagtgatgaccatttctatttgaaagttcaggtaaaagatacaggctgtggaattagtcctcaggatctacctcatgtatttacaaagtttgctcatcctcaaagtggaggaaaccgagggttcaatggtagtggtcttggccttgccatctgcaaaaggtttgttagtctcatgggagggcacatctggatcgacagcgaaggaactggaagaggttgcaccgcaacattcgtcatcaagctcggcgtgtgtgacaacacaaacacctaccagcagcagttgatccctctagtctggccaagcagtgcagactctgatttgtctgctcctaaagtgcttcccgacgggagagggtctgctacttccctgaaatctcggtaccaaagaagcgtatga

SEQ ID NO: 15013 - protein, 635 aa, Sorghum bicolor
  misc_feature: The sequence is a functional homolog of SEQ ID NO 6 in US patent 7105654
  misc_feature: Useful for making plants with modulated biomass
  misc_feature: Useful for making plants with modulated biotic stress sensitivity
  misc_feature: Useful for making plants with modulated light response
  misc_feature: Useful for making plants with modulated root development
  misc_feature: Useful for making plants with modulated salt sensitivity
  misc_feature: Functional homolog of the protein sequence given in SEQ ID NO 13935
  misc_feature: Ceres ANNOT ID no. 8633223
  misc_feature (1)..(625): SWISSPROT Homolog: EC 2.7.13.3 Histidine kinase
  misc_feature (455)..(586): Pfam ID: HATPase_c Pfam Description: Histidine kinase-, DNA gyrase B-, and HSP90-like ATPase
  misc_feature (158)..(307): Pfam ID: GAF Pfam Description: GAF domain
  misc_feature (343)..(408): Pfam ID: HisKA Pfam Description: His Kinase A (phosphoacceptor) domain
MDGCDCIEPLWPTDDLLVKYQYISDFFIALAYFSIPLELIYFVKKSSFFPYRWVLIQFGAFIVLCGATHLINLWTFTTHTKTVAMVMTIAKVSTAVVSCATALMLVHIIPDLLSVKTRELFLKNKAEQLDREMGLIRTQEETGRHVRMLTHEIRSTLDRHTILKTTLVELGRTLGLEECALWMPSRSGSSLQLSHTLRHQITVGSSVPINLPVVNQVFSSNRAIIIPHTSPLARIRPLAGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMSFIKPIASIKRLSVSVMLAPDLPLCAIGDEKRLMQTILNISGNAVKFTKEGHITLVASIVKADSLREFRTPEFHPTASDDHFYLKVQVKDTGCGISPQDLPHVFTKFAHPQSGGNRGFNGSGLGLAICKRFVSLMGGHIWIDSEGTGRGCTATFVIKLGVCDNTNTYQQQLIPLVWPSSADSDLSAPKVLPDGRGSATSLKSRYQRSV

SEQ ID NO: 15014 - DNA, 1380 bp, Sorghum bicolor
  misc_feature: Ceres ANNOT ID no. 8633217
  misc_feature: Encodes the peptide sequence at SEQ ID NO 15015
atgcacatcgtcatcttcccgtggctcgctttcggccacctgcttccctgcctcgagctcgctgagcgtctggccgcgcgcggtcaccgcgtgtcgttcgtttccacgccgcgcaacctcgagcgactcccgtccgtgcctcccgcgctggcgccgctcgtcgagctcgtcgcgctgccgctcccgcgcatcgacggcctcccggacggcgccgagtccaccagcgacgtgccatacgacaagttcgagctccacaggaaggccttcgacggcctcgccgcgccgttcgcggcgttcctcgacgccgcgtgcgcggcggtggatggtggagccaggaggaggcccgactgggtcatcgccgactttatccaccactgggtcgccgctgctgcccaggaccgcaacgttccatgcgccatgctcgtcccgtgcgccgcaagcatcgcgggctccgccggcccgccgccgccggtggactcggacgcggagcaacggcaggcgatcgaccagtccatgagcgcggcaccaccgttcgagcagcagcaggccgcggagcttttcgccaccgtgggcgactcggggccgtccatcatcagccgcttcgtccagacgctggcgaggtccaggttcttcgccgctcggagctgtcccgagctggagccggaagcgttcccgctcctgacgaggctctacggcaagccggccgtcccgctcggcatgctgccgccgcagcccgacggaacgcgcggcgtcagctggagcacggaggacgacgactcgaccatgcggtggctcgacgcgcagcccgccaagtcggtcgtgtacgtcgcgttgggaaccgaggcgccgctgcgtgtcgagctgctccgcgagcttgcccacggcctggagctcgccgggacgcgcttcctctgggccctgaggacgccggtcggcgtccaagaagacggcatcgtacccgacgggttcgtggagcgcaccggcgaccgtgggctcgtggcgacgcggtgggttcctcaggtcagagtgctggcgcacggcgccgtcggcgcgttcctgacgcactgcgggtggggttccatcgtcgaggggctccagttcgggcacccgctgatcatgctgcccatcttcggcgaccaaggccccaacgcgcggctcatggaggggtggaaggtcgggttgcaggcagcgaggaacgagacggacggatctttcgaccggcacggcgttgccggagcagttcgggccgtcgcggcggaggaggaggggaaggtgttggcgaccaacgctaggaagctgcagcacatcgtggcggacagagcgtgccaagagaggtgcatcgacgtgtttattcagcatttgagatcctgcaagggatga

SEQ ID NO: 15015 - protein, 459 aa, Sorghum bicolor
  misc_feature: Useful for making plants with altered carbohydrate content
  misc_feature: Functional homolog of the protein sequence given in SEQ ID NO 14126
  misc_feature: Ceres ANNOT ID no. 8633217
  misc_feature (193)..(407): SWISSPROT Homolog: EC 2.4.1.115 Anthocyanidin 3-O-glucosyltransferase
  misc_feature (1)..(458): Pfam ID: UDPGT Pfam Description: UDP-glucoronosyl and UDP-glucosyl transferase
MHIVIFPWLAFGHLLPCLELAERLAARGHRVSFVSTPRNLERLPSVPPALAPLVELVALPLPRIDGLPDGAESTSDVPYDKFELHRKAFDGLAAPFAAFLDAACAAVDGGARRRPDWVIADFIHHWVAAAAQDRNVPCAMLVPCAASIAGSAGPPPPVDSDAEQRQAIDQSMSAAPPFEQQQAAELFATVGDSGPSIISRFVQTLARSRFFAARSCPELEPEAFPLLTRLYGKPAVPLGMLPPQPDGTRGVSWSTEDDDSTMRWLDAQPAKSVVYVALGTEAPLRVELLRELAHGLELAGTRFLWALRTPVGVQEDGIVPDGFVERTGDRGLVATRWVPQVRVLAHGAVGAFLTHCGWGSIVEGLQFGHPLIMLPIFGDQGPNARLMEGWKVGLQAARNETDGSFDRHGVAGAVRAVAAEEEGKVLATNARKLQHIVADRACQERCIDVFIQHLRSCKG

SEQ ID NO: 15016 - DNA, 2682 bp, Sorghum bicolor
  misc_feature: Ceres ANNOT ID no. 8633241
  misc_feature: Encodes the peptide sequence at SEQ ID NO 15017
atgctgcttcacgcgttcgcggaccggctgacggggaagaacaaggcggcgtggaacgagggccggatccggggcaccgtggtgctggtgaagaaggacgcgctcgacttgggccacttccaggcgtcgctcctcgacggcatccaccagatcctcggccaggacaccggcctcaccttccagctcgtcagcgccaccaaggccgaccaccgcaatggggggcgaggcaaggttgggaaggcggcgcacctggaggaggtggtggtgtcgctcaagtccaggacggacggggagacggtgttccgggtgaacttcgagtgggacgagtcgcaggggatccccggcgccgtcctcgtcaggaaccaccagaccgaggaggtgttcctcaagacgctcaccctggagggcgtccccggcaagggcaccgtcgtcttcgtcgccaactcctgggtccacaaccacaggagctacacccaagaccgcgtcttctttgccaacgacacgtatctgcccagcaaaatgcctgccccgttggtgccttaccggcaagatgaactcaaacttctccgaggcgacaacaaccatgggccatacaagaagcacgaccgtgtgtaccgctacgactactacaacgaccttggtgacccagacaagagcaaagacgacgcacgtccggtccttggtggcaccccagatcacccatatccccgccgctgcagaaccggccgggccccaaccaaaaccgaccccaagtcagagagcaggcttaatctcctgcagatcctggccctggacgtctacgtccctcgcgacgaacgatttgggcatctcaagatggacgacttccgtggctactctctgaagacggtagtcgaggctgttcttccgttgataaatacaaaattcgacatcgtcggcgtaccggaggagttcgattcctttgaagacatcctgaggctctatgaacttggtccggaagcgccgaatcacccgatactggctgagatcaggaagaagatccccagtgagttccttagaagccttctgccggttggtggccacgacgaccctctgaagatgccccttccacatgtcatccaatcagacgcgcgaaacaaggctccacaagataagtatggctggaggactgatgaggagtttgcgcgggaaacgcttgcaggcgtgaacccagtggttatcagacgactagagacgttccctgctacaagtactctggatccaagagtgtatggtgaccataccagcaagataaccgaggctcacattcagcacaacctggaaggcctgacagtgcacgatgcactgaggaagaacaggctcttcatcctagaccaccacgaccacttcatgccgtacctggaccggatcaacaagctggaaggcaacttcatctacgccaccaggacgctgctgttcctgaaagacgatgacacgctgaagcccatcgccatcgagctcagcttgcccaacccaaaaggccagcggcatggcgcggtgagcaaggtgtatactcctgcccacacaggcgtgcagcaccacatctggcagctcgccaaagcctacgcctgcgtcaatgactcgggctggcatcagctcatcagccactggctgaacacgcacgcggtgatggagccgttcgtgatcgccacgaaccggcagctcagcgcggtgcaccccgtgcacaagctgctgcgcccgcacttccgcgacaccatgaccatcaacggcctggcgcggcagacgctcatcaacggcggcggcatcttcgagttcaccgtgttcccgggcaggtacgcgctcgagatgtcctccgacgtgtacaagaactggaacctcaccgagcaggccctccccaacgatctcatcaagagaggcgtcgccgtggcggacgggaggagcccgttcggcgtccgcctgctgatcaaggactacccgtacgccaaggacgggctgatggtgtggtgggcgaccgagcagtgggtgaaggagtacctgagcatctactacccccacgacatcgacgtccggcgcgacacggagctgcaggcgtggtggacggaggtccgcgaggtcgggcacggcgacctcatggaccgcgactggtggcccaagatgaacaccgtcagggagctggccaggacgtgcaccaccatcatctgggtggcgtcggcgctgcacgccgccgtcaacttcgggcagtacccgtacgcggggtacctgccgaaccggccgaccgtgagccggcggccgatgccggagcccggcagcgacgactacaggaagctggagacggggtcgcagaaggaggcggacacggtgttcatccgcaccatcaccagccagcgccagaccatcgtgggcatctcgctcatcgagatcctgtccaagcacgcctccgacgaggtgtacctcggccagcgcgacgagccggagcgctggacgtcagacgccaaggcgctggacgcgttcaagaggttcggcagccggctggtggagatcgagaagcggatcgagaagatgaacgctgacccggcgctcaagaaccggaacgggccggtgaaggttccctacatgctgctgtaccccaacacgtcggacgccaccggcgagaagggcgaggggcttactgccatgggcatccccaacagcatctctatctga

SEQ ID NO: 15017 - protein, 893 aa, Sorghum bicolor
  misc_feature: Useful for making plants with altered lignin content
  misc_feature: Functional homolog of the protein sequence given in SEQ ID NO 13126
  misc_feature: Ceres ANNOT ID no. 8633241
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (10)..(893): SWISSPROT Homolog: EC 1.13.11.12 Lipoxygenase
  misc_feature (175)..(870): Pfam ID: Lipoxygenase Pfam Description: Lipoxygenase
  misc_feature (58)..(163): Pfam ID: PLAT Pfam Description: PLAT/LH2 domain
MLLHAFADRLTGKNKAAWNEGRIRGTVVLVKKDALDLGHFQASLLDGIHQILGQDTGLTFQLVSATKADHRNGGRGKVGKAAHLEEVVVSLKSRTDGETVFRVNFEWDESQGIPGAVLVRNHQTEEVFLKTLTLEGVPGKGTVVFVANSWVHNHRSYTQDRVFFANDTYLPSKMPAPLVPYRQDELKLLRGDNNHGPYKKHDRVYRYDYYNDLGDPDKSKDDARPVLGGTPDHPYPRRCRTGRAPTKTDPKSESRLNLLQILALDVYVPRDERFGHLKMDDFRGYSLKTVVEAVLPLINTKFDIVGVPEEFDSFEDILRLYELGPEAPNHPILAEIRKKIPSEFLRSLLPVGGHDDPLKMPLPHVIQSDARNKAPQDKYGWRTDEEFARETLAGVNPVVIRRLETFPATSTLDPRVYGDHTSKITEAHIQHNLEGLTVHDALRKNRLFILDHHDHFMPYLDRINKLEGNFIYATRTLLFLKDDDTLKPIAIELSLPNPKGQRHGAVSKVYTPAHTGVQHHIWQLAKAYACVNDSGWHQLISHWLNTHAVMEPFVIATNRQLSAVHPVHKLLRPHFRDTMTINGLARQTLINGGGIFEFTVFPGRYALEMSSDVYKNWNLTEQALPNDLIKRGVAVADGRSPFGVRLLIKDYPYAKDGLMVWWATEQWVKEYLSIYYPHDIDVRRDTELQAWWTEVREVGHGDLMDRDWWPKMNTVRELARTCTTIIWVASALHAAVNFGQYPYAGYLPNRPTVSRRPMPEPGSDDYRKLETGSQKEADTVFIRTITSQRQTIVGISLIEILSKHASDEVYLGQRDEPERWTSDAKALDAFKRFGSRLVEIEKRIEKMNADPALKNRNGPVKVPYMLLYPNTSDATGEKGEGLTAMGIPNSISI

SEQ ID NO: 15018 - DNA, 2619 bp, Sorghum bicolor
  misc_feature: Ceres ANNOT ID no. 8633244
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 15019
atgctgctgggcgggatcatcgatgggctgacgggggcgaacaagcatgcgcggctcaagggcacggtggtgctcatgcgcaagaacgtactcgacctcaacgacctcggcgccaccgtcatcgacggcatcagcgagttcctcggcaagggggtcacctgccagctcatcagctccaccctcgtcgacgccaacaacggcaaccgcgggcgtgtcggggcggaggcgaacctggagcagtggctgacgagcctgccgtcggtgacgaccggcgagtccaagttcggcgtcacgttcgactgggaggtggcgaagctgggcgtgccgggggcggtcatcgtcaagaacaaccacacgtccgagttcttcctcaagaccatcacgctcgacgacgtccccggacgcggcaccgtcaccttcgtcgccaactcgtgggtctaccccgtcggcaagtaccgctacagccgcgtcttcttctccaacgatacgtacctgccgagccagatgccgccggcgctgaagccgtaccgcgacgacgagctccgcaacctccgcggcgacgaccagcagggcccctaccaggagcacgaccgcgtgtaccgctacgacgtctacaacgacctcggcgagcctgacggcggcaacccgcgccccatcctcggcggctccgccgaccacccctacccgcgccgctgccgcacgggccgcaagcccaccaaaaccgaccccaactcggagagccggctgtcgtcgctgctggagaagatctacgtgccgcgggacgagcggttcggccacctcaagatgtccgacttcctgggccacgccatcaaggcgatcgcgcaggggatcatcccggcggtgcgcacgtacgtggacaccagccccaaagagttcgactcgttccaggacatcatcaacctgtacgagggcgggatcaagctgcccaagatccaggcgctcgaggacatgcgcaagctcttcccgctccagctcgtcaaggacctcctccccgccggcggcgactacctgctcaagctccccatcccggagatcatcaaaggcacggctgtccatctgcagagcaaggatgcgtggaggaccgacgaggagttcgcgcgggaggtgctcgccggcgtcaacccggtggtgatcacgcgcctcacggagttcccgccgaagagcacgctcgaccccagcaagtacggcgaccacaccagcacgatcacggcggagcacatcgagaagaacctggagggcctcacggtgcagcaggcgctggacggcaacaggctctacatcctggaccaccacgaccggttcatgccgttcctgatcgacgtcaacaacctggagggcaacttcatctacgccaccagggcgctcttcttcctgcgcgccgacggcaggctcgcgccgctcgccatcgagctcagcgagccgtacatcgacggtggcctcaccaaggccaagagcaaggtctacacgccggcgtccgcaggcgtcgaggcctgggtgtggcagctcgccaaggcctatgtcgccgtcaacgactccggctggcaccaactgatcagccactggctgaacacgcacgcggtgatggagccgttcgtgatcgcgacgaaccggcagctgagcgtgacgcacccggtgcacaagctcctgcacccgcacttccgcgacaccatgaccatcaacgcgctggcgcggcagacgctcatcaacggcggcggcatcttcgagctgaccgtgttcccgggcaagtacgcgctggccatgtcctccgtggtgtacaaggactggaacttcacggagcagggcctccccgccgacctcgtcaagcggggggtggcggtggaggacccgtcgagcccctacaaggtgcggctgctgatccaggactacccgtacgcgagcgacgggctggcgatctggcacgccatcgagcagtgggtgggcgagtacctggccatctactacccggacgacgccgcgctgcgtggcgacgaggagctgcaggcgtggtggaaggaggtgcgcgaggtcgggcacggcgacctcaaggacgcggcctggtggcccaagatgcaggccgtgtcggagctcgccagcgcctgcaccaccatcatctggatcgcgtcggcgctgcacgccgccgtgaacttcggccagtacccgtacgcggggtacctgccgaaccggcccacggtgagccggcgccggatgccggagcccggaagcaaggagtacgaggagctggagcgctacccggagcgcggcttcatccacaccatcacgagccagatccagaccatcatcggcatctcgctcatcgagatcctctccaagcactcctccgacgaggtgtacctcgggcagcgcgacacccccgagtggacctccgacgccaaggcgaaggcggcgttcaagcggttcagcgacgcgctggtggcgatcgagggcaaggtggtgggcgagaaccgcgacccgcagctcaagaacaggaacgggcccgccgagttcccctacatgctgctgtaccccaacacctctgaccacagtggcgccgccgctgggctcaccgccaagggcattcccaacagcatctccatctga

SEQ ID NO: 15019 - protein, 872 aa, Sorghum bicolor
  misc_feature: Useful for making plants with altered lignin content
  misc_feature: Functional homolog of the protein sequence given in SEQ ID NO 13126
  misc_feature: Ceres ANNOT ID no. 8633244
  misc_feature: Up-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (1)..(872): SWISSPROT Homolog: EC 1.13.11.12 Lipoxygenase
  misc_feature (170)..(850): Pfam ID: Lipoxygenase Pfam Description: Lipoxygenase
  misc_feature (52)..(158): Pfam ID: PLAT Pfam Description: PLAT/LH2 domain
MLLGGIIDGLTGANKHARLKGTVVLMRKNVLDLNDLGATVIDGISEFLGKGVTCQLISSTLVDANNGNRGRVGAEANLEQWLTSLPSVTTGESKFGVTFDWEVAKLGVPGAVIVKNNHTSEFFLKTITLDDVPGRGTVTFVANSWVYPVGKYRYSRVFFSNDTYLPSQMPPALKPYRDDELRNLRGDDQQGPYQEHDRVYRYDVYNDLGEPDGGNPRPILGGSADHPYPRRCRTGRKPTKTDPNSESRLSSLLEKIYVPRDERFGHLKMSDFLGHAIKAIAQGIIPAVRTYVDTSPKEFDSFQDIINLYEGGIKLPKIQALEDMRKLFPLQLVKDLLPAGGDYLLKLPIPEIIKGTAVHLQSKDAWRTDEEFAREVLAGVNPVVITRLTEFPPKSTLDPSKYGDHTSTITAEHIEKNLEGLTVQQALDGNRLYILDHHDRFMPFLIDVNNLEGNFIYATRALFFLRADGRLAPLAIELSEPYIDGGLTKAKSKVYTPASAGVEAWVWQLAKAYVAVNDSGWHQLISHWLNTHAVMEPFVIATNRQLSVTHPVHKLLHPHFRDTMTINALARQTLINGGGIFELTVFPGKYALAMSSVVYKDWNFTEQGLPADLVKRGVAVEDPSSPYKVRLLIQDYPYASDGLAIWHAIEQWVGEYLAIYYPDDAALRGDEELQAWWKEVREVGHGDLKDAAWWPKMQAVSELASACTTIIWIASALHAAVNFGQYPYAGYLPNRPTVSRRRMPEPGSKEYEELERYPERGFIHTITSQIQTIIGISLIEILSKHSSDEVYLGQRDTPEWTSDAKAKAAFKRFSDALVAIEGKVVGENRDPQLKNRNGPAEFPYMLLYPNTSDHSGAAAGLTAKGIPNSISI

SEQ ID NO: 15020 - DNA, 804 bp, Sorghum bicolor
  misc_feature: Ceres ANNOT ID no. 8633271
  misc_feature: Up-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 15021
atggagtcgcggccaggcgggacgaacctggtggagcccagagggcagggcgccgccgcgctgccgtccggtggccctgccgtgcagccgtggtggacgagctccggggccgtgctcggtgcagtgtcgccagccgttgtggcgcccgggagtggggtggggattggcctgtcgagcagcccggcaggtggtagtggtggtggcggcacggctaaaggagccgcgagtgacgagagcagcgaggattcacggagatctggggaaccaagagatggaagctctggtcaagaaaagaaccatgccacatcgcagatacctgctttggtgccagagtatttggcaccatactcacagctggaactgaaccaatcaattgcttctgcagcatatcagtacccagatccttactactcaggcatggttgctccctatggaagtcaagctgtggctcattttcagctacctggactaacccaatctcgaatgccattacctcttgaagtatccgaggagcctgtttatgtaaatgccaagcagtaccatggtattttaagacgacggcagtcacgtgccaaggctgaacttgagaaaaaggtggtcaaagccagaaagccataccttcatgagtctcgtcatcagcacgcgatgaggagggcaagaggaaatgggggacgcttcctaaacacaaagaaaagtgacaatggtactcccaatggtagagctgagcctaagaaaggagatggtaactccgagcatctccatgtccctcctgacttactacagctacgacagaacggggcttga

SEQ ID NO: 15021 - protein, 267 aa, Sorghum bicolor
  misc_feature: The sequence is a functional homolog of SEQ ID NO 2852 in the 10/374,780 US patent application
  misc_feature: The sequence is a functional homolog of SEQ ID NO 696 in the 10/225,066 US patent application
  misc_feature: Ceres ANNOT ID no. 8633271
  misc_feature (170)..(226): Pfam ID: CBFB_NFYA Pfam Description: CCAAT-binding transcription factor (CBF-B/NF-YA) subunit B
MESRPGGTNLVEPRGQGAAALPSGGPAVQPWWTSSGAVLGAVSPAVVAPGSGVGIGLSSSPAGGSGGGGTAKGAASDESSEDSRRSGEPRDGSSGQEKNHATSQIPALVPEYLAPYSQLELNQSIASAAYQYPDPYYSGMVAPYGSQAVAHFQLPGLTQSRMPLPLEVSEEPVYVNAKQYHGILRRRQSRAKAELEKKVVKARKPYLHESRHQHAMRRARGNGGRFLNTKKSDNGTPNGRAEPKKGDGNSEHLHVPPDLLQLRQNGA

SEQ ID NO: 15022 - DNA, 1374 bp, Sorghum bicolor
  misc_feature: Ceres ANNOT ID no. 8633314
  misc_feature: Encodes the peptide sequence at SEQ ID NO 15023
atggaggccgccgccccgtgcccgcgcgcccaccccgtggacctccgctggctgctctccgtggccgccggcggcctcttcgcgctgctgctcctgctggccacctccccgtcgttccagctcccctcctcctccgccgccacctcccgcctcttcctcacccccgcgtcccgctcctcctcggcgcgccccgcgctgcccccgctcttcgtcgagcccgcgctctcccgcccgccgcccccgcccgccgcgtccctcccgcgcttcgcctacgtcatctccgggtccgccggggacgccgggatgatgcggcgctgcctgctggcgctgtaccacccgaggaaccgctacgtgctccacctggacgcgcaggcgcccgacgccgaccgcgccgacctcgccgctttcgtcgccgcgcacccggtgctcgccgcggcggggaacgtgaaggtggtcgagaaggccaacctcgtcacctacaggggacccaccatggtgaccaccacgctgcacgccgccgcgctgctcctgtggggcgacggcaggggacgcggcggcgccgactgggactggttcatcaacctctccgcctccgactacccgctcgtcacgcaggatgatttgatgcatgtgttctccaagctgccgcgcgatctcaacttcatcgatcacacgagtaacatctcctggaaagcgtttgcgagggcgatgccggtgatcgtagacccggcgttgtacatgaagacaaagggcgacctggtctggatgccggagaggcggagcttgccgacggcattcaagctattcactggttcggcgtggatggtgctgtcccgtccgttcgtggagtacctgatctgggggtgggacaacctcccgcgcacgctgctcatgtactacgccaacttcatctcctccccggagggctacttccacacggtggcgtgcaacgccgacaagttccgcaacacgacggtgaacagcgacctgcacttcatctcctgggacaacccgccgatgcagcacccgcactacctcaccgtcgccgactgggaccgcatggtcgccagcgacgcgcccttcgcgcgcaagttcctcagggacgaccccgtgctggaccgcatcgacgccgagatcctcgggggccgggggcccggcatggtcgcgccgggaggctggtgtcaggcagcagcagctgccggcgccggcggggagaacagtaacgggaccgacgacgacccgtgcgcggcggtggggaacgccgcgttcctaaggcccggaccgggtgctgagcggctgcagaggctcgtcacgtcgctgctgtcggaggagaacttccggcccaggcagtgcgtagtagaagacgagaagtga

SEQ ID NO: 15023 - protein, 457 aa, Sorghum bicolor
  misc_feature: Useful for making plants with altered carbohydrate content
  misc_feature: Functional homolog of the protein sequence given in SEQ ID NO 13849
  misc_feature: Ceres ANNOT ID no. 8633314
  misc_feature (192)..(351): SWISSPROT Homolog: EC 2.4.2.26 Protein xylosyltransferase
  misc_feature (89)..(320): Pfam ID: Branch Pfam Description: Core-2/I-Branching enzyme
MEAAAPCPRAHPVDLRWLLSVAAGGLFALLLLLATSPSFQLPSSSAATSRLFLTPASRSSSARPALPPLFVEPALSRPPPPPAASLPRFAYVISGSAGDAGMMRRCLLALYHPRNRYVLHLDAQAPDADRADLAAFVAAHPVLAAAGNVKVVEKANLVTYRGPTMVTTTLHAAALLLWGDGRGRGGADWDWFINLSASDYPLVTQDDLMHVFSKLPRDLNFIDHTSNISWKAFARAMPVIVDPALYMKTKGDLVWMPERRSLPTAFKLFTGSAWMVLSRPFVEYLIWGWDNLPRTLLMYYANFISSPEGYFHTVACNADKFRNTTVNSDLHFISWDNPPMQHPHYLTVADWDRMVASDAPFARKFLRDDPVLDRIDAEILGGRGPGMVAPGGWCQAAAAAGAGGENSNGTDDDPCAAVGNAAFLRPGPGAERLQRLVTSLLSEENFRPRQCVVEDEK

SEQ ID NO: 15024 - DNA, 1809 bp, Sorghum bicolor
  misc_feature: Ceres ANNOT ID no. 8633309
  misc_feature: Encodes the peptide sequence at SEQ ID NO 15025
atgcgccggcaacgccgcaccgccggcggcctccgcccggtgctgctgctactccccttcgccgcgctcatttcggtcggaaccttctccctacactacgccgaccgcctcctcagctctgacacgggcacggcgcagcgggccgcttcgccgtcccggcaccagcagcagcgtcggctgcccgtctccaccctcgacgtgcgcgcgctcgacgccgccgccccggccccgccgctgcacgaggccgccgcgcgcgccttccggtccggcgggcgcctcctccgcgacgccctctcttcctccccctcgtcatccgcccccgcgccgccgcccgcggccgcgggtgccgacggcgcgacgcggtgcccggcctcgatcacgcggtcgggcgcgtatctgcacctgccctgcgggctggcgctggggtcacacgtcacgctggtcggcgcgccgcggggcggtcgaggcgcggctggcgtcgcgcagttttcggtggagctgcgcggtgaaggcgacggggacgcggcgccgacgatactgcacttcaacccgcggctcagcggggactggagccgccgcccggtgatcgagctgaatacgcgcttccgcggacaatggggacccgcgctccggtgcgagggccgcccgtcgcgccacgacgaggagaccgttgatggattagtgacatgtgaggaatggtctggaaacattggtggtgcatcagaggagttgaagagattgcagttgcagaaccgtgttgctggaaagaataacagaaattggatacattggccatatccattcttggaggaagaattgtttgttctaacactaagtactggtttagaaggctaccattttcatgttgatgggaagcatgtcgcatcttttccttatcgtgttggctttgttcttgaggatgccaaaatcttttctgtgaatggtaatattgatatcaaatcaatagtagctggttctttaccgacggctcatccaagcattgcacagagaaatctggagttgctaacagaactaaaaacccctcctcttgggaaagagaatattgagctgttcataggtgttctttcagcagggagccatttcactgagcgtatggccgtgaggagatcttggatgtctttgatgcgaaattcatcaagcatagtggcacgtttttttgttaacggcagaaaggaagtgaatgaagatttgataaaagaagcagatttcttcagggacattgtcattgtcccttttgcggatagctatgatctggttgttctgaagactgttgccatttgtgactatgtggctcatgttgttccggcgaagtatgtcatgaagtgtgatgatgatacctttgttggacttgattcggtaatggctgaagttaagaaaattccagatggcaaaagcttttatttggggaacatgaactactaccacaggccactgcgggagggaaaatgggccgtctcatatgaggagtggcccagagaagagtacccgccttatgctgatggtgcaggctatgtcgtttcttctgacattgcaaacttcgtcgcaaccgaaatgaagaatggcagactaaatctgttcaagatggaggatgtgagcatggggatgtgggtggggcaattcaacctctcgcggacggggaacgccgtggcgtacgtccacagcgccggtttctgccagtccggctgcgtcaatggctacctcaccgcgcactaccagtcgccggcgcagatggtgtgcctctgggagaagctacggcgaggcaacacatggtgctgcaacgcaaggtga

SEQ ID NO: 15025 - protein, 602 aa, Sorghum bicolor
  misc_feature: Useful for making plants with altered carbohydrate content
  misc_feature: Functional homolog of the protein sequence given in SEQ ID NO 13850
  misc_feature: Ceres ANNOT ID no. 8633309
  misc_feature (357)..(598): SWISSPROT Homolog: EC 2.4.1.134 Galactosylxylosylprotein 3-beta-galactosyltransferase
  misc_feature (130)..(324): Pfam ID: Gal-bind_lectin Pfam Description: Galactoside-binding lectin
  misc_feature (369)..(555): Pfam ID: Galactosyl_T Pfam Description: Galactosyltransferase
MRRQRRTAGGLRPVLLLLPFAALISVGTFSLHYADRLLSSDTGTAQRAASPSRHQQQRRLPVSTLDVRALDAAAPAPPLHEAAARAFRSGGRLLRDALSSSPSSSAPAPPPAAAGADGATRCPASITRSGAYLHLPCGLALGSHVTLVGAPRGGRGAAGVAQFSVELRGEGDGDAAPTILHFNPRLSGDWSRRPVIELNTRFRGQWGPALRCEGRPSRHDEETVDGLVTCEEWSGNIGGASEELKRLQLQNRVAGKNNRNWIHWPYPFLEEELFVLTLSTGLEGYHFHVDGKHVASFPYRVGFVLEDAKIFSVNGNIDIKSIVAGSLPTAHPSIAQRNLELLTELKTPPLGKENIELFIGVLSAGSHFTERMAVRRSWMSLMRNSSSIVARFFVNGRKEVNEDLIKEADFFRDIVIVPFADSYDLVVLKTVAICDYVAHVVPAKYVMKCDDDTFVGLDSVMAEVKKIPDGKSFYLGNMNYYHRPLREGKWAVSYEEWPREEYPPYADGAGYVVSSDIANFVATEMKNGRLNLFKMEDVSMGMWVGQFNLSRTGNAVAYVHSAGFCQSGCVNGYLTAHYQSPAQMVCLWEKLRRGNTWCCNAR

SEQ ID NO: 15026 - DNA, 540 bp, Sorghum bicolor
  misc_feature: Ceres ANNOT ID no. 8633318
  misc_feature: Encodes the peptide sequence at SEQ ID NO 15027
atggacgacgccacggtcgcatcgcggcagcgccagcagcagcagccggcctcgccggcgacgacgacgaaggattccagggacatgatggcggagctggacgcgccgctgcacgccctcgggttcgagatggaggagctctccccgtcgcggctcaccggccgcctccccgtcactcgcatctgctgccagccgttcaaggtgctgcacggcggcgtgtcggcgctggtggcggaggcgctggcgagcatgggcgcgcacatggcgtccgggtacagccgcgtcgccggcgtgcagctcagcatcaaccacttccgcagcgccgccctcggcgacaccgtcctcgcgcaggccgtccccgtccacgtcggacgctccacacaggtttgggaggtaaagctctggaagatggatgcatccacaggagagaaggggcctcagatcgccgaatccagagtcaccctgctgtctaacctgccgttgtcggagaagcacaagacggcaggagatgctctaaagaaatatgcatcaaaactgtag

SEQ ID NO: 15027 - protein, 179 aa, Sorghum bicolor
  misc_feature: Useful for making plants with modulated biomass
  misc_feature: Functional homolog of the protein sequence given in SEQ ID NO 13187
  misc_feature: Ceres ANNOT ID no. 8633318
  misc_feature (66)..(143): Pfam ID: 4HBT Pfam Description: Thioesterase superfamily
MDDATVASRQRQQQQPASPATTTKDSRDMMAELDAPLHALGFEMEELSPSRLTGRLPVTRICCQPFKVLHGGVSALVAEALASMGAHMASGYSRVAGVQLSINHFRSAALGDTVLAQAVPVHVGRSTQVWEVKLWKMDASTGEKGPQIAESRVTLLSNLPLSEKHKTAGDALKKYASKL

SEQ ID NO: 15028 - DNA, 1683 bp, Sorghum bicolor
  misc_feature: Ceres ANNOT ID no. 8633325
  misc_feature: Encodes the peptide sequence at SEQ ID NO 15029
atggcgattagggctggccgctcggtcctccacctcctcaccctcgccttcctcctcatcctcgccgcctcgccctgcctccaagatggccctcatctcctgagcagatcagaggaaataacacacaggaaattaagagggagaattggtgtaaggaagaaaatggaagtaatgcagcaggatgatgaagcattagttaaacttgagaacgcaggtatcgaacgctcaaaagctgttgattctgctgtgctgggaaaatacagtatctggagacgcgaaaatgaaaatgagaaggcagattcaagggttcgtctgatgcgagatcaaatgatcatggccagaatatattctgttcttgccaaatcgagggacaagcttgatctctatcaggagctgcttgcaaggctcaaggaaagccagcgctcccttggggaagctactgctgatgccgaacttcccaagagcgcttcggatagaataaaagcaatgggacaagttttatcaaaagcaagggatctattgtatgattgcaaggaaattaccgagcgtttgagagcaatgcttcagtcagcagatgagcaggtccggagcttgaagaagcagagcacctttcttagccagctggcagctaagacaatcccaaatggcatccattgtctttccatgcgcttaacaattgattattaccttctgtctccagagaaaagaaagttccccaatagtgagaatttggaaaatcctgatctttaccactatgctcttttctcggacaatgttttggcagcatcagttgtggtcaactcaaccatcatgaatgcaaaggagcctgaaaaacatgtatttcatcttgttaccgacaaactgaactttggggccatgaacatgtggtttttgctgaatccacctggggatgcaacaatccatgtggaaaatgttgatgacttcaaatggttaaactcttcttactgccctgttctgaggcagcttgagtctgcagccatgagagaatactatttcaaggccggtccgaaaacactctctgctggctcttctaatctgaagtatcgaaacccaaaatatttgtccatgctcaaccatctaagattttacctcccccaagtttatcccaagctgaataaaatccttttcctggatgatgacatagttgtccagagggatctaactggactctgggaggttgaccttaatggaaatgtaaatggagcggtggaaacatgtggagagagttttcatcgatttgacaagtacctcaatttctcaaacccaaatatttctcagaattttgatcctaatgcatgtggttgggcttatggaatgaacatgtttgatctggaagaatggaagaataaagacattactgggatttaccacaaatggcagaacatgaacgagaacaggctgctctggaaactggggacattgcctccagggcttctaactttttacaagctgacacaccctctggacaaatcatggcatgtgcttggcttagggtacaatccaaccattgagcgctcagagatagacaatgctgcggtcatccactacaatggtaacatgaagccgtggctggaaatcgcaatgacaaagtatcggccttactggacaaagtacatcaattatgagcacccgtacattcatggatgcaagatcagccaatag

SEQ ID NO: 15029 - protein, 560 aa, Sorghum bicolor
  misc_feature: Useful for making plants with altered carbohydrate content
  misc_feature: Functional homolog of the protein sequence given in SEQ ID NO 13787
  misc_feature: Useful for making plants with altered cell wall content and/or composition
  misc_feature: Functional homolog of the protein sequence given in SEQ ID NO 13838
  misc_feature: Ceres ANNOT ID no. 8633325
  misc_feature (219)..(534): Pfam ID: Glyco_transf_8 Pfam Description: Glycosyl transferase family 8
MAIRAGRSVLHLLTLAFLLILAASPCLQDGPHLLSRSEEITHRKLRGRIGVRKKMEVMQQDDEALVKLENAGIERSKAVDSAVLGKYSIWRRENENEKADSRVRLMRDQMIMARIYSVLAKSRDKLDLYQELLARLKESQRSLGEATADAELPKSASDRIKAMGQVLSKARDLLYDCKEITERLRAMLQSADEQVRSLKKQSTFLSQLAAKTIPNGIHCLSMRLTIDYYLLSPEKRKFPNSENLENPDLYHYALFSDNVLAASVVVNSTIMNAKEPEKHVFHLVTDKLNFGAMNMWFLLNPPGDATIHVENVDDFKWLNSSYCPVLRQLESAAMREYYFKAGPKTLSAGSSNLKYRNPKYLSMLNHLRFYLPQVYPKLNKILFLDDDIVVQRDLTGLWEVDLNGNVNGAVETCGESFHRFDKYLNFSNPNISQNFDPNACGWAYGMNMFDLEEWKNKDITGIYHKWQNMNENRLLWKLGTLPPGLLTFYKLTHPLDKSWHVLGLGYNPTIERSEIDNAAVIHYNGNMKPWLEIAMTKYRPYWTKYINYEHPYIHGCKISQ

SEQ ID NO: 15030 - DNA, 1761 bp, Sorghum bicolor
  misc_feature: Ceres ANNOT ID no. 8633340
  misc_feature: Encodes the peptide sequence at SEQ ID NO 15031
atgggcaacgtgtgcttctgcggcaccacctccacgtcccctgaccagcccgaacccgacgcggccacagccagcaaagcgccgccgccacatccacaaggtggccacaacaagaggccggcgacgcctccgagcagccagcaggaggagccgagcccgcggcctaccaagcccagacccaaggcgaggcccaaggcggcggctactactaagcccaacaacccgtacgactcggcgccgcccgcgtcccgcggcgttggcggcgcgtcggcgttggcggcgcgcgtgctggacggcgtggtgccgcaccacccgcggctgcgggtgacggacaagtaccacctcgggcgtgagctcgggcggggcgagttcggggtcacgcggctcgccacggaccgcgccacgcgggagcggctggcgtgcaagtccatacccaagcggcgcctgcgcacggcggtggacgtcgccgacgtgcgccgggaggtggccatcatggcgtcgctgcccgaccacccggcgctcgtgcgcctaagggcggcgtacgaggacgccgacgccgtgcacctcgtcatggagctctgcgacggcggggagctgttcgaccggatcgtggcgcgcgggaggtacacggagcgcgccgcggcggcggcggcaaggaccgtggcggaggtggtcagggcgtgccacgcgcacggggtcatgcaccgggacctcaagcccgagaacttcctgtacgcgggcaagagcgacgacgcgcagctcaaggccatcgatttcggactctccgtcttcttcaaaccaggcgagcggttcacggagatcgtgggcagcccgtactacatggcgccggaggtgcttcggcggagctacgggccggaggtggacatctggagcgccggcgtgatcctctacatcctcctctgcggcgtgcctcccttctgggcggagacggagcagggcgtggcgcgcgccatcctccgcggcaacctggacctgcagcgggagccctggccgcggatctccgacggcgccaagagcctcgtccgccagatgctccagatggaccccaagaagcgccccaccgcgcagcaagtgctcgagcacccgtggctgcagaacgcgcggaaggcgccgaacgtgccgctgggcgacgtcgtccgggcgcggctgcagcagttctccgccatgaacaagttcaagaagaaggcgatgcgggtgatcgcggagcacctgtccgtggaggaggtggaggtgatcagggacatgttcgcgctcatggacaccgacaaggacggcagggtgacgctggaggagctcaaggccgggctcaggaaggtcggctccaagctggccgagccagagatggagctgctcatggaggccgccgacgtgaacggcaacgggtacctggactacggcgagttcgtggccatcaccatccacctgcagcggctctccaacgacgcccacctccgcaaggcgttcctcttcttcgacaaggacagcagcggctacatcgagcgcgccgagctggccgacgcgctcgccgacgaggccggccacaccgacgaggccgcgctcgacaacgtcatgcaagaagtcgacaccaacaaggatgggcggatcagcttcgaggagttcgtggccatgatgaaggccggcacggactggaggaaggcgtcccggcagtactcgagggagcgcttcaagacactgagcaacagcctcatcaaggacgggtcgctccggatggcgcgatga

SEQ ID NO: 15031 - protein, 586 aa, Sorghum bicolor
  misc_feature: The sequence is a functional homolog of SEQ ID NO 2 in US patent 7084323
  misc_feature: Ceres ANNOT ID no. 8633340
  misc_feature (95)..(584): SWISSPROT Homolog: EC 2.7.11.1 Non-specific serine/threonine protein kinase
  misc_feature (113)..(371): Pfam ID: Pkinase Pfam Description: Protein kinase domain
  misc_feature (526)..(554): Pfam ID: efhand Pfam Description: EF hand
  misc_feature (418)..(446): Pfam ID: efhand Pfam Description: EF hand
  misc_feature (490)..(518): Pfam ID: efhand Pfam Description: EF hand
  misc_feature (454)..(482): Pfam ID: efhand Pfam Description: EF hand
MGNVCFCGTTSTSPDQPEPDAATASKAPPPHPQGGHNKRPATPPSSQQEEPSPRPTKPRPKARPKAAATTKPNNPYDSAPPASRGVGGASALAARVLDGVVPHHPRLRVTDKYHLGRELGRGEFGVTRLATDRATRERLACKSIPKRRLRTAVDVADVRREVAIMASLPDHPALVRLRAAYEDADAVHLVMELCDGGELFDRIVARGRYTERAAAAAARTVAEVVRACHAHGVMHRDLKPENFLYAGKSDDAQLKAIDFGLSVFFKPGERFTEIVGSPYYMAPEVLRRSYGPEVDIWSAGVILYILLCGVPPFWAETEQGVARAILRGNLDLQREPWPRISDGAKSLVRQMLQMDPKKRPTAQQVLEHPWLQNARKAPNVPLGDVVRARLQQFSAMNKFKKKAMRVIAEHLSVEEVEVIRDMFALMDTDKDGRVTLEELKAGLRKVGSKLAEPEMELLMEAADVNGNGYLDYGEFVAITIHLQRLSNDAHLRKAFLFFDKDSSGYIERAELADALADEAGHTDEAALDNVMQEVDTNKDGRISFEEFVAMMKAGTDWRKASRQYSRERFKTLSNSLIKDGSLRMAR

SEQ ID NO: 15032 - DNA, 2196 bp, Sorghum bicolor
  misc_feature: Ceres ANNOT ID no. 8633369
  misc_feature: Encodes the peptide sequence at SEQ ID NO 15033
atggagcatcgccgccgccagcagcctccagcgccctccgcgcccgcctacctcgccgcaacgctcgccttcctcaccctcgccgcggtcgcctactcccgcgtcgccttccccagcttcccgcacccgctggccacacgcgggtgccgccccgacgccgaggggtcctggtccgccggcgtcttccgcggggactcccccttctccctcaagcccatcgagcactgggggatctctagtggccctggagcggcatggccagtggcgaacccggtcgtgacgtgcgccgacgtggcgaaggttggattccctagcagcttcgtcgctaatccctttctcttcatccagggggactccatttatatgtttttcgagaccaagaaccccatttcatcacaaggcgacattgctgctgccgtgagcaaggatgccggcacaacatggcagcagctgggtgtagtgttggatgaggagtggcacctttcttatccatatgtgttcagttatggaaacgagacttacatgatgcctgaaagcagcaagaaaggaatccttaagttataccgtgccgtggactttccccttaagtgggaattagaaaaggtccttctggagaggccgcttgtagattcggtcatcatatatttcaagggttcctattggctccttggatcagatttaagttcttatggcgcaaaacagacaggtgatctctttatttggtacagcagctctcctcttggtccttggaatcgacacaagcagaacccaattcttaatacaggcaacaggccgagtgccagaaatggaggcaggccattcatttacaatgacaatctttatcgcataggaaaaatccgtggtggtggatctggctataccatccaaatattcaaagttcaattcctgacagcagatcaatacaaggaagttgcggtcccatttgtccttgacaaacccctcaaaaaccgaaatgcatggaatggtgcaaggtcccatcaccttgatgttcagcagcttccattaagtcaacattggattggggtaatggatggtgacagagtgctctcaggtgactcaattcaccgtctgacggtaggctgtatgttttatggtgctgcttgcattttggttcttctacttggtgggcttattggtgcaatcaagtgcaccttaccacttaaatggtatttaccacatactgagaagcggagtgacacctttgatatagagaagcaggtattgctgtgccataagtttagttggcttatctgcaatgtgaacaggttgggatctcttattggtgggaaaattaattacagagcttggaaagaccgagtttatatagctgttataatattgatattagtagtcctaacttttttggggactaactacatctttggtggcaatggtgcagaagaaccatatcctattaggggtaggtactcacagttcacattgttgaccatgacctatgatgcccgattttggaatctgaagatgtttgtggagcattactctaaatgtgcatcggtgagggagattgtagtggtctggaacaaaggtcgagccccagtgcaaggtgaattgaactctatggtgcctgttaggatcagagttgaaaataagaatactctgaacaacagattcaaaatagacaaagaaattaaaacgggagctgttatggagcttgatgatgatatcatgatgacatgtgatgacttagagcgtgggttcaaggtatggagggagcaccctgataggattgttggatactatccacgccttgctgagggctcgcctctagaataccgcaatgagaggtatgctcggcaacaaggaggttataacatcatactaacaggagcagcatttatggatcatgagctagcctttaagaggtactggagcaaagaggctgagataggaaggcagattgttgatagtttctttaattgtgaggatgttctcctaaatttcttatttgcgaatgcaagctcggcaagcacagtggagtatgtaaaaccagcttgggcaattgatatgtctaaattctcaggagtagccattagtcgaaacacgcaggcacattaccatgttaggagcaaatgccttgctatgttttcaggaatctttgggaatttgacttccaagaggtcttttaacagcaggggtgatggctgggatgtatag

SEQ ID NO: 15033 - protein, 731 aa, Sorghum bicolor
  misc_feature: Useful for making plants with altered carbohydrate content
  misc_feature: Functional homolog of the protein sequence given in SEQ ID NO 13847
  misc_feature: Ceres ANNOT ID no. 8633369
  misc_feature (478)..(721): SWISSPROT Homolog: EC 2.4.1.223 Glucuronyl-galactosyl-proteoglycan 4-alpha-N-acetylglucosaminyltransferase
  misc_feature (486)..(722): Pfam ID: EXTL2 Pfam Description: EXTL2, alpha-1,4-N-acetylhexosaminyltransferase
MEHRRRQQPPAPSAPAYLAATLAFLTLAAVAYSRVAFPSFPHPLATRGCRPDAEGSWSAGVFRGDSPFSLKPIEHWGISSGPGAAWPVANPVVTCADVAKVGFPSSFVANPFLFIQGDSIYMFFETKNPISSQGDIAAAVSKDAGTTWQQLGVVLDEEWHLSYPYVFSYGNETYMMPESSKKGILKLYRAVDFPLKWELEKVLLERPLVDSVIIYFKGSYWLLGSDLSSYGAKQTGDLFIWYSSSPLGPWNRHKQNPILNTGNRPSARNGGRPFIYNDNLYRIGKIRGGGSGYTIQIFKVQFLTADQYKEVAVPFVLDKPLKNRNAWNGARSHHLDVQQLPLSQHWIGVMDGDRVLSGDSIHRLTVGCMFYGAACILVLLLGGLIGAIKCTLPLKWYLPHTEKRSDTFDIEKQVLLCHKFSWLICNVNRLGSLIGGKINYRAWKDRVYIAVIILILVVLTFLGTNYIFGGNGAEEPYPIRGRYSQFTLLTMTYDARFWNLKMFVEHYSKCASVREIVVVWNKGRAPVQGELNSMVPVRIRVENKNTLNNRFKIDKEIKTGAVMELDDDIMMTCDDLERGFKVWREHPDRIVGYYPRLAEGSPLEYRNERYARQQGGYNIILTGAAFMDHELAFKRYWSKEAEIGRQIVDSFFNCEDVLLNFLFANASSASTVEYVKPAWAIDMSKFSGVAISRNTQAHYHVRSKCLAMFSGIFGNLTSKRSFNSRGDGWDV

SEQ ID NO: 15034 - DNA, 912 bp, Sorghum bicolor
  misc_feature: Ceres ANNOT ID no. 8633374
  misc_feature: Encodes the peptide sequence at SEQ ID NO 15035
atgcccgacacggacgtcgacaccgagatgcgcgaagccgccgctgccgcggccggggccccagccggcgacgacgacggcgagggagacaccgaggaggaagaggaggaggacgaggacgacgaggatgaggtcgatgaggacgatgaggaggagttgcccgccgcggcgccggcgccgaccgaagagcaacccgccccagcgcccatctcggccttgccggggaacccgaaccagctgacgctggtcttccagggcgaggtttacgttttcgaatccgtcacccccgagaaggttcaagctgtgctgctactgttgggacgcggtgaactaccacctggtttagcaggcatggttctacctaatcaaaatgagaacaagggctatgatgatatacttcggaggactgacattcccgcaaaaagggttgcttcactaatcaggttccgtgagaaaaggaaggaaagaaattttgataagaaaatacgttatgctgttcgcaaagaagtggcactcaggatgcagcgtcggaaggggcaatttgctggaagggccagtctggagggagaatctccatctcctggatttgatcctggttcacagggttcaggcctagattttgcatctcgagaatcaaagtgccataactgtggtactagtgaaaaaatgaccccagcaatgcgtcgtggtccagctggtccaaggactttgtgcaatgcttgtggattgatgtgggcaaacaagggtaccctgagaagttgccccaaggcaaaagtcgaatctcctgtggttgcaattgaacagggaatcagtgacaacaaagcgctggtgacaccgagcaatgacaatgttgctgcaagcaatggcgaagccacaattgcagcagagataggagtgcccaaggcgccgtga

SEQ ID NO: 15035 - protein, 303 aa, Sorghum bicolor
  misc_feature: Useful for making plants with altered terpenoid content
  misc_feature: Functional homolog of the protein sequence given in SEQ ID NO 12908
  misc_feature: Ceres ANNOT ID no. 8633374
  misc_feature (142)..(186): Pfam ID: CCT Pfam Description: CCT motif
  misc_feature (214)..(251): Pfam ID: GATA Pfam Description: GATA zinc finger
MPDTDVDTEMREAAAAAAGAPAGDDDGEGDTEEEEEEDEDDEDEVDEDDEEELPAAAPAPTEEQPAPAPISALPGNPNQLTLVFQGEVYVFESVTPEKVQAVLLLLGRGELPPGLAGMVLPNQNENKGYDDILRRTDIPAKRVASLIRFREKRKERNFDKKIRYAVRKEVALRMQRRKGQFAGRASLEGESPSPGFDPGSQGSGLDFASRESKCHNCGTSEKMTPAMRRGPAGPRTLCNACGLMWANKGTLRSCPKAKVESPVVAIEQGISDNKALVTPSNDNVAASNGEATIAAEIGVPKAP

SEQ ID NO: 15036 - DNA, 1023 bp, Sorghum bicolor
  misc_feature: Ceres ANNOT ID no. 8633414
  misc_feature: Encodes the peptide sequence at SEQ ID NO 15037
atggagggagccttcgacctcaacacgaggatcttcctcagcctcaactcccggcttccctacggcgacaaatcgccgcagatggatttcttcgacgccgcgttcaagggcgacctccgccgcgtcagggagatggctaggggcaaggacgcggaggggaaggcgcagctcgtggacgtctgcatcgggggccagggcccactccaagcggcggcgcgcatggggaggctagacgtcgtcaagttcatggtgaaggagctcggtttcgacatcaatctgggtagtagtggcacgggtgtgacagctttgcatgctgctgcgttggatgggaaattggacactgtaaggtatcttctggacaatggggccgatccaaataaaaaagatgaacctggtgaagttcctcttcactgtgctgcaaaatatgggcatgacgaagtagcaaaattgttgttgtctagaggagctaatgttgatatggcctattttcatggcacaccactccatattgctgctgtccatgggaaggctgatttcatgaaagttttattggagcaacatgcagatccaaacaaaatctcagaagctttaggtacaccgcttgttgcaacacttaatgctgcttctgatggacttcctgaatcaattgcattgaaatgcgtgaagctactcgtcgaggcgcgtgcggatgtgaattttgttggtccagacactcctttggtggtagcgactactcatggcttgactgattgcatcaagtacttgttgaatgctggtggtgacaaggctgttggtagaaagaactaccttgctgcatcaaagctctacactcaagcaattgagctggatcctgatgacgcaacattgtattcaaacaggagcctttgccagctacaaattggtgaggcaaacaaggctttgcttgatgccaacagttgcataaagatacggcctgaatggttgaaaggttactaccggaaaggtgttgctctcatgtcactcaaggtcgatctatcaaaatga

SEQ ID NO: 15037 - protein, 340 aa, Sorghum bicolor
  misc_feature: The sequence is a functional homolog of SEQ ID NO 1842 in the 10/374,780 US patent application
  misc_feature: The sequence is a functional homolog of SEQ ID NO 1843 in the 10/374,780 US patent application
  misc_feature: Ceres ANNOT ID no. 8633414
  misc_feature (7)..(269): SWISSPROT Homolog: EC 2.7.11.1 Non-specific serine/threonine protein kinase
  misc_feature (265)..(334): SWISSPROT Homolog: EC 3.1.3.16 Phosphoprotein phosphatase
  misc_feature (98)..(130): Pfam ID: Ank Pfam Description: Ankyrin repeat
  misc_feature (131)..(163): Pfam ID: Ank Pfam Description: Ankyrin repeat
MEGAFDLNTRIFLSLNSRLPYGDKSPQMDFFDAAFKGDLRRVREMARGKDAEGKAQLVDVCIGGQGPLQAAARMGRLDVVKFMVKELGFDINLGSSGTGVTALHAAALDGKLDTVRYLLDNGADPNKKDEPGEVPLHCAAKYGHDEVAKLLLSRGANVDMAYFHGTPLHIAAVHGKADFMKVLLEQHADPNKISEALGTPLVATLNAASDGLPESIALKCVKLLVEARADVNFVGPDTPLVVATTHGLTDCIKYLLNAGGDKAVGRKNYLAASKLYTQAIELDPDDATLYSNRSLCQLQIGEANKALLDANSCIKIRPEWLKGYYRKGVALMSLKVDLSK

SEQ ID NO: 15038 - DNA, 993 bp, Sorghum bicolor
  misc_feature: Ceres ANNOT ID no. 8633413
  misc_feature: Encodes the peptide sequence at SEQ ID NO 15039
atggaactgccgcagccacggcctcgtggtggcggcgtggacaagtacgacttctactactggctcgggtgccagatcctcgtcttaggcgactcgattaagggcaagctcgtcgaggcgatccaggacggagatgtccgccgcctcaaggggctggtgagtagcatgaaaaagaataccagagccaagcttgccaaaatgaatattgatcgacatgggctgctacaattggcagtgttcctaggaaaactggaggtctgcaggtactttgtggaggacctcagttttgacgtggattgcagtggcctctgtaatggtgcaacacctttgggttgtgcatcattatttggagaagtggcttgtgcgaggtttcttctagaccatggagctgatccgaacaagatggacgagacaggctctgttgccctgcacaacgccgcaaaaaatgggaatggtgaattaatgcggctattgttatccagaggagccagagttgatattgctatacctcaggggacaccactacatattgctgcttcctatgggaacattgatgctgtaaagatcttactggatcaccatgccgatccagacatcatttcagaagtgtcaggcagccctctggtatcagctcttcaatctactaaacttgtgaatgaatctgattcattggaatgtgtgaagcttctcatcaaggcaattgagctggaccttgatgatgcaacattgtatgcaaacaggagcctttgccatctacgaattggcgaggcaaacaaggctttgcttgatgccaatagttgtataaagatacgacccgaatggttgaaaggttactaccgaaaaggcgttgctctcatgtcactcagggagtacaaagaagcatgtgatgctttcttggctggactgaagttggaccctacaaatgttgatatggagaggatgttcagagaggttcttgaggcgacagaaggatcatgtatgttggaaaaatag

SEQ ID NO: 15039 - protein, 330 aa, Sorghum bicolor
  misc_feature: The sequence is a functional homolog of SEQ ID NO 1842 in the 10/374,780 US patent application
  misc_feature: Ceres ANNOT ID no. 8633413
  misc_feature (75)..(208): SWISSPROT Homolog: EC 2.7.11.1 Non-specific serine/threonine protein kinase
  misc_feature (225)..(321): SWISSPROT Homolog: EC 3.1.3.16 Phosphoprotein phosphatase
  misc_feature (105)..(137): Pfam ID: Ank Pfam Description: Ankyrin repeat
  misc_feature (173)..(202): Pfam ID: Ank Pfam Description: Ankyrin repeat
  misc_feature (275)..(308): Pfam ID: TPR_2 Pfam Description: Tetratricopeptide repeat
MELPQPRPRGGGVDKYDFYYWLGCQILVLGDSIKGKLVEAIQDGDVRRLKGLVSSMKKNTRAKLAKMNIDRHGLLQLAVFLGKLEVCRYFVEDLSFDVDCSGLCNGATPLGCASLFGEVACARFLLDHGADPNKMDETGSVALHNAAKNGNGELMRLLLSRGARVDIAIPQGTPLHIAASYGNIDAVKILLDHHADPDIISEVSGSPLVSALQSTKLVNESDSLECVKLLIKAIELDLDDATLYANRSLCHLRIGEANKALLDANSCIKIRPEWLKGYYRKGVALMSLREYKEACDAFLAGLKLDPTNVDMERMFREVLEATEGSCMLEK

SEQ ID NO: 15040 - DNA, 1062 bp, Sorghum bicolor
  misc_feature: Ceres ANNOT ID no. 8633420
  misc_feature: Encodes the peptide sequence at SEQ ID NO 15041
atgacgcgctctcctctgactctgatcctactgctcctcctctgcgccgccgccgccacggcggccgtgccgcggtaccgcgaggcgccgcacttcaccaactcggcggcggcgcagtgcccgccgccgctgcatccgtcggacgcggacgcggcgtgctcgccgcacgcggcggtgcacgtggccatgacgctggacgcgtcgtacctgcgcggcaccatggcggccgtgctctccgtgctgcgccacgcgtcgtgcccggagtccatccacttccacttcatcgcctccgcctcccccaagtccagggcgacggcggaggagctgggggccacggtgcgcgcgtcgttcccgtcgctggcgttccgtgtctacccgttcgccgacgaggcccgcgtggcggggctcatctccacctccatccgcggcgcgctggaccgcccgctcaactacgcgcggtcctacctcgcctccacgcttcccccctgcgtgcgccgcgtcgtgtacctcgactccgacgtcgtgctcaccgacgacatcgcgtccctcgccgcgaccccgctcccgggggaggaggagacggccgtggcggcgccgcagtactgcggcgccaacttcaccgcctacttcacgccggggttctgggcgtcccccgcgctgtcctccaccttcgcgggccgccgcgcctgctacttcaacacgggcgtcatggtgctggacctcgcgcggtggcgccgcgcgggctacacggcgcagatcgaggagtggatggagctgcagaagcgcgtgcgcatctacgagcttggctcgctgccgccgttcctgctcgtgttcgccggccggatcgcgtccgtggaccaccgatggaaccagcacggcctcggcggggacaactaccgcggcctctgccgcggcctgcacgccggcgccgtcagcctgctgcactggagcggcaaggggaagccctgggaccgcctggatgccggaaggccctgcccgctcgacgccgtctgggccaagtacgacctgctccggccggccgccggcatcgagagctcgtga

SEQ ID NO: 15041 - protein, 353 aa, Sorghum bicolor
  misc_feature: Useful for making plants with altered cell wall content and/or composition
  misc_feature: Functional homolog of the protein sequence given in SEQ ID NO 14127
  misc_feature: Useful for making plants with altered carbohydrate content
  misc_feature: Functional homolog of the protein sequence given in SEQ ID NO 14010
  misc_feature: Ceres ANNOT ID no. 8633420
  misc_feature (60)..(327): Pfam ID: Glyco_transf_8 Pfam Description: Glycosyl transferase family 8
MTRSPLTLILLLLLCAAAATAAVPRYREAPHFTNSAAAQCPPPLHPSDADAACSPHAAVHVAMTLDASYLRGTMAAVLSVLRHASCPESIHFHFIASASPKSRATAEELGATVRASFPSLAFRVYPFADEARVAGLISTSIRGALDRPLNYARSYLASTLPPCVRRVVYLDSDVVLTDDIASLAATPLPGEEETAVAAPQYCGANFTAYFTPGFWASPALSSTFAGRRACYFNTGVMVLDLARWRRAGYTAQIEEWMELQKRVRIYELGSLPPFLLVFAGRIASVDHRWNQHGLGGDNYRGLCRGLHAGAVSLLHWSGKGKPWDRLDAGRPCPLDAVWAKYDLLRPAAGIESS

SEQ ID NO: 15042 - DNA, 552 bp, Sorghum bicolor
  misc_feature: Ceres ANNOT ID no. 8633455
  misc_feature: Encodes the peptide sequence at SEQ ID NO 15043
atggacgactcacatattgcaaatcatggaacagatgacaatggctatgaagaaggaggcggttcctccgacgaagacgagcaagaaaccggcgacttgggcggcctgccggtcccagctgagaccggcagcccgtccggggaggacaaggagctgaagagccgcctcctgaacaagtacagcggctacctgagcagcctctggagggagctctcgaggaagaagaagaaaggcaagctgccgagggacgcgcgccagaagctcctccactggtggcagctgcactacagatggccctatccctcggagctggagaaggcggcgctggcagagtcgacggggctcgacgcgaagcagatcaacaactggttcatcaaccagcggaagcgccactggaagccggcgccaccgacgatggggctggccacaggagattacaggttgggctcgcatggcggcggcggcggcggttctagcagctcggccaacgccggtctccgcgtggaggggcagtacttcaccggcggaagctcgtatccccgtggcccgtga

SEQ ID NO: 15043 - protein, 183 aa, Sorghum bicolor
  misc_feature: The sequence is a functional homolog of SEQ ID NO 2674 in the 10/374,780 US patent application
  misc_feature: The sequence is a functional homolog of SEQ ID NO 76 in the 10/225,066 US patent application
  misc_feature: The sequence is a functional homolog of SEQ ID NO 200 in the 10/225,066 US patent application
  misc_feature: The sequence is a functional homolog of SEQ ID NO 2334 in the 10/374,780 US patent application
  misc_feature: The sequence is a functional homolog of SEQ ID NO 272 in the 10/412,699 US patent application
  misc_feature: The sequence is a functional homolog of SEQ ID NO 601 in the 11/479,226 US patent application
  misc_feature: Ceres ANNOT ID no. 8633455
  misc_feature (51)..(72): Pfam ID: ELK Pfam Description: ELK domain
MDDSHIANHGTDDNGYEEGGGSSDEDEQETGDLGGLPVPAETGSPSGEDKELKSRLLNKYSGYLSSLWRELSRKKKKGKLPRDARQKLLHWWQLHYRWPYPSELEKAALAESTGLDAKQINNWFINQRKRHWKPAPPTMGLATGDYRLGSHGGGGGGSSSSANAGLRVEGQYFTGGSSYPRGP

SEQ ID NO: 15044 - DNA, 501 bp, Sorghum bicolor
  misc_feature: Ceres ANNOT ID no. 8633453
  misc_feature: Encodes the peptide sequence at SEQ ID NO 15045
atggaggaggagctgcctgctcttgccagtggctcaaaggcggccaccacgacgcctttctacctcgccttagatcacagagcttcggccacttcatcttcaccgccggcggaggcgccaacaccgccgccgccttccgccgtctcagatccttctagacagtccaacagcgagaggggatccgaaataatcaaagccaagatcatgtctcaccctctctatcctgctctcttgagagccttcatagactgccggaaggttggagcgccgccggagactgtcggccggctttccgccctcgccgatgaggtcgaaatgaactcagacgacagacaagaacagcgaccagcagacccagagctcgatcagttcatggagatctattgtcacatgttggtaaggtacagacaggagctcacaagaccaatccaggaagccgacgaattcttcagaagcatggaggcccagatcgattcattttcgttaggtgattatgcttaa

SEQ ID NO: 15045 - protein, 166 aa, Sorghum bicolor
  misc_feature: Useful for making plants with modulated biomass
  misc_feature: Functional homolog of the protein sequence given in SEQ ID NO 13573
  misc_feature: Useful for biocontainment applications
  misc_feature: Functional homolog of the protein sequence given in SEQ ID NO 12970
  misc_feature: Ceres ANNOT ID no. 8633453
  misc_feature (111)..(162): Pfam ID: KNOX2 Pfam Description: KNOX2 domain
  misc_feature (62)..(106): Pfam ID: KNOX1 Pfam Description: KNOX1 domain
MEEELPALASGSKAATTTPFYLALDHRASATSSSPPAEAPTPPPPSAVSDPSRQSNSERGSEIIKAKIMSHPLYPALLRAFIDCRKVGAPPETVGRLSALADEVEMNSDDRQEQRPADPELDQFMEIYCHMLVRYRQELTRPIQEADEFFRSMEAQIDSFSLGDYA

SEQ ID NO: 15046 - DNA, 558 bp, Sorghum bicolor
  misc_feature: Ceres ANNOT ID no. 8633476
  misc_feature: Encodes the peptide sequence at SEQ ID NO 15047
atggggctactcagcatcatccggaagatcaagcgcaaggagaaggagatgcgcatcctcatggtaggcctggacaactcggggaagacaaccatcgttctcaagatcaacggggaggacaccagcgtcattagcccaaccctcggattcaacatcaagaccatcaagtaccacaaatactctttgaacatatgggatgttggaggacagaagacgatcaggtcttactggagaaattactttgagcagactgatgggttagtttgggtcgttgatagttcagacataaggaggcttgatgattgccgtgctgaactccacaatctcttgaaagaagagagactagctggagcttcattgttggttttcgcaaataagcaagacatacagggagctctaaaaccagctgaaattgcgaaggttctgaatctggaagtgatgaacagcagcaggcactggaagattgtgggctgcagcgcttacactggagaggggcttctcgagggcttcgactggctggtccaggacgtcgcttctcggatctacgtcctggactga

SEQ ID NO: 15047 - protein, 185 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 12945
  misc_feature: Ceres ANNOT ID no. 8633476
  misc_feature (3)..(177): Pfam ID: Arf Pfam Description: ADP-ribosylation factor family
MGLLSIIRKIKRKEKEMRILMVGLDNSGKTTIVLKINGEDTSVISPTLGFNIKTIKYHKYSLNIWDVGGQKTIRSYWRNYFEQTDGLVWVVDSSDIRRLDDCRAELHNLLKEERLAGASLLVFANKQDIQGALKPAEIAKVLNLEVMNSSRHWKIVGCSAYTGEGLLEGFDWLVQDVASRIYVLD

SEQ ID NO: 15048 - DNA, 1422 bp, Sorghum bicolor
  misc_feature: Ceres ANNOT ID no. 8633491
  misc_feature: Encodes the peptide sequence at SEQ ID NO 15049
atgggcgccgaggcgaggaggaagcccgccgccgccgcggctctgctgccaatctggctcatctgcctcgtctgcgcctcgagagcagcagcggagccgtacatcggcgtcaactacggcgaggtggcggacaacctgccgtcgccggacgagacggcgaagctgctcaagtcgacgtccatctccaaggtgcgtctctacggcgtggacgcggggctgatccgtgcgctggcggggtccggcatctcggtcgtcgtcggcgtggcgaacggcgacatcccctcgctggccgccgacccggcggcggcgtcgcggtggctggcggccaacgtgctgccgttcgtcccggccaccaccatctcggccgtggccgtcggcaacgaggtgctggagtccggcgacgccacgctggccgcggcgctgctcccggccatgcagaacctccgcgccgcggccctggccgccggggacggcgcggcggggatccggttctccaccgtcaacaccatgggcgtgatggcgcagtcggacccgccctccacgggcgcgttccacccggacgtggcgccgcagctgcagcagatcctggcgttcctcagccggaccggcgcgcccttcatgatcaacccgtacccgtggttcgcgtaccagtcggacccgcgcccggagacgctggcgttctgcctgttccagcccaacgccggccgcgtcgacggcgggtccaagatcaggtacaccaacatgttcgacgcgcagctggacgccgtcaagtcggcgctggtgcgcgccgggtacgggagcgtggacatcgtggtggccgagacgggttggccgacgaaaggcgacgccggggagcccggcgccacggcggagaacgccagggcgtacgtgtccaacctggtggcgcaccttcggtccggcgccggcacgccgctgatgccggggaggtcggtggagacgtacctgttcgcgctctacgacgaggacctcaagcctggcccgacgtcggagcgctcgttcgggctgtaccacacggacctcaccatggcgtacgacgccgggctcacctcctcctccagcgccggggcggcggggggaggaggaggaggaggaggaagcgcggcggcgcagcccaagcagggcggcgggtggtgcgtggcgcgggacggcgcctcggacgcggacctgcaggcggacctggactacgcgtgctcgcagctgggcgtcgactgcggcgccatccagccaggcggcgcgtgcttcgagcccaacacggtgcgcgcgcacgccgcgtacgccatgaaccagctgtaccaggcggccggccggcacccgtggaactgcgacttccgggcgtccgccacgctcacctccgagaacccaagctacggcgcctgtgtgtacaccggtggcgcccaataa

SEQ ID NO: 15049 - protein, 473 aa, Sorghum bicolor
  misc_feature: Useful for making plants with altered carbohydrate content
  misc_feature: Functional homolog of the protein sequence given in SEQ ID NO 14128
  misc_feature: Useful for making plants with altered cell wall content and/or composition
  misc_feature: Functional homolog of the protein sequence given in SEQ ID NO 14129
  misc_feature: Ceres ANNOT ID no. 8633491
  misc_feature (20)..(468): SWISSPROT Homolog: EC 3.2.1.39 Glucan endo-1,3-beta-D-glucosidase
  misc_feature (35)..(355): Pfam ID: Glyco_hydro_17 Pfam Description: Glycosyl hydrolases family 17
  misc_feature (383)..(468): Pfam ID: X8 Pfam Description: X8 domain
MGAEARRKPAAAAALLPIWLICLVCASRAAAEPYIGVNYGEVADNLPSPDETAKLLKSTSISKVRLYGVDAGLIRALAGSGISVVVGVANGDIPSLAADPAAASRWLAANVLPFVPATTISAVAVGNEVLESGDATLAAALLPAMQNLRAAALAAGDGAAGIRFSTVNTMGVMAQSDPPSTGAFHPDVAPQLQQILAFLSRTGAPFMINPYPWFAYQSDPRPETLAFCLFQPNAGRVDGGSKIRYTNMFDAQLDAVKSALVRAGYGSVDIVVAETGWPTKGDAGEPGATAENARAYVSNLVAHLRSGAGTPLMPGRSVETYLFALYDEDLKPGPTSERSFGLYHTDLTMAYDAGLTSSSSAGAAGGGGGGGGSAAAQPKQGGGWCVARDGASDADLQADLDYACSQLGVDCGAIQPGGACFEPNTVRAHAAYAMNQLYQAAGRHPWNCDFRASATLTSENPSYGACVYTGGAQ

SEQ ID NO: 15050 - DNA, 1797 bp, Sorghum bicolor
  misc_feature: Ceres ANNOT ID no. 8633503
  misc_feature: Encodes the peptide sequence at SEQ ID NO 15051
atggaggtctccaccatcagcttctcgtccccgtcctcgtcgccgccgtccctgtccccttcgccgccgccgtcgcagcagcagcagcaccagccgcggggggccacgccggcggacctcgaggccgtgggcctccgccgcctcagcgacaacctgcagcgcctgctggacccggccttcctcaactgcgcggacgccgagatcgcgctcgcaccggccaagggcggcggcgccgtcggcgtccaccgctgcatcctcgccgccaggagcgccttcttcctccaccacttcgcctccctcccggcccccgccggcggcggcggcgagaggccccgcctcgagctcgccgacctcgtccccggcggccgccacatcggccaagacgccctcgtgcccgtcctcggatacctctacaccggccgcctcaagtcgccgccgcaggaggccaccgtctgcatggacgacgcgtgcggccacgggacctgccgccccgcgattgacttcgtcgtcgagtccatgtacgccgcgtctggcttccagatctccgagcttatctccctcttccagcgccgtctctctgacttcgttagcgaagcactggatgaggatgtggtgcccattattcatgttgcttccacctgcgaccttcaggacctgctcaatcagtgtattcacagggttgcggtctccactctcgatagccggtacctcgagaaggaacttccagatgacatatactgcaggatcaaggaaatccgccggagcacgtttcatgacgaatcatcagagagtgccattctggaccctgagcatgacaagagggtcagaaacatcctcaaggccttggattctgacgatgttgatcttgttggcctgctgttaaaggagtcgacggtgaccttggatgatgcgtttgcgatacactatgctgcagcctactgtgagcccaaagtgtttgcggaattgctgaaactggattctgctaacgtgaatcggaagagtaatagtgggtatacaccactgcatatagcttgcatgaggagagaaccagacatcattctttcgcttgtggagaggggagcctctgtgctggagaggaccctagatgggcgtgatgctcttactatctgcaagagactaacaagagagaaagactgcaataggaagttggagaagtacgaggagaaaagtaaggcttacttgtgtatcgacatactggagcaagaacttaagaggaaatcctttattttggacccgatctctatagaggagtccattgccacacctttgttggttgataattttcacatgaggctcataaacttggaaaacagagttgcgtttgcacgaatattcttcccttcggaagccaagcttgtcatgcgcattgcacaagctgattcaaccgaagagtttgccggcatcaccaatttcagcaaactaaaggaagttgatctcaatgaaaccccaacaatgcagaataggaggttgcgtgaacgccttgatgccttaacaaagacagttgagctagggagacgatacttcccacattgttcagacgttcttgacaagttcctcaacgaagaatccactgatctgatcttccttgaaactgggactccagaggatcagcgagtcaagagaatgcgcttttctgaactcaaagaggacgtgcgcaaggcattcacaaaagataaggctgcagtggcagccatagcttcctcagcatcctcgtcttcatctccgaggtgtgaggggaggggtagatccaataggaaattgaggccatctcggtga

SEQ ID NO: 15051 - protein, 598 aa, Sorghum bicolor
  misc_feature: The sequence is a functional homolog of SEQ ID NO 1466 in the 10/374,780 US patent application
  misc_feature: The sequence is a functional homolog of SEQ ID NO 872 in the 10/666,642 US patent application
  misc_feature: The sequence is a functional homolog of SEQ ID NO 4 in US patent 7030293
  misc_feature: Ceres ANNOT ID no. 8633503
  misc_feature (336)..(368): Pfam ID: Ank Pfam Description: Ankyrin repeat
MEVSTISFSSPSSSPPSLSPSPPPSQQQQHQPRGATPADLEAVGLRRLSDNLQRLLDPAFLNCADAEIALAPAKGGGAVGVHRCILAARSAFFLHHFASLPAPAGGGGERPRLELADLVPGGRHIGQDALVPVLGYLYTGRLKSPPQEATVCMDDACGHGTCRPAIDFVVESMYAASGFQISELISLFQRRLSDFVSEALDEDVVPIIHVASTCDLQDLLNQCIHRVAVSTLDSRYLEKELPDDIYCRIKEIRRSTFHDESSESAILDPEHDKRVRNILKALDSDDVDLVGLLLKESTVTLDDAFAIHYAAAYCEPKVFAELLKLDSANVNRKSNSGYTPLHIACMRREPDIILSLVERGASVLERTLDGRDALTICKRLTREKDCNRKLEKYEEKSKAYLCIDILEQELKRKSFILDPISIEESIATPLLVDNFHMRLINLENRVAFARIFFPSEAKLVMRIAQADSTEEFAGITNFSKLKEVDLNETPTMQNRRLRERLDALTKTVELGRRYFPHCSDVLDKFLNEESTDLIFLETGTPEDQRVKRMRFSELKEDVRKAFTKDKAAVAAIASSASSSSSPRCEGRGRSNRKLRPSR

SEQ ID NO: 15052 - DNA, 1797 bp, Sorghum bicolor; identical to SEQ ID NO: 15050
  misc_feature: Ceres ANNOT ID no. 8633506
  misc_feature: Encodes the peptide sequence at SEQ ID NO 15053

SEQ ID NO: 15053 - protein, 598 aa, Sorghum bicolor; identical to SEQ ID NO: 15051
  misc_feature: The sequence is a functional homolog of SEQ ID NO 1466 in the 10/374,780 US patent application
  misc_feature: The sequence is a functional homolog of SEQ ID NO 872 in the 10/666,642 US patent application
  misc_feature: The sequence is a functional homolog of SEQ ID NO 4 in US patent 7030293
  misc_feature: Ceres ANNOT ID no. 8633506
  misc_feature (336)..(368): Pfam ID: Ank Pfam Description: Ankyrin repeat

SEQ ID NO: 15054 - DNA, 1338 bp, Sorghum bicolor
  misc_feature: Ceres ANNOT ID no. 8633555
  misc_feature: Encodes the peptide sequence at SEQ ID NO 15055
atgagggagatcctgcacatccagggcggccagtgcggcaaccagatcggcgccaagttctgggaggtgatctgcggggagcacggcgtcgactccacgggccgctcctcggggacctccccgcagcagctcgagcggatcaacgtctactacaacgaggccgggggcggccgctacgtgccccgcgccgtgctcatggacctggagcccggcaccatggagtccatccgcgccggacccttcggcggcatcttccgccccgacaacttcgtctacggccagtccggcgccgggaacaactgggccaagggacactacaccgagggcgcagagctcatcgactccgtactcgacgtcgtgcgcaaggaggccgagaactgcgactgcctccaggggttccaagtatgccactccctgggtggcggcactggttctggcatgggcacgctgctcatctccaagatccgggaggagtacccggaccgcatgatgctcaccttctccgtgttcccgtcgcccaaggtgtccgacaccgtcgtggagccctacaacgcgacgctgtccgtgcaccagctcgtggagaacgccgacgagtgcatggtccttgacaacgaggcgctctatgatatttgcttccgcaccctcaagctcaccaacccttcatttggtgacctgaaccatctgatctcagcgaccatgagcggcgtcacgtgctgcctgcggttcccgggccagctgaactcggacctccgcaagctggcagtgaacctgatcccgttcccgcggctgcacttcttcatggtcgggttcgcgccgctgacgtcgcgcgggtcgcagcagtaccgcgcgctgacggtgccggagctgacgcagcagatgtgggacgccaagaacatgatgtgcgcggcggacccgcggcacgggcggtacctgacggcgtccgccatgttccggggcaagatgagcaccaaggaggtggacgagcagatgatcaacgtgcagaacaagaactcctcctacttcgtggagtggatccccaacaacgtcaagtccagcgtgtgcgacatcccgcccgtggggctgtccatggcctccaccttcgtgggcaactccacctccatccaggagatgttccgccgtgtgagcgagcagttcacggccatgttccggcgcaaggccttcttgcactggtacaccagcgagggcatggacgagatggagttcaccgaggccgagagcaacatgaacgacctcgtcgccgagtaccagcagtaccaggacgccaccgccgaggagtacgacgaggaagagcaagacggcgaggaggagcacgcctga

SEQ ID NO: 15055 - protein, 445 aa, Sorghum bicolor
  misc_feature: Useful for making plants with modulated flowering time
  misc_feature: Functional homolog of the protein sequence given in SEQ ID NO 14090
  misc_feature: Ceres ANNOT ID no. 8633555
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (45)..(244): Pfam ID: Tubulin Pfam Description: Tubulin/FtsZ family, GTPase domain
  misc_feature (246)..(383): Pfam ID: Tubulin_C Pfam Description: Tubulin/FtsZ family, C-terminal domain
MREILHIQGGQCGNQIGAKFWEVICGEHGVDSTGRSSGTSPQQLERINVYYNEAGGGRYVPRAVLMDLEPGTMESIRAGPFGGIFRPDNFVYGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPVGLSMASTFVGNSTSIQEMFRRVSEQFTAMFRRKAFLHWYTSEGMDEMEFTEAESNMNDLVAEYQQYQDATAEEYDEEEQDGEEEHA

SEQ ID NO: 15056 - DNA, 2037 bp, Sorghum bicolor
  misc_feature: Ceres ANNOT ID no. 8633575
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 15057
atgggtgttgtgtattatcaatataagagtgaaaaggaaatctgttctatgcctgtgccccatgcttttatctctgtgtctgaactcaagcagcttatcatgacgagcggtaagcacggccgtgggcgaacccgcggccgtgccacagaggatattgtcatctccaacgcccacactggcgaagaatatgcagatgaaagagcatccgtaccacagaacacaactgtgctggtccgcagaatttccattcctgggcaactgtcagagaagatcgtcttgtcccccacgcggaaagtcgcagaagaatgttctgtaccttgtaagtcagtcgttattgattcaagctcaaagtcatgttcctccacagtagtgcaagatgaagatgctgcaattgcagcagtgattgatgctgctgaactcaaattggaacagcacccatctaaaagaggacaaggcagtggaaggtttacatcagggcgtaactatgggccattggaaggggagacacctccaccaggatatgtctgccgctcttgcggtgttccaggccatttcattcaacactgctcacaggaaaacaagacgcccccacctggatacatttgctacagatgccgaattgcagggcattttattcaccattgcccaaccattggtgatcccaagttcgacaataataaaatgagtcggtctcttgtcccagtagtaactgtcagtcctgtcgatggcattttggattcacttgtccgcactgccccggttagtgttgttgatgacttgccagcagagctccactgccgactatgtaaaaaagtgatgagagatgcagtattgacaagcaagtgctgttttgacagtttttgtgatagatgcattcgggactatattattacagagttgaagtgcatttgtggagtcaagacactagcagatgacctcattcccaatcacacacttcggagcacaataagcaatatgttgggaacacaggctagcagtggcggaagtggtacaacaaggcacagaagttcgtcaggcagcaaccctgaccccaaaatacagagcgccactgcttctgctgcctcagcaagggagatgaagcaatctacagaccaccagctacctgcagcatctgcacctgacgatgcgctccaggttgccacaggagttgctccagtgaagcaacctctagagaaattggcagacactgctagaatccttagcaaagatgaaggcaattctgcagaattgtcagcagagaaagcaaatgctgaagcccccagagtaaaggatggaagtgaatcaatttcaaaggccaccactgtttcaggggccctgaaacacaatgtcacaaggacagatcaaccaaagaagaagcggaagaaggcagacttaactaagaacgttcaacctaacaatgttggctatggttacaatgttccatttgaacctgcatattgcaatccctttaacaatggatatccttgggcaactgaaccttacatgtatagctcaatggggatgccctacaccggttatccaatggatccatattgtgtgaatacttttactggcatgccaccgcaggttcttgcaatgcaaggctatccagcaagctaccaaaggcctgcaactgtgcccatgcattgtgggggcactgcagctgctagggcactttcaaatcaccctgagaggagtgagagacccaatgacactcgtgttcagccccgatcaccagagcacaagcgacaaatggtctcctctcatggctcagaatcaagaacaaggaacagaacaaggccaagctccgagaggagggaacatgggcattctgacagagcctccgttgaggatcactctagtaggaagcggatgcgcgattcctctccaaagtatgacgataggcagagcggccggagatcgagacatggttccaggggtatgatgactcgtgaggaggatgcaagcgacgatgaacgtaatttcaagaggagatggggtcgcagatcatcaggaggcgtggacacaaggcactga

SEQ ID NO: 15057 - protein, 678 aa, Sorghum bicolor
  misc_feature: The sequence is a functional homolog of SEQ ID NO 1252 in the 10/666,642 US patent application
  misc_feature: Ceres ANNOT ID no. 8633575
  misc_feature (4)..(82): Pfam ID: DWNN Pfam Description: DWNN domain
MGVVYYQYKSEKEICSMPVPHAFISVSELKQLIMTSGKHGRGRTRGRATEDIVISNAHTGEEYADERASVPQNTTVLVRRISIPGQLSEKIVLSPTRKVAEECSVPCKSVVIDSSSKSCSSTVVQDEDAAIAAVIDAAELKLEQHPSKRGQGSGRFTSGRNYGPLEGETPPPGYVCRSCGVPGHFIQHCSQENKTPPPGYICYRCRIAGHFIHHCPTIGDPKFDNNKMSRSLVPVVTVSPVDGILDSLVRTAPVSVVDDLPAELHCRLCKKVMRDAVLTSKCCFDSFCDRCIRDYIITELKCICGVKTLADDLIPNHTLRSTISNMLGTQASSGGSGTTRHRSSSGSNPDPKIQSATASAASAREMKQSTDHQLPAASAPDDALQVATGVAPVKQPLEKLADTARILSKDEGNSAELSAEKANAEAPRVKDGSESISKATTVSGALKHNVTRTDQPKKKRKKADLTKNVQPNNVGYGYNVPFEPAYCNPFNNGYPWATEPYMYSSMGMPYTGYPMDPYCVNTFTGMPPQVLAMQGYPASYQRPATVPMHCGGTAAARALSNHPERSERPNDTRVQPRSPEHKRQMVSSHGSESRTRNRTRPSSERREHGHSDRASVEDHSSRKRMRDSSPKYDDRQSGRRSRHGSRGMMTREEDASDDERNFKRRWGRRSSGGVDTRH

SEQ ID NO: 15058 - DNA, 2283 bp, Sorghum bicolor
  misc_feature: Ceres ANNOT ID no. 8633595
  misc_feature: Encodes the peptide sequence at SEQ ID NO 15059
atggcgtcccatattgttggataccctcgcatgggccccaagagggagctcaagtttgccttggagtctttctgggatgggaagagcagcgccgaggatttggagaaagttgccactgacctcaggtctagcatctggaagcaaatgtcagaagctgggatcaagtacattcccagcaacaccttctcgtactacgaccaggttcttgataccacggccatgcttggcgctgtcccagagcgctactcttggactggaggtgagattggcttgagcacctacttctcaatggccaggggaaatgccactgtccctgctatggagatgacaaagtgccactttattgtccctgaacttggcccaagcaccaagttcacatacgcttcacacaaggctgtttctgagtacaaggaggcaaaggcgctcggcattgatacagtcccagtgcttgttggaccagtctcatacttgctcctctctaagcctgccaagggtgtagagaaatctttctctcttctttcacttcttggtagcattcttcccatctacaaggaggttgttgctgagctgaaggcggccggtgcttcatggattcagtttgatgagcctacccttgttaaagaccttgatgctcatgaattggctgccttctcttcagcatatgctgaactagagtcagcattctctggattgaatgtgcttatcgagacctactttgctgacattcctgctgagtcctacaagaccctcacgtcattgagtggggtgactgcttacggtttcgatcttatccgtggagccaagacccttgatcttatcaggagcagcttcccctctgggaagtacctcttcgctggggttgtagatggacgcaacatttgggctgatgatcttgctgcatctcttagcactcttcagtctcttgaggctgttgctggcaaggacaaacttgtggtgtcaacatcctgctcactgatgcacaccgctgttgatcttgtaaatgagactaagctggatgatgagattaagtcatggcttgcgtttgctgcccaaaaggttgttgaggttaatgcccttgccaaggctttggcaggccaaaaggatgaggcttactttgcagccaatgctgctgctcaggcctcaaggagatcatcacccagagtgacaaacgaggaggtccaaaaggctgcagctgctttgaagggctctgaccaccgccgtgctaccactgtttcttctagattggatgctcagcagaaaaagctcaaccttcctgtccttcccacaaccacaattggttcattccctcagactccggaactcaggagggtccgccgtgagtacaaggcaaagaagatctctgaggaggaatacatcagtgccatcaaggaagaaattagcaaggttgtcaagatccaagaggagcttgacattgatgtgcttgtgcatggagagccagagagaaatgatatggttgagtacttcggtgagcaattgtctggttttgcattcactgccaacggctgggtgcaatcttatggatcacgttgtgtgaagccacccattatctatggtgatgtcagccggccgaaccccatgactgtgttctggtccaagacggcacaaagcatgaccgcccgtcccatgaagggaatgttgactggtccagtcacaatcctcaactggtcatttgtcaggaacgaccagcctaggtttgagacatgctaccaaatagctcttgcaatcaaaaaggaggttgaggatcttgaggctgctggtattcaggtgatccagattgatgaggcagctctaagggagggtctgccactgcgcaagtcagagcatgcattctacctggactgggctgtccactctttcagaatcaccaactgcggagtccaggacaccacccagatccacacccatatgtgctactccaactttaacgatatcatccactccatcattgacatggatgccgatgtgatcaccatcgagaactcccggtctgatgagaagctactgtccgtcttccgtgagggtgtcaagtatggagctggcattggccctggtgtctatgacatccactctcccaggattcccactaccgaggagattgcggaccgcgtcaacaagatgcttgctgtgcttgacaccaacatcctctgggtgaacccggactgtggtctcaagacacgcaagtacacggaggtcaagcccgccctgaccaacatggtttccgccaccaagctcatccgcacccagcttgccagcgcgaaatga

SEQ ID NO: 15059 - protein, 760 aa, Sorghum bicolor
  misc_feature: Useful for making plants with altered cell wall content and/or composition
  misc_feature: Functional homolog of the protein sequence given in SEQ ID NO 13984
  misc_feature: Ceres ANNOT ID no. 8633595
  misc_feature (1)..(760): SWISSPROT Homolog: EC 2.1.1.14 5-methyltetrahydropteroyltriglutamate--homocysteine S-methyltransferase
  misc_feature (427)..(751): Pfam ID: Meth_synt_2 Pfam Description: Cobalamin-independent synthase, Catalytic domain
  misc_feature (2)..(313): Pfam ID: Meth_synt_1 Pfam Description: Cobalamin-independent synthase, N-terminal domain
MASHIVGYPRMGPKRELKFALESFWDGKSSAEDLEKVATDLRSSIWKQMSEAGIKYIPSNTFSYYDQVLDTTAMLGAVPERYSWTGGEIGLSTYFSMARGNATVPAMEMTKCHFIVPELGPSTKFTYASHKAVSEYKEAKALGIDTVPVLVGPVSYLLLSKPAKGVEKSFSLLSLLGSILPIYKEVVAELKAAGASWIQFDEPTLVKDLDAHELAAFSSAYAELESAFSGLNVLIETYFADIPAESYKTLTSLSGVTAYGFDLIRGAKTLDLIRSSFPSGKYLFAGVVDGRNIWADDLAASLSTLQSLEAVAGKDKLVVSTSCSLMHTAVDLVNETKLDDEIKSWLAFAAQKVVEVNALAKALAGQKDEAYFAANAAAQASRRSSPRVTNEEVQKAAAALKGSDHRRATTVSSRLDAQQKKLNLPVLPTTTIGSFPQTPELRRVRREYKAKKISEEEYISAIKEEISKVVKIQEELDIDVLVHGEPERNDMVEYFGEQLSGFAFTANGWVQSYGSRCVKPPIIYGDVSRPNPMTVFWSKTAQSMTARPMKGMLTGPVTILNWSFVRNDQPRFETCYQIALAIKKEVEDLEAAGIQVIQIDEAALREGLPLRKSEHAFYLDWAVHSFRITNCGVQDTTQIHTHMCYSNFNDIIHSIIDMDADVITIENSRSDEKLLSVFREGVKYGAGIGPGVYDIHSPRIPTTEEIADRVNKMLAVLDTNILWVNPDCGLKTRKYTEVKPALTNMVSATKLIRTQLASAK

SEQ ID NO: 15060 - DNA, 717 bp, Sorghum bicolor
  misc_feature: Ceres ANNOT ID no. 8633605
  misc_feature: Encodes the peptide sequence at SEQ ID NO 15061
atggaatactcaggcggcggcgcgacgctgtcggagatgtaccagagcgcgcggcggctgctactctcggcgcgcgacggcgtggcccgcgtcgagcgcctcgcctcggcgcccacttcgtcctcctactcctcggcgccgctcgtcggtggcggcgctgcgggggaccccgcggtcgctgaggaggtgcggcgagaggtggcgcagatccaggggctgtgcgcgcagatggaccggctctggcgatccatccccgccaagggccagcgggacctctggaagagaaaagtggagcagctgtctgaagaggttgattcattgaaggaaacccttgacaagcattctttgcgtcagaaaaaacgaattctggaagcaaaagaaagggctgagctatttgagagagctaatggtgaatcttcacatgtcctccgaatatttgacgacgaagcccaagcgaagcaatcagctcgtaactcctcaagaatgcttgaagaagcttatgagacaggagtggctatccttcacaagtacgctgaccagagggatcgactgaagagtgctcaaaggaaagctttggatgtcctgaacactgttggtctatcgaactctgttttgaagctaatcgagaggcggcaccgtgtggacaagtggatcgcgtatgctggtatgatcatcaccgtagtggtgatgattgcgttttggcggttaacgcattag

SEQ ID NO: 15061 - protein, 238 aa, Sorghum bicolor
  misc_feature: Useful for making plants with modulated nitrogen use efficiency
  misc_feature: Functional homolog of the protein sequence given in SEQ ID NO 13022
  misc_feature: Ceres ANNOT ID no. 8633605
  misc_feature (63)..(215): Pfam ID: V-SNARE Pfam Description: Vesicle transport v-SNARE protein
MEYSGGGATLSEMYQSARRLLLSARDGVARVERLASAPTSSSYSSAPLVGGGAAGDPAVAEEVRREVAQIQGLCAQMDRLWRSIPAKGQRDLWKRKVEQLSEEVDSLKETLDKHSLRQKKRILEAKERAELFERANGESSHVLRIFDDEAQAKQSARNSSRMLEEAYETGVAILHKYADQRDRLKSAQRKALDVLNTVGLSNSVLKLIERRHRVDKWIAYAGMIITVVVMIAFWRLTH

SEQ ID NO: 15062 - DNA, 279 bp, Sorghum bicolor
  misc_feature: Ceres ANNOT ID no. 8633657
  misc_feature: Encodes the peptide sequence at SEQ ID NO 15063
atggagcaacagtttcgcaggcagcagcagccaggcagcgctccagagaagaggcaacgtgttccttcagcatataacagatttattaaggaagagatacgaaggattaaagcaagcaacccagacataagccacagggaagccttcagcactgcagcaaaaaattgggcacattttccaaacattcattttggactagggccctatgaaagtagcaacaagcttgatgaggccattggtgcaacgggccatccccagaaagtccaagatctctactaa

SEQ ID NO: 15063 - protein, 92 aa, Sorghum bicolor
  misc_feature: Useful for biocontainment applications
  misc_feature: Useful for making plants with modulated biomass
  misc_feature: Useful for making plants with modulated flowering time
  misc_feature: Useful for making plants with modulated time to senescence
  misc_feature: Functional homolog of the protein sequence given in SEQ ID NO 12923
  misc_feature: The sequence is a functional homolog of SEQ ID NO 414 in the 10/666,642 US patent application
  misc_feature: The sequence is a functional homolog of SEQ ID NO 888 in the 11/435,388 US patent application
  misc_feature: The sequence is a functional homolog of SEQ ID NO 1506 in the 10/666,642 US patent application
  misc_feature: The sequence is a functional homolog of SEQ ID NO 420 in the 10/666,642 US patent application
  misc_feature: The sequence is a functional homolog of SEQ ID NO 412 in the 10/666,642 US patent application
  misc_feature: The sequence is a functional homolog of SEQ ID NO 1150 in the 10/666,642 US patent application
  misc_feature: Ceres ANNOT ID no. 8633657
  misc_feature (1)..(66): Pfam ID: YABBY Pfam Description: YABBY protein
MEQQFRRQQQPGSAPEKRQRVPSAYNRFIKEEIRRIKASNPDISHREAFSTAAKNWAHFPNIHFGLGPYESSNKLDEAIGATGHPQKVQDLY

SEQ ID NO: 15064 - DNA, 1836 bp, Sorghum bicolor
  misc_feature: Ceres ANNOT ID no. 8633702
  misc_feature: Encodes the peptide sequence at SEQ ID NO 15065
atgcagagtctcgccccgcccacctctgtttccatacaccggcagcacctgccggcgtccgggtccagcagggcccgggcctccaattccgtccggttctcgccgcgcgccgtcagctccgtgccgcgcgccaccgcgcccgccgagcgcctccaggcgccgttccacaagcccggcgcggccgacctgccggcgcagtccaagaaacccgccaccgccattgccgtcccgaggcacgccgcggcgccgcggaaggccggcggcaagaagcagctcaacttcttccagcgcgccgcggcggccgcgctcgacgcgttcgaggaagggttcgttgccaacgtcctggagcggccccacgggctgcccagcaccgccgacccggccgtgcagatcgccggcaacttcgcgcccgtcggggagaggccgcccgtgcgcgagctccccgtctccggccgcatcccgcccttcatcaacggcgtctacgcgcgcaacggcgccaacccctgcttcgaccccgtcgccgggcaccacctgttcgacggcgacggcatggtgcacgcgctgcggatacgcaacggcgtcgccgagtcctacgcctgccgcttcacggagaccgcgcgcctcacccaggagcgcgcgatcggacgccccgtcttccccaaggccattggcgagctccacggccactccgggatcgcgcgcctcgccctgttctacgcgcgcgccgcgtgcggcctcgtcgatccctcggcgggaacgggcgtcgctaacgccggcctcgtctacttcaacggccacctcctcgccatgtccgaggacgacctcccctaccacgtccgcgtcgcggacgacggcgacctcgagaccgtcggccgttacgacttcgacggccagctcggctgcgccatgatcgcgcacccgaagctcgacccggtcaccggagagctccacgcgctgagctacgacgtcatcaagaagccgtacctcaagtacttctacttcaggcccgacggcaccaagtccgacgacgtggagatcccgctggaccagcccaccatgatccacgacttcgccatcaccgagaacttcgtggtcgtgcccgaccaccaggtggtgttcaagctccaggagatgctgcgcggcggctcgcccgtggtgctggacaaggagaagacgtcgcgcttcggcgtgctcccgaagcacgcctcggacgcgtcggagatggtgtgggtggacgtgccggactgcttctgcttccacctttggaacgcgtgggaggacgaggcgacgggcgaggtggtggtgatcggctcctgcatgacccccgccgactccatcttcaacgagtccgacgagcgcctcgagagcgtgctcacggagatccgcctggacacgcgcacgggccggtccacgcgccgcgccgtcctgccgccgtcgcagcaggtgaacctggaggtgggcatggtgaaccgcaacctcctgggccgcaagacacggtacgcctacctcgcggtggccgagccgtggcccaaggtgtccggcttcgccaaggtggacctcgaaactggcgagctcaccaagttcgagtacggcgagggccgcttcggcggcgagccctgcttcgtgcccatggacccgtccgcggcgcacccgcgcggcgaggacgacgggtacgtgctcaccttcgtccacgacgagcgcgccggcacgtcggagctcctggtggtcaatgccgccgacatgcggctggaggccacggtccagctcccgtcccgggtgcccttcggcttccacggcaccttcatcacgggcaaggagctcgaggcccaggcctga

SEQ ID NO: 15065 - protein, 611 aa, Sorghum bicolor
  misc_feature: Useful for making plants with modulated water use efficiency
  misc_feature: Functional homolog of the protein sequence given in SEQ ID NO 14130
  misc_feature: The sequence is a functional homolog of SEQ ID NO 6 in US patent 7049487
  misc_feature: Useful for making plants with modulated drought sensitivity
  misc_feature: Ceres ANNOT ID no. 8633702
  misc_feature (1)..(611): SWISSPROT Homolog: EC 1.13.11.51 9-cis-epoxycarotenoid dioxygenase
  misc_feature (111)..(604): Pfam ID: RPE65 Pfam Description: Retinal pigment epithelial membrane protein
MQSLAPPTSVSIHRQHLPASGSSRARASNSVRFSPRAVSSVPRATAPAERLQAPFHKPGAADLPAQSKKPATAIAVPRHAAAPRKAGGKKQLNFFQRAAAAALDAFEEGFVANVLERPHGLPSTADPAVQIAGNFAPVGERPPVRELPVSGRIPPFINGVYARNGANPCFDPVAGHHLFDGDGMVHALRIRNGVAESYACRFTETARLTQERAIGRPVFPKAIGELHGHSGIARLALFYARAACGLVDPSAGTGVANAGLVYFNGHLLAMSEDDLPYHVRVADDGDLETVGRYDFDGQLGCAMIAHPKLDPVTGELHALSYDVIKKPYLKYFYFRPDGTKSDDVEIPLDQPTMIHDFAITENFVVVPDHQVVFKLQEMLRGGSPVVLDKEKTSRFGVLPKHASDASEMVWVDVPDCFCFHLWNAWEDEATGEVVVIGSCMTPADSIFNESDERLESVLTEIRLDTRTGRSTRRAVLPPSQQVNLEVGMVNRNLLGRKTRYAYLAVAEPWPKVSGFAKVDLETGELTKFEYGEGRFGGEPCFVPMDPSAAHPRGEDDGYVLTFVHDERAGTSELLVVNAADMRLEATVQLPSRVPFGFHGTFITGKELEAQA

SEQ ID NO: 15066 - DNA, 900 bp, Sorghum bicolor
  misc_feature: Ceres ANNOT ID no. 8633729
  misc_feature: Encodes the peptide sequence at SEQ ID NO 15067
atgggggctccaaaacaaaggtggacttctgaggaagaggctgctcttagagctggaatagcaaggcatggagttggaaaatggcgcacaatattgaaagatccagaatttagttccactttgtgctaccgctcaaatgttgacctcaaggacaaatggcgaaacatgaatgtaattgtcagtacatcgagttctcgtgacaaggcgaagactgcagtgaagagagcccgaactactcccaagaataacgagcacaccatggcaatcagcagagttacttctgatattgatgatgagattgttgacgaaaagcatatagcaccattgcctagtgaagcaaagaacacatcatattcgaagaaatctcactcaaggctagataatattataatggaggctataaagaatttaaatgagcctacggggtcacacagaactactattgctaattacatagaggagcaatattggccacctagtgattttgatcacttactatctgcaaaactgaaggacttgtccaccagtggcaaattgataaaggtgaatcggaagtacaggatagcacctagttcacccaattcagagggccgaagccccaaaatgctgctgttggaagatgtgcaaagagcgcctgtcaagatatggagcgatgatagtaaaacccttaccagatctcaagttgatgctgaattggcacgtatgtcaacaatgactgctgaggaagcttcagtggctgcagctcatgcagttgctgaagcagaggccatcatggcagaagctgaagctgcagcgaaagaagcagaggctgcagaagcagaagcccaagctgcgcaagcatttgctgaagcagcatttttgacattgaagaacagaaatgctgcaaaactgatggcctaa

SEQ ID NO: 15067 - protein, 299 aa, Sorghum bicolor
  misc_feature: The sequence is a functional homolog of SEQ ID NO 1220 in the 10/666,642 US patent application
  misc_feature: Ceres ANNOT ID no. 8633729
  misc_feature (122)..(190): Pfam ID: Linker_histone Pfam Description: linker histone H1 and H5 family
  misc_feature (5)..(57): Pfam ID: Myb_DNA-binding Pfam Description: Myb-like DNA-binding domain
MGAPKQRWTSEEEAALRAGIARHGVGKWRTILKDPEFSSTLCYRSNVDLKDKWRNMNVIVSTSSSRDKAKTAVKRARTTPKNNEHTMAISRVTSDIDDEIVDEKHIAPLPSEAKNTSYSKKSHSRLDNIIMEAIKNLNEPTGSHRTTIANYIEEQYWPPSDFDHLLSAKLKDLSTSGKLIKVNRKYRIAPSSPNSEGRSPKMLLLEDVQRAPVKIWSDDSKTLTRSQVDAELARMSTMTAEEASVAAAHAVAEAEAIMAEAEAAAKEAEAAEAEAQAAQAFAEAAFLTLKNRNAAKLMA

SEQ ID NO: 15068 - DNA, 2565 bp, Sorghum bicolor
  misc_feature: Ceres ANNOT ID no. 8633734
  misc_feature: Encodes the peptide sequence at SEQ ID NO 15069
atggcgatggtggtggtcgggggcggcaaggaccggtcgtcgcctggcggcggtggggcgccgcaggtggacacgggcaagtacgtgcgctacacccccgagcaggtcgaggcgctcgagcgggtctacagcgagtgccccaagcccagctcgctgcgcaggcagcagctcatcagggagtgccccatactcagcaacatcgagcccaagcagatcaaggtctggttccagaaccgcagatgccgcgagaagcagcggaaggaggcctcgcgcctgcagactgtgaaccggaagctgactgcgatgaacaagctgttgatggaggagaatgacaggctgcagaagcaggtctcccgactcgtctacgagaatggatacatgcgacagcagctccacaatccttctgctgcgaccacagacacgagctgtgagtctgtggtcacaagtggtcagcaccaccaacagcaaaacccagcagctccgcgtcctcaacgggacgcgaataacccagctggtctactagctatcgctgaggagaccttggcagagttcctgtcgaaagcgacaggaactgctgtcgattgggtgcaaatggttgggatgaagcctggtccggattccattggaatcatcgctgtttcgcacaattgtagtggcgtagcagcccgagcttgcggcctagtgagccttgagcccacaaaggtcgcggagatcctcaaggatcgcccttcttggtaccgcgactgccggtgcgtggatatcctccatgttatccctacgggtaacggaggaactatcgaacttatctacatgcagacttacgcaccgacaactttggcggcaccacgcgacttttggactctccgatacactagtggtcttgaggatggcagtcttgtgatctgtgagagatcattgacacaatcgactggaggcccatcaggacccaatactccaaactttgtcagagcggaggtgcttcctagtggctatttaattcgaccttgtgagggaggtggctccatgattcacattgtggatcatgttgatttagatgcttggagtgtgcctgaggtccttagaccactttatgaatctccgaagattcttgcacagaaaacaactattgctgcactgcgtcacattaggcaaattgcacatgaatcgagtggggaaatgccctatggagggggccgccagccagcggttttgagaacatttagccagaggcttagcaggggtttcaatgatgctgtcaatgggtttccagatgacggttggtcactgatgagcagtgatggtgctgaggatgttactattgctatcaactcttctccaaacaaacttattggtcctcatgtcaactcctcccagctgtttactacaattggaggtggcatcctgtgtgctaaggcatcaatgcttcttcagaatgtgccacctgccctactagtacgatttctgagggagcatcgctctgaatgggctgatcctggtgttgatgcttattctgctgctgctctgagggctagtccatatgcagttcctggcttgcgcgctagtgggtttatgggcagccaggttattctgccgcttgcacataccttagagcatgaagagttcttggaggttattaggcttgagggacacagcctctgccatgatgaagttgttctgtcacgagatatgtatcttctgcagttgtgcagtggcgtggatgaaaatgcagctggtgcttgtgcacagctagtctttgcacccatcgatgaatcttttgctgatgatgcaccactgctgccctcaggcttccgtgtcattccactggatgcaaagacggatccaccatcaggcacacgcacacttgacctagcatctactcttgaggttggatctggtgggactactcgtgcttcaagtgatgcctccagcacctgcaacacaagatcagtgctgaccattgctttccagttctcatatgagaatcacctacgggaaagcgtcgcagcaatggccaggcaatatgtcaggactgtggtggcatcggtgcagagggtggccatggcaatagctccttcccgtcttggtggacagcttgaaatgaagcaaactccaggatctcctgaggcgcacacgcttgcaaggtggatcggcaggagctacaggtttcacacaggagccgagctccttcgcacagacacccaatgcactgatgcttccttgaaagcactgtggcaacactcggactcgatcatgtgctgttccctgaaggctgctcctgtgttcaccttcgccaaccaagccggcctcgacatgctggagacgacgttgatcgctctccaggacatctcccttgagaagatccttgatgatgatggcaggaaggcgctctgcaccgagtaccctaagattatgcagcagggcttcgcatacctccccggcggcgtgtgtgtatcgagtatgggtcggccggtgtcctacgagcaggcggtggcgtggaaggtcctgagcgacgacgacaccccgcactgcctcgccttcatgttcgtgaactggtccttcgtgtga

SEQ ID NO: 15069 - protein, 854 aa, Sorghum bicolor
  misc_feature: Useful for making plants with altered carbohydrate content
  misc_feature: Functional homolog of the protein sequence given in SEQ ID NO 13708
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 2 in US patent 7056739
  misc_feature: Useful for making plants with altered lignin content
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: Ceres ANNOT ID no. 8633734
  misc_feature: Down-regulated in shoot tissues in response to salicylic acid treatment
  misc_feature (707)..(854): Pfam ID: MEKHLA Pfam Description: MEKHLA domain
  misc_feature (175)..(385): Pfam ID: START Pfam Description: START domain
  misc_feature (27)..(85): Pfam ID: Homeobox Pfam Description: Homeobox domain
MAMVVVGGGKDRSSPGGGGAPQVDTGKYVRYTPEQVEALERVYSECPKPSSLRRQQLIRECPILSNIEPKQIKVWFQNRRCREKQRKEASRLQTVNRKLTAMNKLLMEENDRLQKQVSRLVYENGYMRQQLHNPSAATTDTSCESVVTSGQHHQQQNPAAPRPQRDANNPAGLLAIAEETLAEFLSKATGTAVDWVQMVGMKPGPDSIGIIAVSHNCSGVAARACGLVSLEPTKVAEILKDRPSWYRDCRCVDILHVIPTGNGGTIELIYMQTYAPTTLAAPRDFWTLRYTSGLEDGSLVICERSLTQSTGGPSGPNTPNFVRAEVLPSGYLIRPCEGGGSMIHIVDHVDLDAWSVPEVLRPLYESPKILAQKTTIAALRHIRQIAHESSGEMPYGGGRQPAVLRTFSQRLSRGFNDAVNGFPDDGWSLMSSDGAEDVTIAINSSPNKLIGPHVNSSQLFTTIGGGILCAKASMLLQNVPPALLVRFLREHRSEWADPGVDAYSAAALRASPYAVPGLRASGFMGSQVILPLAHTLEHEEFLEVIRLEGHSLCHDEVVLSRDMYLLQLCSGVDENAAGACAQLVFAPIDESFADDAPLLPSGFRVIPLDAKTDPPSGTRTLDLASTLEVGSGGTTRASSDASSTCNTRSVLTIAFQFSYENHLRESVAAMARQYVRTVVASVQRVAMAIAPSRLGGQLEMKQTPGSPEAHTLARWIGRSYRFHTGAELLRTDTQCTDASLKALWQHSDSIMCCSLKAAPVFTFANQAGLDMLETTLIALQDISLEKILDDDGRKALCTEYPKIMQQGFAYLPGGVCVSSMGRPVSYEQAVAWKVLSDDDTPHCLAFMFVNWSFV

SEQ ID NO: 15070 - DNA, 786 bp, Sorghum bicolor
  misc_feature: Ceres ANNOT ID no. 8633751
  misc_feature: Down-regulated in shoot tissues in response to salicylic acid treatment
  misc_feature: Encodes the peptide sequence at SEQ ID NO 15071
atggcatttcgtggcggcaaagaggcaaggccaaagagcgccatcgaatcgtctcgtctcgtcccctccctcccctcctcttcctcgcccaatcccagacaaatccaatccgaaatcatctcccccctcgcctcgcctcgccgaggaagagcagagagaagcgacgccgcgttccttcctcccgcgtcgagctcgatcttcccggagccaccgcgggaggcgcagacgttgggacagcctcgcgcgcgcgtcccacgtatgcagagccagatcgtgtgccatgcttgccggaccgttctactctacccgcgaggcgcgtccagcgtctgctgcgccgtttgccaggccatcaccaccgtgccgccaccaggactggagatggctcagcttatatgtggtggttgtcgaactttgctgatgtatactcgcagtgcagacaccgtaaggtgttcatgttgcaacacagtcaatcttgttagaccagtgaataatatagctcatgtgaactgcggccagtgccggacaactttgatgtatccgtatggcgcaccttcagtaaaatgtgccatatgcaattatgtcacgactaccggagtaaatactgtggcacccactccatctgcgaggccaacatcaaatgagtcttcatatattggctcatctacttctgctcctaaatctcaacctcagaatgtaactgttgttgttgagaaccctatgacagttgacgacaagggaaaacttgtcagcagcgttgtagttggagtcacagctgggaaagtgtga

SEQ ID NO: 15071 - protein, 261 aa, Sorghum bicolor
  misc_feature: Useful for making plants with modulated oxidative stress sensitivity
  misc_feature: Functional homolog of the protein sequence given in SEQ ID NO 13490
  misc_feature: Ceres ANNOT ID no. 8633751
  misc_feature (170)..(194): Pfam ID: zf-LSD1 Pfam Description: LSD1 zinc finger
  misc_feature (132)..(156): Pfam ID: zf-LSD1 Pfam Description: LSD1 zinc finger
  misc_feature (93)..(117): Pfam ID: zf-LSD1 Pfam Description: LSD1 zinc finger
MAFRGGKEARPKSAIESSRLVPSLPSSSSPNPRQIQSEIISPLASPRRGRAERSDAAFLPPASSSIFPEPPREAQTLGQPRARVPRMQSQIVCHACRTVLLYPRGASSVCCAVCQAITTVPPPGLEMAQLICGGCRTLLMYTRSADTVRCSCCNTVNLVRPVNNIAHVNCGQCRTTLMYPYGAPSVKCAICNYVTTTGVNTVAPTPSARPTSNESSYIGSSTSAPKSQPQNVTVVVENPMTVDDKGKLVSSVVVGVTAGKV

SEQ ID NO: 15072 - DNA, 2295 bp, Sorghum bicolor; identical to SEQ ID NO: 14914
  misc_feature: Ceres ANNOT ID no. 8633796
  misc_feature: Encodes the peptide sequence at SEQ ID NO 15073

SEQ ID NO: 15073 - protein, 764 aa, Sorghum bicolor; identical to SEQ ID NO: 14915
  misc_feature: Useful for making plants with modulated flowering time
  misc_feature: Functional homolog of the protein sequence given in SEQ ID NO 14098
  misc_feature: Ceres ANNOT ID no. 8633796
  misc_feature (31)..(578): SWISSPROT Homolog: EC 3.4.21.25 Cucumisin
  misc_feature (365)..(464): Pfam ID: PA Pfam Description: PA domain
  misc_feature (34)..(110): Pfam ID: Subtilisin_N Pfam Description: Subtilisin N-terminal Region

SEQ ID NO: 15074 - DNA, 2130 bp, Sorghum bicolor
  misc_feature: Ceres ANNOT ID no. 8633805
  misc_feature: Encodes the peptide sequence at SEQ ID NO 15075
atggagtgcgagactggcctggtcgaccgcccccgccgcaacggttcagcagggccgcacgtcgtcgacgacgaccccttgaagtggggcaaggcggcggaggatcttacggggagccatctcgacgatgtgaggaggatggtggaggagtaccgcatgccgctggtgaagatcgacggcgccatgctcagcgttgccaaggtggcagccgtcgccggcgaggccacccgacgggttcaggtggtgctcgatgaatccgcacgaccccgcctagaggctagccgcgagtgggtcttcgacagcaccatgaacggcaccgacacctacggcgtcaccaccggcttcggcggcgcctcccaccgccgcaccaaggagttccgcgcgctccagacagagctcatccgatacctcaacgccggcgtgtttggagccagcagcagtgacggctacacgctgccggcggaggtgacgcgtgcggccatgctcgtgcgcatcaacaccctcacccagggctactcgggcatccgcttcgagatcctcgaggccatcgccaagctgctcaacgccaacgtgacgccgtgcctgccgctccggggctccatcaccgcgtccggcgacctggtcccgctgtcctacatcgccggcctcatcacgggccgcggtaactccgcggcggtggccccggacggcaccaaggtgggcgctgccgaggcgttcaggatcgccggcatcgaccacgggttcttcgcgctggagcccaaggaagggctcgccatcgtcaacggcacggccgtgggctccggtctcgcggcgatcgtgctcttcgaggccaacgtcctcgccgtccttgccgaggtcctctcggcggtgtactgcgaggtgatggccggcaacccggagtacaccgaccacctcatccacgcgctgaagcaccaccctggacagatcgaagctgcggccatcatggagcacgtactggaaggcagctcctacatgaagcttgccagggagcaggccgagcttgacccgctgacgaagccgaagcaggacaggtacgcgatccgaacgacgccgcagtggctcggcccgcaggtggaggtcatccgcttcgccaccaagtcgatcgagcgggagatcaactccgtcaacgacaacccggtcatcgacgtcgcccgcggcaaggcgctccacggcgggaacttccagggcacccccgtcggggtgtccatggacaacacgcgtctcgccgtcgctgccatcggcaagctcatgttcgcgcagttcaccgagcttgtcagcagcttctacagcaatggccttccctccaacctctccggcgggcgcgacccgagcttggactacggcttcaacggcgccgaggtcgccatggcgtcctactgctctgagctccagttcctcgccaacccggtgaccaaccatgtgcagaccgcggagcagcacaaccagagcgtcaactctctcgggctcatctcctccaggatgaccgcagaggccgtcaccatcctgaagctcatgtcctccactttcctgatcgccctgtgccaggccatcgacctgcggcaactcgaggagagcatcaaggccgctgttaaaaagtgcgtggcgcgtgtcgccaagaaatgtctggccatggacgacgacgccgccgccgccgccgcccagctgctcggcgctgttgatcgcgtggcggtgttcacgtacgcggaggacccgtgcagacccagcttgccactgatgcagaagctccgcgtggtgctcatggagcatgcgctcggcgccgccgagggggctgtggagacgacctccatcctggccaaggtggctgagttcgagcagcagctccgcgcggtgctgcccgacgaggtggaggccgcacgcgcggctgtggagagcggcacggcgccgaagaggatcgccgagtgccgctcgtacccgctgtacaggttcgtgcgcgaggagctcggcgccgagtacctgaccggcgagaagacgcggtcgcccggggaggaggtggacaaggtggtgatcgccatgaaccagcgcaagcacatcgacccactgctggagtgcctcagcgactggaaaggcgcgcccctgcatgccacttag

SEQ ID NO: 15075 - protein, 709 aa, Sorghum bicolor
  misc_feature: Useful for making plants with altered cell wall content and/or composition
  misc_feature: Useful for making plants with altered lignin content
  misc_feature: Functional homolog of the protein sequence given in SEQ ID NO 14131
  misc_feature: Ceres ANNOT ID no. 8633805
  misc_feature (1)..(706): SWISSPROT Homolog: EC 4.3.1.5 Phenylalanine ammonia-lyase
  misc_feature (55)..(554): Pfam ID: PAL Pfam Description: Phenylalanine and histidine ammonia-lyase
MECETGLVDRPRRNGSAGPHVVDDDPLKWGKAAEDLTGSHLDDVRRMVEEYRMPLVKIDGAMLSVAKVAAVAGEATRRVQVVLDESARPRLEASREWVFDSTMNGTDTYGVTTGFGGASHRRTKEFRALQTELIRYLNAGVFGASSSDGYTLPAEVTRAAMLVRINTLTQGYSGIRFEILEAIAKLLNANVTPCLPLRGSITASGDLVPLSYIAGLITGRGNSAAVAPDGTKVGAAEAFRIAGIDHGFFALEPKEGLAIVNGTAVGSGLAAIVLFEANVLAVLAEVLSAVYCEVMAGNPEYTDHLIHALKHHPGQIEAAAIMEHVLEGSSYMKLAREQAELDPLTKPKQDRYAIRTTPQWLGPQVEVIRFATKSIEREINSVNDNPVIDVARGKALHGGNFQGTPVGVSMDNTRLAVAAIGKLMFAQFTELVSSFYSNGLPSNLSGGRDPSLDYGFNGAEVAMASYCSELQFLANPVTNHVQTAEQHNQSVNSLGLISSRMTAEAVTILKLMSSTFLIALCQAIDLRQLEESIKAAVKKCVARVAKKCLAMDDDAAAAAAQLLGAVDRVAVFTYAEDPCRPSLPLMQKLRVVLMEHALGAAEGAVETTSILAKVAEFEQQLRAVLPDEVEAARAAVESGTAPKRIAECRSYPLYRFVREELGAEYLTGEKTRSPGEEVDKVVIAMNQRKHIDPLLECLSDWKGAPLHAT

SEQ ID NO: 15076 - DNA, 681 bp, Sorghum bicolor
  misc_feature: Ceres ANNOT ID no. 8633824
  misc_feature: Encodes the peptide sequence at SEQ ID NO 15077
atggaaaccaccgttgtgggagacctcatggcgaccgagctgaggcttggactgccgggcaccgtcgacgacagctgcagcctgcagagccaggtgaaggcgacgacgcctaggggcaagaagcgcgccaccaccgatgccgccgtggaggacgccgccgccgccgaggaggcaacaaacaagcgtgacgacgccgaggcagcacccccagcagccaaggcgcccgtggtcggttggccgccggtgaggtcgtaccggaagagctgcttccagcaggcgatcagcagcaagcagcaggtcagcaagcaggcggccaaagatgaggcggcggcggcgtcgcccagctgcacggcgccatccgtagccgccgcgaacaccaccgccagcgtcggcggcggctcgttcgtcaaagtgagcatggacggcgccccgtacctgaggaaggtggacctgaggatgtacaagggctacagggagctccgggaggccctggaggccatgttcgtctcctccaacagcggcagcgccaacctgtccgagttcgccgtcacctacgaggacaaggacggcgacctcatgctcgtcggagacgtgccgttcgagatgttcactagcacttgcaagaagctgaggatcatgaagagatctgaagccacaggcctgggatcagcgaggcaatga

SEQ ID NO: 15077 - protein, 226 aa, Sorghum bicolor
  misc_feature: The sequence is a functional homolog of SEQ ID NO 648 in the 11/479,226 US patent application
  misc_feature: The sequence is a functional homolog of SEQ ID NO 636 in the 11/479,226 US patent application
  misc_feature: The sequence is a functional homolog of SEQ ID NO 652 in the 11/479,226 US patent application
  misc_feature: The sequence is a functional homolog of SEQ ID NO 656 in the 11/479,226 US patent application
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 667 in the 11/479,226 US patent application
  misc_feature: The sequence is a functional homolog of SEQ ID NO 671 in the 11/479,226 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: Ceres ANNOT ID no. 8633824
  misc_feature (8)..(225): Pfam ID: AUX_IAA Pfam Description: AUX/IAA family
METTVVGDLMATELRLGLPGTVDDSCSLQSQVKATTPRGKKRATTDAAVEDAAAAEEATNKRDDAEAAPPAAKAPVVGWPPVRSYRKSCFQQAISSKQQVSKQAAKDEAAAASPSCTAPSVAAANTTASVGGGSFVKVSMDGAPYLRKVDLRMYKGYRELREALEAMFVSSNSGSANLSEFAVTYEDKDGDLMLVGDVPFEMFTSTCKKLRIMKRSEATGLGSARQ

SEQ ID NO: 15078 - DNA, 1059 bp, Sorghum bicolor
  misc_feature: Ceres ANNOT ID no. 8633829
  misc_feature: Encodes the peptide sequence at SEQ ID NO 15079
atggaggaagtggaggaggccaacagggaagccgtggagagctgccacagggtgctcgccttgctctcgcagccgcatgaccccgcacaggtcaggagcatagctctgggcacggacgaagcatgcgccaagtttaggaaggtggtctccctgctcagcaatggaggagtgggagtaggagaagccggaccatcaggcgcaagtggaagcggaagccatccgagagctaagcttgttagcagaagacagaatccagggttcttaactcagaaaggcttcctggatagcaacaccccggttgtggtgttgaacagcgcccatccttctcctgcctctgcgcaggtgtatcctagaactgctggagctctggatgcgcagggcgtgcatcccctcggaggaccgcctaagctggtccagcctttatctgcgcattttcagtttggcaatgtgtcgtcacggtatcagttccagaatcagcagcagcagcagcagaagttgcaggctgagatgttcaagagaagcaacagtggggttaacttgaagtttgagagcaccagtggcacggggacaatgtcatcggcgaggtccttcttgtcgtctttgagcatggatggtagtgtggctagcctggatggcaagtcatcgtcgttccatttgatcggtgggcctgcaatgagcgatccggtgaacgtgcagcaggccccaaggaggcgatgcacgggtcgtggggaggatgggactggcaagtgcgctgtgacagggaggtgccattgttcaaagagaagtaggaagttgcgggtaaagaggtcgattaaggttcccgccattagtaataagattgctgatatacctccggatgaatactcgtggaggaagtatgggcagaagccaattaagggttcccctcatcctaggggttactacaaatgcagtagtgtgaggggctgcccagctaggaagcatgttgaacggtgtgtagatgattcatcaatgctcattgtgacatatgagggcgagcacaaccacaccagaatgccaactcagtcagcacaggtttag

SEQ ID NO: 15079 - protein, 352 aa, Sorghum bicolor
  misc_feature: The sequence is a functional homolog of SEQ ID NO 736 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8633829
  misc_feature (284)..(344): Pfam ID: WRKY Pfam Description: WRKY DNA -binding domain
MEEVEEANREAVESCHRVLALLSQPHDPAQVRSIALGTDEACAKFRKVVSLLSNGGVGVGEAGPSGASGSGSHPRAKLVSRRQNPGFLTQKGFLDSNTPVVVLNSAHPSPASAQVYPRTAGALDAQGVHPLGGPPKLVQPLSAHFQFGNVSSRYQFQNQQQQQQKLQAEMFKRSNSGVNLKFESTSGTGTMSSARSFLSSLSMDGSVASLDGKSSSFHLIGGPAMSDPVNVQQAPRRRCTGRGEDGTGKCAVTGRCHCSKRSRKLRVKRSIKVPAISNKIADIPPDEYSWRKYGQKPIKGSPHPRGYYKCSSVRGCPARKHVERCVDDSSMLIVTYEGEHNHTRMPTQSAQV

SEQ ID NO: 15080 - DNA, 1026 bp, Sorghum bicolor
  misc_feature: Ceres ANNOT ID no. 8633849
  misc_feature: Encodes the peptide sequence at SEQ ID NO 15081
atggaggaggggctgccgccggggttccggttccacccgacggacgaggagctcgtcacctactacctcacccgcaaggtctccgacttcgccttcgccacccgcgccatcgccgacgtcgacctcaacaagtgcgagccatgggacctcccaagcaaagctagcatgggcgagaaagaatggtacttcttcagcatgcgtgacaggaaatacccgactggaatccggacgaaccgcgccactgattcaggctactggaagacgacgggcaaggacaaggagatcttccactgcggcatgctcgtggggatgaagaaaaccctagtcttctacaggggcagggctcccaagggccagaagaccagctgggtcatgcacgagtacaggctccagaacaagttcccctacaaaccaaacaaggaggaatgggtggtgtgcagggtgttcaagaagtgccaggtcatcaagatgagaccgccacaggacagccccacgatgggctccccatgccacgacgccggcaacgcctccctgggcgagctcggggagctcgacgtgtcctccatcctcggcggcctggccgccgccgcggcgcacacatcatccggctcgccgccgggcgtgctgcatcaccagggctccgccgccgccgccgagagcttcgtcggcgcccacaacaggccggtggacatgagcgcgtacatgagctggatggcggcggccaaccagggcgccgcagcggccgccgccatgcttccctgggccacgacgacgccgccgggattgttcggcaatgtcttcgcgccgaataaccaccagctgctgcagaagccgcttccgttcgccggcgggtgcagcggccagccgcgagggctcggtggcgtcgtggcaaacaacgtcgtcgtcggaagtggtgagcatgccatgttcgggagctccgtggtgaaggttggcatggaatgtgatcagcagcagcagccggagcagcagctggggatggacgagtcgacatggagaacattctga

SEQ ID NO: 15081 - protein, 341 aa, Sorghum bicolor
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 476 in the 10/666,642 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: Useful for making plants with altered cell wall content and/or composition
  misc_feature: Functional homolog of the protein sequence given in SEQ ID NO 14132
  misc_feature: Useful for making plants with altered lignin content
  misc_feature: Functional homolog of the protein sequence given in SEQ ID NO 12985
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 612 in the 11/435,388 US patent application
  misc_feature: Useful for biocontainment applications
  misc_feature: Functional homolog of the protein sequence given in SEQ ID NO 13623
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 890 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 891 in the 10/374,780 US patent application
  misc_feature: The sequence is a functional homolog of SEQ ID NO 854 in the 11/435,388 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: Useful for making plants with modulated nitrogen use efficiency
  misc_feature: Functional homolog of the protein sequence given in SEQ ID NO 13624
  misc_feature: Ceres ANNOT ID no. 8633849
  misc_feature (5)..(131): Pfam ID: NAM Pfam Description: No apical meristem (NAM) protein
MEEGLPPGFRFHPTDEELVTYYLTRKVSDFAFATRAIADVDLNKCEPWDLPSKASMGEKEWYFFSMRDRKYPTGIRTNRATDSGYWKTTGKDKEIFHCGMLVGMKKTLVFYRGRAPKGQKTSWVMHEYRLQNKFPYKPNKEEWVVCRVFKKCQVIKMRPPQDSPTMGSPCHDAGNASLGELGELDVSSILGGLAAAAAHTSSGSPPGVLHHQGSAAAAESFVGAHNRPVDMSAYMSWMAAANQGAAAAAAMLPWATTTPPGLFGNVFAPNNHQLLQKPLPFAGGCSGQPRGLGGVVANNVVVGSGEHAMFGSSVVKVGMECDQQQQPEQQLGMDESTWRTF

SEQ ID NO: 15082 - DNA, 252 bp, Sorghum bicolor
  misc_feature: Ceres ANNOT ID no. 8633858
  misc_feature: Encodes the peptide sequence at SEQ ID NO 15083
atgatgacaatgatgttacctgtatactcaggggtgctccttttacagggttatggtatgactaaaacatacgggataatatccctggagtacctgcaaaaggaagttgaggcaaaaattgttgattcaaagacaatgaagcatctgcctccgaaccaactaggagaaatctgtgttcgaggaccaaacataatggaagattatatttgcttatctttctgctttattgattgtgtttggttacaaatataa

SEQ ID NO: 15083 - protein, 83 aa, Sorghum bicolor
  misc_feature: Useful for making plants with altered cell wall content and/or composition
  misc_feature: Functional homolog of the protein sequence given in SEQ ID NO 14036
  misc_feature: Ceres ANNOT ID no. 8633858
MMTMMLPVYSGVLLLQGYGMTKTYGIISLEYLQKEVEAKIVDSKTMKHLPPNQLGEICVRGPNIMEDYICLSFCFIDCVWLQI

SEQ ID NO: 15084 - DNA, 1137 bp, Sorghum bicolor
  misc_feature: Ceres ANNOT ID no. 8633947
  misc_feature: Encodes the peptide sequence at SEQ ID NO 15085
atggccgacaaggagaactccgccgccgccgctgttgccgccgccccgccgcgcctcacccgcgccgcagccaagcgcgccgccgccgtcacggccgtggccgtcgccgccaagcgcaagcgcgtcgcgcttacccagctgcccacgcaccccaacgccgtgcacgacgactactacgatgacggcgacgacgacgacaagcccgtcaggaagcagcagcacctcctcgtccccgccgccaagcccaagcccaaggcagcgcccgcgcctgccgccgcctctgacgaggaggcggaggatccgcagctctgcaagccctacgcctccgacatctactcctacctccgctccatggagtcgcagcccaagcgccgccccgccgcggactacatcgccgcggtgcaggtcgacgtcacgcctaacatgcgcgccatcctcgtcgactggctcgtcgaggtcgccgaggagtacaagctcgtctccgacacgctctacctcaccgtctcctacgtcgaccgcttcctctccgccaacgccctcaacaggcagaggctgcagctcctcggcgtctgcgccatgctcgtcgcatccaagtatgaggagatcagcccgcccaatgtggaggatttctgctacatcaccgataacacctacaccaagcaggaggtagttaagatggagagtgatatactgaatgtcctcaagtttgaggtgggcaatcctacccccaagacgttcctgaggatgttcatcagatctgcccaagaagacaacaataagtgtcctagcctccagctggagttcctgggtaactacctgtgtgagctgagcttgctggactacagcttgcttcgcttcttgccatcacttgttgcagcctcagtggtgtttgttgcaaggctgacccttgatccacacaccaatccctggagcaagaagatgcagacactaactggctacaagccatctgagttgaaggactgtgttgctgccatacatcatatgcagctcaaccggaaatattcatccatgatggcgatccgggagaaatacaagcaacacaagttcaagggtgtatcagctttgctacctcctgttgagatcccagcatcatacttcaagaaactgaaggagtag

SEQ ID NO: 15085 - protein, 378 aa, Sorghum bicolor
  misc_feature: Useful for making plants with modulated nitrogen use efficiency
  misc_feature: Functional homolog of the protein sequence given in SEQ ID NO 13108
  misc_feature: Useful for making plants with modulated oxidative stress sensitivity
  misc_feature: Functional homolog of the protein sequence given in SEQ ID NO 13710
  misc_feature: Ceres ANNOT ID no. 8633947
  misc_feature (110)..(239): Pfam ID: Cyclin_N Pfam Description: Cyclin, N-terminal domain
  misc_feature (241)..(369): Pfam ID: Cyclin_C Pfam Description: Cyclin, C-terminal domain
MADKENSAAAAVAAAPPRLTRAAAKRAAAVTAVAVAAKRKRVALTQLPTHPNAVHDDYYDDGDDDDKPVRKQQHLLVPAAKPKPKAAPAPAAASDEEAEDPQLCKPYASDIYSYLRSMESQPKRRPAADYIAAVQVDVTPNMRAILVDWLVEVAEEYKLVSDTLYLTVSYVDRFLSANALNRQRLQLLGVCAMLVASKYEEISPPNVEDFCYITDNTYTKQEVVKMESDILNVLKFEVGNPTPKTFLRMFIRSAQEDNNKCPSLQLEFLGNYLCELSLLDYSLLRFLPSLVAASVVFVARLTLDPHTNPWSKKMQTLTGYKPSELKDCVAAIHHMQLNRKYSSMMAIREKYKQHKFKGVSALLPPVEIPASYFKKLKE

SEQ ID NO: 15086 - DNA, 1089 bp, Sorghum bicolor
  misc_feature: Ceres ANNOT ID no. 8633925
  misc_feature: Encodes the peptide sequence at SEQ ID NO 15087
atggaccgggcggcgctcaccgtggggccggggatggacatgcccataatgcacgacggcgaccgctacgagctcgtacgcgacatcggctccggcaacttcggcgtcgcgcgcctcatgcgcaaccgcgccgacggacagctcgtcgccgtcaagtacatcgagcgaggcgagaagatcgacgagaacgtgcagcgggagatcatcaaccaccgctccctgcgccaccccaacatcatccgcttcaaggaggtcatcctcaccccgacgcacctcgccatcgtcatggagtacgcctccggcggggagctcttcgagcgcatctgcaacgccggcagattcagcgaggacgaggcgcgtttctttttccagcaactcatatcaggggtcagctactgccattccatgcaagtatgccatcgtgacttgaagctagagaacaccctgttggacgggagcaccgcacctcgcctcaaaatatgtgatttcggctattcaaagtcatcagttctacactctcagccgaaatccacagtgggaactcctgcatacattgctcctgaggttcttctgaagaaggaatacgatggaaaggttgctgatgtctggtcatgcggagtaaccctttatgtgatgctggtcggtgcatatccatttgaggacccagatgagcctaagaattttaggaagacaattcagagaatattgggtgtgcagtactcaattccagactatgtccacatatctccagaatgccaagatcttatttctaggatttttgtcgccaacccagccactaggatcaccatccctgagataagaaaccatccttggttcttgaagaacctcccagctgacctaatggatgacagcacaatgagcaaacagtacgaggagcccgagcaaccaatgcagagcatggatgagatcatgcagatcctggctgaggcgaccattccagcagctggttctcgtggactcaaccagttcctgaacgacggccttgacctcgacgatgacatggaggacctagactcagatgccgatcttgacctggaaagcagtggggagatcgtgtatgctatgtga

SEQ ID NO: 15087 - protein, 362 aa, Sorghum bicolor
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 14093
  misc_feature: Useful for making plants with modulated water use efficiency
  misc_feature: Functional homolog of the protein sequence given in SEQ ID NO 14094
  misc_feature: Ceres ANNOT ID no. 8633925
  misc_feature (1)..(362): SWISSPROT Homolog: EC 2.7.11.1 Non-specific serine/threonine protein kinase
  misc_feature (23)..(279): Pfam ID: Pkinase Pfam Description: Protein kinase domain
MDRAALTVGPGMDMPIMHDGDRYELVRDIGSGNFGVARLMRNRADGQLVAVKYIERGEKIDENVQREIINHRSLRHPNIIRFKEVILTPTHLAIVMEYASGGELFERICNAGRFSEDEARFFFQQLISGVSYCHSMQVCHRDLKLENTLLDGSTAPRLKICDFGYSKSSVLHSQPKSTVGTPAYIAPEVLLKKEYDGKVADVWSCGVTLYVMLVGAYPFEDPDEPKNFRKTIQRILGVQYSIPDYVHISPECQDLISRIFVANPATRITIPEIRNHPWFLKNLPADLMDDSTMSKQYEEPEQPMQSMDEIMQILAEATIPAAGSRGLNQFLNDGLDLDDDMEDLDSDADLDLESSGEIVYAM

SEQ ID NO: 15088 - DNA, 507 bp, Sorghum bicolor
  misc_feature: Ceres ANNOT ID no. 8633995
  misc_feature: Encodes the peptide sequence at SEQ ID NO 15089
atgaaccagcccgtgcagaagaacaccctctacgtcggtgggctggcggaggaggtggacgagaagatcctgcacgccgcgttcgtgcccttcggcgaggtcaaggacgtcaagacgccgctggaccagtccacgcagaagcaccgctccttcggcttcgtcaccttccttgagcgcgaggacgccgccgctgccatggacaacatggacggcgccgagctcttcggccgcgtgctcaccgtcaactacgccttccccgagcgcatcaagggaggggagcagggatgggctgcccagccaatttgggccgatgcggacacttggtttgagaggcagcagcaggaagaggagatgcagcggctgcaggcagagcaccgtgcagcaatgcaggcagcagagaagctgcacagggagaaactggctgccgaaagggagggcgagaaagaagaagagacagcagatcccatggctgctgcagaggctcaggctgtgaaacaaagttcttaa

SEQ ID NO: 15089 - protein, 168 aa, Sorghum bicolor
  misc_feature: Useful for making plants with altered lignin content
  misc_feature: Useful for making plants with altered terpenoid content
  misc_feature: Functional homolog of the protein sequence given in SEQ ID NO 14133
  misc_feature: Ceres ANNOT ID no. 8633995
  misc_feature (7)..(108): SWISSPROT Homolog: EC 5.2.1.8 Peptidylprolyl isomerase
  misc_feature (10)..(81): Pfam ID: RRM_1 Pfam Description: RNA recognition motif. (a.k.a. RRM, RBD, or RNP domain)
MNQPVQKNTLYVGGLAEEVDEKILHAAFVPFGEVKDVKTPLDQSTQKHRSFGFVTFLEREDAAAAMDNMDGAELFGRVLTVNYAFPERIKGGEQGWAAQPIWADADTWFERQQQEEEMQRLQAEHRAAMQAAEKLHREKLAAEREGEKEEETADPMAAAEAQAVKQSS

SEQ ID NO: 15090 - DNA, 2178 bp, Sorghum bicolor
  misc_feature: Ceres ANNOT ID no. 8634028
  misc_feature: Encodes the peptide sequence at SEQ ID NO 15091
atggagttcaacgacaaatctagttctaactttgaggatttccaaagcaacatgtcggctacttctgggttctatgccttggttgatccagccgatgagtcaaatgatttggagtcatttttgcaccaaccaagatccaagcatcattatcctcctgtatcaaatacttttagcgatagtgaccatattacattgagcaccccctattcgagtacagtagatggtcctcaattctgtgacctcagtagcaatgcggcaccagattggtatggaaccagtgtagcagactcttctaataacagttggaccaactcagatataaccatcgactacttaaacaagctgttgatggacgaggacgatgaggataaggtaaaattacatcatggagagtgcgcccttagagctatggaagagcctttctatagaattcttggacaaaataatccagcttatcctgagtcaccatcactttgtagctgtggtcatctgaataacctcgacgacagcatcaacaagtcttctgggctctcatgcagtagctgctctgttgctattgattcaagtaatagtcattctaatcacaacttgcaagcttttgaagctccatggagtttgtctgacatagtcaaagagacaaaacgttccactgaaggtacacgaaacatggagtttggtgtgaaaattgatggcctctcaattgctgaaaagcgtagccgagataatcagtcacttcaggtaaatgctgcagatacgagcaagcatgcatcatctgaggttcacagtggatatttctcaagtacagaagattcttatttgtcagaagcaagaagtagcaagcaggttgccttttcattcaatgagccaacccgagatgagatgtttgacagggttctactcttctctgagcataaacctacagatgaagctattgttttgcaagaaatgatgacaaacaaatcaaccggacattcacagaatgaacaaggaagaacatcagctcggcggaagacacgaggaaagaagcaacagaagaaagaggtggtggatctaagagccattcttatccattgtgcacaagcagtatctgtgaataaccataccttagcaaatgacatgcaacattcctcaataactggggacgatacccagaggctagcattttgtctagtggactgccttgaggtgcgattagctggaactgggtgtcagctgtatcgcaaattgatcactaaaagcagcaacgctgtggccattttaaaggtattacaattgtctttagcggtaaatcctttattgagggcatcattttatttctcaaataagacaatccttgatgtctcgaagggaaaatctaaggtgcacattatcgattttggcatttgctttggatttcaatggccatcactgtttgagcaactcgcaaagagggaagatgggccgcccaaggttcggatcacaggtattgagcaaccaatgcaaggatttcgaccaaaccaaatgaataagcagaacacgggacagcgattagctgattatgctagcatgttcaatgtgccttttgaatatcaagcaatatcatcaatgtgggaaaccataagtatagaagatcttaacattgaggaagatgatgtgctgatagtcaactgcatagaccgaatgaagattctgggtgatgagacagtatccataaacagcgcaaggaataaggttctcaataccattagaatgatgaagccaaaaatttttgtgcatggagtagtgaatggatcatacggtacccccatctttttaacacgttttaaagaagtaatgtaccattactctgcattatttgatatctttgataaaactgttccacgagataatgagacaagattgcacatagagaggagcatgtttctgtcccaacttctcaatgtcatcgcatgtgaaggatccgaaaggattgagaggccagagaattataagaaatggaagtcacgaagcctgaatgctggccttgagcagctcccactgaatccagacattgtggaagtaataagagaaatggtgggaaaatatcacaaagattatgttatctacgaagatgatcagtggctactactaggatggaagggaaggatactgaatggaatatccacatggaaacctagtgagtcatatgttggtgactaa

SEQ ID NO: 15091 - protein, 725 aa, Sorghum bicolor
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
  misc_feature: Ceres ANNOT ID no. 8634028
  misc_feature (326)..(627): Pfam ID: GRAS Pfam Description: GRAS family transcription factor
MEFNDKSSSNFEDFQSNMSATSGFYALVDPADESNDLESFLHQPRSKHHYPPVSNTFSDSDHITLSTPYSSTVDGPQFCDLSSNAAPDWYGTSVADSSNNSWTNSDITIDYLNKLLMDEDDEDKVKLHHGECALRAMEEPFYRILGQNNPAYPESPSLCSCGHLNNLDDSINKSSGLSCSSCSVAIDSSNSHSNHNLQAFEAPWSLSDIVKETKRSTEGTRNMEFGVKIDGLSIAEKRSRDNQSLQVNAADTSKHASSEVHSGYFSSTEDSYLSEARSSKQVAFSFNEPTRDEMFDRVLLFSEHKPTDEAIVLQEMMTNKSTGHSQNEQGRTSARRKTRGKKQQKKEVVDLRAILIHCAQAVSVNNHTLANDMQHSSITGDDTQRLAFCLVDCLEVRLAGTGCQLYRKLITKSSNAVAILKVLQLSLAVNPLLRASFYFSNKTILDVSKGKSKVHIIDFGICFGFQWPSLFEQLAKREDGPPKVRITGIEQPMQGFRPNQMNKQNTGQRLADYASMFNVPFEYQAISSMWETISIEDLNIEEDDVLIVNCIDRMKILGDETVSINSARNKVLNTIRMMKPKIFVHGVVNGSYGTPIFLTRFKEVMYHYSALFDIFDKTVPRDNETRLHIERSMFLSQLLNVIACEGSERIERPENYKKWKSRSLNAGLEQLPLNPDIVEVIREMVGKYHKDYVIYEDDQWLLLGWKGRILNGISTWKPSESYVGD

SEQ ID NO: 15092 - DNA, 486 bp, Sorghum bicolor
  misc_feature: Ceres ANNOT ID no. 8634036
  misc_feature: Encodes the peptide sequence at SEQ ID NO 15093
atggtgctgaagaccgaactttgccgcttcagcggccagaagatttatcctgggaagggcatccgatttattcgcgctgattctcaggttttcctttttgccaactcgaaatgcaagcgctacttccacaaccgtctgaagcctgcaaagcttacctggacagcaatgtacaggaagcagcacaagaaggatatccatgctgaagctgtgaagaagaggcgccgcaccaccaagaagccatactccaggtcaattgtgggtgcctccctggaagtgatccagaagaagagagctgagaagcccgaggtgcgcgatgctgctagggaagctgctcttcgcgagatcaaggagcgcatcaagaagaccaaggatgagaagaaggcaaagaaggcggaggtgaccaagtcccagaagtcgcagtcgaagggcgcggttcagaagggttccaagggccccaagctgggcggcggcggcggcaagcgctga

SEQ ID NO: 15093 - protein, 161 aa, Sorghum bicolor
  misc_feature: Useful for making plants with modulated nitrogen use efficiency
  misc_feature: Functional homolog of the protein sequence given in SEQ ID NO 14134
  misc_feature: Ceres ANNOT ID no. 8634036
  misc_feature (3)..(73): Pfam ID: Ribosomal_L24e Pfam Description: Ribosomal protein L24e
MVLKTELCRFSGQKIYPGKGIRFIRADSQVFLFANSKCKRYFHNRLKPAKLTWTAMYRKQHKKDIHAEAVKKRRRTTKKPYSRSIVGASLEVIQKKRAEKPEVRDAAREAALREIKERIKKTKDEKKAKKAEVTKSQKSQSKGAVQKGSKGPKLGGGGGKR

SEQ ID NO: 15094 - DNA, 3162 bp, Sorghum bicolor
  misc_feature: Ceres ANNOT ID no. 8634033
  misc_feature: Encodes the peptide sequence at SEQ ID NO 15095
atggccatctcggaggaaccagagggggccgcgggcgatggtggtggggtgacgacgcgcgggagcaaagggcgggggaaaggcgccgcgaaggggcgcgggaggcccaagcgccggagcgacgacaggcccttcgcggcgccggcgatggatggggtggcgttcagggacatggtgcttagggagaggaggcacgcggccaacgtcttctgcgagcgcgacaccgatgatgacaatgaggagattgccaccaaccaattcaagcctcagagaaagaagagaaatgatgctggcaagaagaggggtcctagaaaaacgaaaccagaacatgtggacaacagcaaggccgacttccccaacagcaaatgccacggtgacatgaagggggatggttccgagacagttagggacaaggttttacagactgcaaagaagaggaagaaaggagatgcagggaaggtttctgtcacaaaaaggttgaaaagagagaatgaagaacaaaagaaggccttatcctccaagcgtaaagattgtgatgaaactaaaaggaaagggaagaagatgttgactggggataatgccctgatgtgccaccagtgccaaaggaatgataaagggagggtggtctggtgtaattcatgcaagaataagcgcttctgcgtgccatgcatccaacgatggtatcctggtttgtcagaagatgaatttgcttcacaatgcccgtattgtcgcaagaactgtaattgcaagggatgcctacgaatgcgaggagttgaagagccaccaaagaagaaaatttctgaaggaaatcaaatccattatgcttgtcatgttctgcacttgttgcttccctggttgagacaactgcgacaggagcagacggaggagaagaaattagaggctaaaatacaaggtgtttcgatgaatgaggtgaagttggaacaggctgaatgtgatatagatgaacgcgtcttctgcaataactgtaaaacttctgtagttgattttcatagaagctgcaagtactgtttttatgatttgtgcctttcatgctgtggggagatccgcaaaggtgagattcctggaggagaggaggtaaagatcttagagcctgaaccaaaagacaagacttatatttttgctaccaataatcagttccaatggaaaaatgtgtcttccaatggaatgggttctagtgaggccccaaagaagtctctactactgtggaaatcagaaagtgatggtagcatatgttgcccaccgaaggagctaggaggctgtggtggttcagttttggacctcaaatgcttgttcccagagaaattactttctgacttagaagaacgagctgacagaattgtgaggagtaaagtatttgcaaaagcagtaaccaaaagaattgatcagtgcccttgttatgaccattcaggaagtgtaagaattcatgatgtgcgagaggctgcaaataggaaaggctcaagtgataatcacatctactgcccagttgccactgccatcaaggaggatgacttagtgcactttcagatgcattggacaaaaggtgagccagttatagtttctgacgttcttcagttgacctctggtctcagttgggagccattagttatgtggcgggcattgcgagagaaaaagactaatggtgatgttgaagatgagcactttgctgtcagggcaatagactgccttgattggaatgaggtggaaattaatatacatatgttttttatgggatatatgaaaggcagaatgcacaccacagtacactggcctgagatgcttaagctgaaggactggccaccatctagttcatttgatcagaggttgcctcgccatggcgctgagtttatcagtgcattgccatttcctgagtacactgatcctcgatatggtccactaaatcttgcagtcaagcttcctgatggtgcactgaagccagatcttggacccaaaacttacattgcttatggatttcaccaagagttaggcaggggtgattctgtgaccaagcttcactgcgacatgtctgatgtaaatatattaacacatacaacacaagtgacctatgagggttatcaacataagaagatagagaaactcagaaagaaaatgaaagaacaagatcttcaggaactttatggtgttttagaatctggcactgaacgagacctattatcatcttctactgattccaggaatttaaccattgacgaaacatcaaagatctcatgtaaagatgcaggccagtgttcagattacattgacaagaataatagttatgctgggatgcataatggtgctcagtgtattacgggcaagagtggagaccatgagaaaactggtggtgctttgtgggatattttccgaagagaagattctgacaagctacaagattatcttaggaaacatgccaaagaattccggcatatcaattgcaatcctgtgaaacaggttattcacccaattcacgatcagattttctacttaactgaggagcataagagaaagctcaaggaagaatatggtgttgaaccctggacgtttgagcagaggcttggtgaagcggtttttattcctgctggatgtcctcaccaagtgaggaatctgaagtcttgcatcaaggttgcaatggactttgtttccccagaaaacgtcgatgagtgcataaaactgactggagagtttaggcgacttccacctggtcacagggctaaagaggataaactggagattaagaagattgctcttcatgctctgaaccaagtaataaatttcttggatcctttctctgaggggttgaagagtggagctgcccaacccaagaataaaaaagaagctgatgctgatgctgaagcacagaagaagcctaaaaggggtcgcccatgtcgcaagtcgaacgatgaagctactgacgataagcccaaaaagaagcctggtcgtcccagaggtgagaagagcggagacggcaagtccaaagatggtgctgttgatgagaagcctcctaaaatgcagggcaatcgcctgaaaggctctagcaagcggtgcactgaaaaggtttgcgacgactttgatctatatagatgggaaaagtgccgcaatcacaacggctttgatccttccaaatgcagtcgaccagaaaaataa

SEQ ID NO: 15095 - protein, 1053 aa, Sorghum bicolor
  misc_feature: The sequence is a functional homolog of SEQ ID NO 959 in the 10/666,642 US patent application
  misc_feature: The sequence is a functional homolog of SEQ ID NO 957 in the 10/666,642 US patent application
  misc_feature: Ceres ANNOT ID no. 8634033
  misc_feature: Up-regulated in shoot tissues in response to methyl jasmonate treatment
  misc_feature (764)..(885): Pfam ID: JmjC Pfam Description: JmjC domain
MAISEEPEGAAGDGGGVTTRGSKGRGKGAAKGRGRPKRRSDDRPFAAPAMDGVAFRDMVLRERRHAANVFCERDTDDDNEEIATNQFKPQRKKRNDAGKKRGPRKTKPEHVDNSKADFPNSKCHGDMKGDGSETVRDKVLQTAKKRKKGDAGKVSVTKRLKRENEEQKKALSSKRKDCDETKRKGKKMLTGDNALMCHQCQRNDKGRVVWCNSCKNKRFCVPCIQRWYPGLSEDEFASQCPYCRKNCNCKGCLRMRGVEEPPKKKISEGNQIHYACHVLHLLLPWLRQLRQEQTEEKKLEAKIQGVSMNEVKLEQAECDIDERVFCNNCKTSVVDFHRSCKYCFYDLCLSCCGEIRKGEIPGGEEVKILEPEPKDKTYIFATNNQFQWKNVSSNGMGSSEAPKKSLLLWKSESDGSICCPPKELGGCGGSVLDLKCLFPEKLLSDLEERADRIVRSKVFAKAVTKRIDQCPCYDHSGSVRIHDVREAANRKGSSDNHIYCPVATAIKEDDLVHFQMHWTKGEPVIVSDVLQLTSGLSWEPLVMWRALREKKTNGDVEDEHFAVRAIDCLDWNEVEINIHMFFMGYMKGRMHTTVHWPEMLKLKDWPPSSSFDQRLPRHGAEFISALPFPEYTDPRYGPLNLAVKLPDGALKPDLGPKTYIAYGFHQELGRGDSVTKLHCDMSDVNILTHTTQVTYEGYQHKKIEKLRKKMKEQDLQELYGVLESGTERDLLSSSTDSRNLTIDETSKISCKDAGQCSDYIDKNNSYAGMHNGAQCITGKSGDHEKTGGALWDIFRREDSDKLQDYLRKHAKEFRHINCNPVKQVIHPIHDQIFYLTEEHKRKLKEEYGVEPWTFEQRLGEAVFIPAGCPHQVRNLKSCIKVAMDFVSPENVDECIKLTGEFRRLPPGHRAKEDKLEIKKIALHALNQVINFLDPFSEGLKSGAAQPKNKKEADADAEAQKKPKRGRPCRKSNDEATDDKPKKKPGRPRGEKSGDGKSKDGAVDEKPPKMQGNRLKGSSKRCTEKVCDDFDLYRWEKCRNHNGFDPSKCSRPEK

SEQ ID NO: 15096 - DNA, 1884 bp, Sorghum bicolor
  misc_feature: Ceres ANNOT ID no. 8634093
  misc_feature: Up-regulated in shoot tissues in response to methyl jasmonate treatment
  misc_feature: Encodes the peptide sequence at SEQ ID NO 15097
atggcggggagaggcggaggcggaggcggcggcggcaagggcgcggcggggaggatgatgtcgctgcaggagttcgtgtcctccatggccccgctcatcgatctcgagaaggcggcggagataacggcggagtccgagacgagcgccaagagcctggagaggcggggctgcgtcattgcaaacctcaagtgcaccgatgcccagtttggaacgcatgatgtggttgccctgaagccaaataaggcagatgccggatctgcttcgcttggtcaaggtgtggtttatcgcttaaaggattcttccattactgttgcttttgatgatattcctgaagatggtttaaatagccctctgcgtcttgagaagcttgcaaatgaggtcacttatcggaggatgaaggatgcactaattgaacttagcaaggctgtccaaacaggaccttgtgcaaaccttgttcctgttttatttggagagaaggcacccatgcgctccaaggatactatgaaattcagtccattcaataagaacttggatgattcacagaaagaggctatttcaaaggctcttggatcaagggatgttttcttgcttcatggacctcctggaactgggaaaacaacaactattattgagataatattgcaggaggtcaagcgtggatcaaagattcttgcctgtgctgcttctaatattgctgtggataatattgttgaacgacttgcacgatacaggacaaaattggtgaggttagggcaccctgctcgtttactgccccaagtgctcgacagcgctcttgatgcacaggtattacgagctgataatagcagcttggcaggagacattcgcaaggaaatgaaggtgcttaatagcaaattgctgaaggctaaagataggaacactaaacgggacatcaggaaagagctcagagcccttgcaaaagaggagagaaaaagacagcagcttgcagtcactgatgtactgaaaaacgctgatgttgtgctgacaactttgactggcgcatcttcaaaaaagctaaacggaattacatttgatttggttgttattgatgaagctgctcaggcacttgaggtggcatgctggatagccttgttgaaagggccaagatgtattcttgctggagaccatcttcaacttcctccaacaattcaaagtgttgaggctgaaaagaaggggatgggaaagacactctttgaacgccttactgaagcatatggagaggaaatcacatccatgctcactgtccagtacagaatgcacgagcacattatgagctggtcatctaaagaactttacaataataagatcaaagcacattctagtgttgctgggcatatgctctatgatcttgaagaagtcactagatcttcttcaacagaaccaactattatactcattgacactacagggtgtgatatggaagaagtaaaagacgaagaggagagcaccatgaatgaaggcgaggcagcagtatccatcgcccatgccaagttgcttgttgagagtggcgttaatgcttctgatattggaataattactccttactctgcacaggtaacctgcctgaagatgatgagaaacaaagatgctaaattgaaagatttagagatatcgacagttgatgggtttcagggccgggagaaagaagccatcatcatttcaatggtccggtctaactcaaagaaagaggtggggttcttgagtgatcacaggcggatgaacgtggcggtgacacgcgccaggaggcagtgctgtctggtgtgtgacgtggagaccgtgagcaacgacaggttcctgaaacgcttggtcgaatacttcgaggagaacggggagtacttgagtgcttcagaataccagagcagctga

SEQ ID NO: 15097 - protein, 627 aa, Sorghum bicolor
  misc_feature: Useful for making plants with modulated salt sensitivity
  misc_feature: Functional homolog of the protein sequence given in SEQ ID NO 13507
  misc_feature: Ceres ANNOT ID no. 8634093
MAGRGGGGGGGGKGAAGRMMSLQEFVSSMAPLIDLEKAAEITAESETSAKSLERRGCVIANLKCTDAQFGTHDVVALKPNKADAGSASLGQGVVYRLKDSSITVAFDDIPEDGLNSPLRLEKLANEVTYRRMKDALIELSKAVQTGPCANLVPVLFGEKAPMRSKDTMKFSPFNKNLDDSQKEAISKALGSRDVFLLHGPPGTGKTTTIIEIILQEVKRGSKILACAASNIAVDNIVERLARYRTKLVRLGHPARLLPQVLDSALDAQVLRADNSSLAGDIRKEMKVLNSKLLKAKDRNTKRDIRKELRALAKEERKRQQLAVTDVLKNADVVLTTLTGASSKKLNGITFDLVVIDEAAQALEVACWIALLKGPRCILAGDHLQLPPTIQSVEAEKKGMGKTLFERLTEAYGEEITSMLTVQYRMHEHIMSWSSKELYNNKIKAHSSVAGHMLYDLEEVTRSSSTEPTIILIDTTGCDMEEVKDEEESTMNEGEAAVSIAHAKLLVESGVNASDIGIITPYSAQVTCLKMMRNKDAKLKDLEISTVDGFQGREKEAIIISMVRSNSKKEVGFLSDHRRMNVAVTRARRQCCLVCDVETVSNDRFLKRLVEYFEENGEYLSASEYQSS

SEQ ID NO: 15098 - DNA, 1122 bp, Sorghum bicolor
  misc_feature: Ceres ANNOT ID no. 8634126
  misc_feature: Encodes the peptide sequence at SEQ ID NO 15099
atggcacataacatacaacctatacacaaggacagaggccgcactatacccaatgtgtcaagccttacaccatttaaggtgtatgttggttgccaaagctgggaaactgcgctcatagttcaggccttttgttcaacagggcttactgaggagttttgttcaacccttcaaaaagctcaccagttcttacaaaatgcacagattactgaggacattcctaattacaaaagctactatcgtgaaagaacaaaaggttcttggactctatccaatggagaaaacgtttgggctattgctgatactaatgctgaagcacttaaggcaatactgctgctgtctgacattccttcagaacttgtcgggaatacaatcaaacaagaacggttgtatgatgctattgattgcctcctttcttttgtgaacaaagatggtacattgtcatcagctgaatgtaaacgaacaacttcatgggtggagtttatcaatccttctgagagttttcgtaatatcatcgtcgactatccgtatcctgaatgcacatcatcattaatacaagttttaatattgtttagagacaagtgtccaatgtatcgtcgcgaggagatagacaaaattatcaaaagtggtgcatcattcattgagaaagtacagcgaaaggatgggtcctggtacggctcttgggctgtgtgtttcacttatgcaacattcttcggtataaaaggattagctgatgcaggaagaacataccagaacagtttgcctatcaggaaagcatgcaacttcttgttgtcaaagcagctagcaaccggtggatggggagagagctacctcagctgtcaaactgaggagtatgttgatagtggcaggccacatgcagtgcagactgcacaggcgatgctagctttactttacgctggacaggttgaacaagatccagcgccactataccgtgctgcaaaagaattaatcaacatgcagatggagaacggagaatttccccaacaagaaattgttggcaacttcaactcctcacttttctttaattaccccaacttccggaacttatttcccatctgggctctaggagagtttcgccgccgacttcttgcaaaaaagagttaa

SEQ ID NO: 15099 - protein, 373 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: Ceres ANNOT ID no. 8634126
  misc_feature (28)..(372): SWISSPROT Homolog: EC 5.4.99.8 Cycloartenol synthase
  misc_feature (204)..(246): Pfam ID: Prenyltrans Pfam Description: Prenyltransferase and squalene oxidase repeat
  misc_feature (253)..(306): Pfam ID: Prenyltrans Pfam Description: Prenyltransferase and squalene oxidase repeat
MAHNIQPIHKDRGRTIPNVSSLTPFKVYVGCQSWETALIVQAFCSTGLTEEFCSTLQKAHQFLQNAQITEDIPNYKSYYRERTKGSWTLSNGENVWAIADTNAEALKAILLLSDIPSELVGNTIKQERLYDAIDCLLSFVNKDGTLSSAECKRTTSWVEFINPSESFRNIIVDYPYPECTSSLIQVLILFRDKCPMYRREEIDKIIKSGASFIEKVQRKDGSWYGSWAVCFTYATFFGIKGLADAGRTYQNSLPIRKACNFLLSKQLATGGWGESYLSCQTEEYVDSGRPHAVQTAQAMLALLYAGQVEQDPAPLYRAAKELINMQMENGEFPQQEIVGNFNSSLFFNYPNFRNLFPIWALGEFRRRLLAKKS

SEQ ID NO: 15100 - DNA, 969 bp, Sorghum bicolor
  misc_feature: Ceres ANNOT ID no. 8634119
  misc_feature: Encodes the peptide sequence at SEQ ID NO 15101
atggcgttgtggaacggtggtggtggagcctttccggcggcggccgtgctggtggctgcggccgtggcggcgctgctgggcgccggggtgggcgccaccaagttcgacgacgtggtgcagcccagctgggccaacgaccacatggtgtacgacggcgacctcctcaagctccgcctcgacgccaactccggcggaggcttcgtgtccaggagcaagttcctgtacggcaaggccagcgccgacctcaagctcgtgccgggtgactccgccggcgtcgtcaccgctttctatctgtcgtcggccggggacaagcacaacgagttcgacttcgagttcctgggcaacgtgaccggcgagccgtacctggtgcagacgaacctgtacatcgacggcgtgggcaacagggagcagcgcatcgacctgtggttcgaccccaccgccgacttccacacctacgccgtgctgtggaaccccagccaggtggtgttcatggtcgacgacacccccatccgcgtctacgagaaccgccagaacgccacggtgcacggccaccaccaccgcagcaacaacgccaccacatccacagcatcgccgccgccgttcccggggccgcagccgatggccgtgtacagctccatctggaacgcggacgactgggcgacgcagggcgggcgcgtgaagacggactggtcgcacgcgccgttcgaggccacgttccgggaggtgcgcgtggacggctgcgcctgggcggccaacgccaccgacggcgacgccggggaggtccggcggtgcagcgagacgtcgtggggaaaagaaggccggtactggtggaaggagaaggagatgtcggagctgtctgtgcaccagagccaccagctcgtgtgggcgcgcgcgcaccacctcgtctacgactactgcgtcgacaccgaccgcttccccgttcagccgcctgagtgcgccggccgctga

SEQ ID NO: 15101 - protein, 322 aa, Sorghum bicolor
  misc_feature: Useful for making plants with altered cell wall content and/or composition
  misc_feature: Functional homolog of the protein sequence given in SEQ ID NO 13782
  misc_feature: Useful for making plants with altered carbohydrate content
  misc_feature: Functional homolog of the protein sequence given in SEQ ID NO 13783
  misc_feature: Ceres ANNOT ID no. 8634119
  misc_feature (34)..(175): SWISSPROT Homolog: EC 2.4.1.207 Xyloglucan:xyloglucosyl transferase
  misc_feature (35)..(232): Pfam ID: Glyco_hydro_16 Pfam Description: Glycosyl hydrolases family 16
  misc_feature (264)..(319): Pfam ID: XET_C Pfam Description: Xyloglucan endo-transglycosylase (XET) C-terminus
MALWNGGGGAFPAAAVLVAAAVAALLGAGVGATKFDDVVQPSWANDHMVYDGDLLKLRLDANSGGGFVSRSKFLYGKASADLKLVPGDSAGVVTAFYLSSAGDKHNEFDFEFLGNVTGEPYLVQTNLYIDGVGNREQRIDLWFDPTADFHTYAVLWNPSQVVFMVDDTPIRVYENRQNATVHGHHHRSNNATTSTASPPPFPGPQPMAVYSSIWNADDWATQGGRVKTDWSHAPFEATFREVRVDGCAWAANATDGDAGEVRRCSETSWGKEGRYWWKEKEMSELSVHQSHQLVWARAHHLVYDYCVDTDRFPVQPPECAGR

SEQ ID NO: 15102 - DNA, 1272 bp, Sorghum bicolor
  misc_feature: Ceres ANNOT ID no. 8634124
  misc_feature: Encodes the peptide sequence at SEQ ID NO 15103
atgtggcggctaaagatcggcgagaggccaagcaacccgttgcttcggtcgccgaatggcttctttgggcgggaggtgtgggagttcgaccccgccgccggcacgccggaggagcgcgccgaggtggagaggctgcgccgggagtacacccgcaaccgcttcacgcaccgggagtgcagtgaccttctcatgcggatgcaggaaatgtatacaaaacagaaccttcatagtacaaaccttccatctatcaagattgacaatgattcagaagccacgggagaaactatactagctgtgttgaggcgtgcccttagtcaattttcttctttgcaaggaccggatgggcattggcctgggggttacagcgggattttgttcattctaccactcatgatatttgcattacatgtcacacgatcactacatgaagttttgtcaatagagcatatacatgagatatgtcgctacatttataacatccagaatgaggatggaggctggggaacacataccttgggaccaagctccatgtttggcacatgcgtaaactatgcaaccttaaggattctaggagaggtgcttgatggagaaaatgatgcattatccaaagggcgtgcctggattttgtctcatggaactgcaactgcagcaccacaatgggcaaagatatatctctcggtggtaggtgcatatgattggtctgggaacaatgcaattattcctgagttatggatgcttccacattttctcccaattcatcctggaagattttggtgcttttgtcgaatggtttacatgccaatggcttacatttatggaaaaaagtttgttggacctatcactccaactattttggcaataagaaatgagatctacaatataccatataatgagatcgattggaacaaggctcgcaattcttgcgccaaggaagaccttatctatcgccgttcatggttgcaaagtgttgcactcgcttatttaaataactttgtagaaccattatcaaatctctggccgatgaataagctacgagaaagagctatgagcaacctcatggaacatatccactacgaagatgaaaacagcaactatgttggcttatgccctattaacaaggtcttaaatatgatatgttgttggatagaaaaaccaaactcccatgaatttagacaacatctcccaaggattcatgactttttgtggattgctgaagatggaatgaagtcaaaggtactattttttgtgctttgttctcactactataaataa

SEQ ID NO: 15103 - protein, 423 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: Ceres ANNOT ID no. 8634124
  misc_feature (1)..(409): SWISSPROT Homolog: EC 5.4.99.8 Cycloartenol synthase
  misc_feature (148)..(191): Pfam ID: Prenyltrans Pfam Description: Prenyltransferase and squalene oxidase repeat
MWRLKIGERPSNPLLRSPNGFFGREVWEFDPAAGTPEERAEVERLRREYTRNRFTHRECSDLLMRMQEMYTKQNLHSTNLPSIKIDNDSEATGETILAVLRRALSQFSSLQGPDGHWPGGYSGILFILPLMIFALHVTRSLHEVLSIEHIHEICRYIYNIQNEDGGWGTHTLGPSSMFGTCVNYATLRILGEVLDGENDALSKGRAWILSHGTATAAPQWAKIYLSVVGAYDWSGNNAIIPELWMLPHFLPIHPGRFWCFCRMVYMPMAYIYGKKFVGPITPTILAIRNEIYNIPYNEIDWNKARNSCAKEDLIYRRSWLQSVALAYLNNFVEPLSNLWPMNKLRERAMSNLMEHIHYEDENSNYVGLCPINKVLNMICCWIEKPNSHEFRQHLPRIHDFLWIAEDGMKSKVLFFVLCSHYYK

SEQ ID NO: 15104 - DNA, 1755 bp, Sorghum bicolor
  misc_feature: Ceres ANNOT ID no. 8634157
  misc_feature: Encodes the peptide sequence at SEQ ID NO 15105
atggggtcgacggcggaggacgtggcggcggtggcggacgaggaggcgtgcatgtacgcgatgcagctggcgtcgtcgtcgatcctccccatgacgctgaagaacgcgctggagctgggcctgctggaggtgctgcagaaggacgccggcaaggcgctggcggcagaggaggtggtggcgcagctgcccgtggcgccgaccaaccccggcgcggcggacatggtggaccggatgctccgcctcctcgcctcctacgacgtcgtcaagtgccagatggaggacaaggacgggaggcggagcgccaggtcgggaggttgggttctgtggatgcggcgccccggccgcggccacggccgcagggaactcggggagtgtggagaggcggcggaggccgagcccaagccggcacaggacggcagcgaacggagaggcggcggaggccgagcccaagccggcacaggacggcggctgacagatgcgggagcgctccagatgcggcgtcatgtcggggagaacccacgtgtcagacatgttaaacgtcacaaaacgaacagaatggagacggaatggcacacgggtatagtcgaagatgaagttgggcacagcggtaaaaagctttctcgacaggacctgcggggcgagaggagggagggagagagagaccatcgggttgccaagttctccatggctggcggcggcgagccgtcgcggtctgcgtccaccatcgtcgccaacaccgcgagtgggtaccacattctcaggatcgatggatactcccgcaccttggcgacccccacaggaaagtacatcgcgtccctcccgttcaccgtgggcggccatcgctggtacattcgctactaccccaacggcggcgactggggggccaaagattacatctcgctttatcttcatctccgcgacgacgtcgccaaggcagtggaggtgcacttcaagttccatttcgtcggcgacgtgtcggagcaggcgttgacactggggcaagtgcgtagcttcaccaacagtaatcagggttgggggcaccctttcatcaaaagggaagacttggtgcagtccaagcatctccaggacgattccatagccattcggtgcgatgtgctcgttgtcgccaacgaattccgcatggaggaggcgccggaagccactgctgcggctgctatgatctctgtgcccccatctgaccttcaccagcatcttggcagtctcttgcagaccgagaagggcgctgatgtggtgttcgacgtcgccggtgagaggttcgctgcacaccggtggctactcgcagcccgttcgcctgtcttcagtgcagagctctttggtgggatgaaagagagccacaccgaaggtgtggtgcacatagaggacatggaacctcgggtgttcaaggctttgctctacttcgtttacaccgacttattattccaaaagacaaagacaatgaaacaggtggaagagggagatgcaggcgacgacggtgaagacgttttatctcagcacctactggttgctgcggacaaatacaacttggagaggctgaaactgttatgtgaaaagaagttgtgtgagtatatcaatgcaggcaatgtggcaacaatcctggcgctagctgagcaacaccattgccatggactgaagaaggtgtgcttccattttctcagctttcctgcaaatttgagggcagccatggccagcaacggctttaagcatctgagcagaagctgcccctctgttatgtag

SEQ ID NO: 15105 - protein, 584 aa, Sorghum bicolor
  misc_feature: Useful for making plants with altered carbohydrate content
  misc_feature: Functional homolog of the protein sequence given in SEQ ID NO 14135
  misc_feature: Ceres ANNOT ID no. 8634157
  misc_feature (1)..(102): SWISSPROT Homolog: EC 2.1.1.68 Caffeate O-methyltransferase
  misc_feature (31)..(83): Pfam ID: Dimerisation Pfam Description: Dimerisation domain
  misc_feature (405)..(530): Pfam ID: BTB Pfam Description: BTB/POZ domain
  misc_feature (255)..(374): Pfam ID: MATH Pfam Description: MATH domain
MGSTAEDVAAVADEEACMYAMQLASSSILPMTLKNALELGLLEVLQKDAGKALAAEEVVAQLPVAPTNPGAADMVDRMLRLLASYDVVKCQMEDKDGRRSARSGGWVLWMRRPGRGHGRRELGECGEAAEAEPKPAQDGSERRGGGGRAQAGTGRRLTDAGALQMRRHVGENPRVRHVKRHKTNRMETEWHTGIVEDEVGHSGKKLSRQDLRGERREGERDHRVAKFSMAGGGEPSRSASTIVANTASGYHILRIDGYSRTLATPTGKYIASLPFTVGGHRWYIRYYPNGGDWGAKDYISLYLHLRDDVAKAVEVHFKFHFVGDVSEQALTLGQVRSFTNSNQGWGHPFIKREDLVQSKHLQDDSIAIRCDVLVVANEFRMEEAPEATAAAAMISVPPSDLHQHLGSLLQTEKGADVVFDVAGERFAAHRWLLAARSPVFSAELFGGMKESHTEGVVHIEDMEPRVFKALLYFVYTDLLFQKTKTMKQVEEGDAGDDGEDVLSQHLLVAADKYNLERLKLLCEKKLCEYINAGNVATILALAEQHHCHGLKKVCFHFLSFPANLRAAMASNGFKHLSRSCPSVM

SEQ ID NO: 15106 - DNA, 399 bp, Sorghum bicolor
  misc_feature: Ceres ANNOT ID no. 8634228
  misc_feature: Encodes the peptide sequence at SEQ ID NO 15107
atggtgcagcagtgggagcaggccgacagctcacgagtccagaggatccaatggatttcttctattcataccaggaaagccataaaagaggaattgaaattattctatcctgcttgtggaagctgcagcatcatcacagttaccatgggttccaagggcgaggcgccaacctgggcggaccagtgggcctctggtgaagacagcgggagcaggagcagcaccaacggcaaggcggataagaaggggacggtcgccggcaacgtgaaggcggcggcgtcggaggggttcgtcaaggccaaggcggcggcgctggtcggagcgcacaaggtgaaggccgggacgagcaccggcatcaagtgggtcaaggagcagtaccagaagaagaggacatccaagtga

SEQ ID NO: 15107 - protein, 132 aa, Sorghum bicolor
  misc_feature: Useful for making plants with modulated biomass
  misc_feature: Functional homolog of the protein sequence given in SEQ ID NO 14136
  misc_feature: Ceres ANNOT ID no. 8634228
MVQQWEQADSSRVQRIQWISSIHTRKAIKEELKLFYPACGSCSIITVTMGSKGEAPTWADQWASGEDSGSRSSTNGKADKKGTVAGNVKAAASEGFVKAKAAALVGAHKVKAGTSTGIKWVKEQYQKKRTSK

SEQ ID NO: 15108 - DNA, 1260 bp, Sorghum bicolor
  misc_feature: Ceres ANNOT ID no. 8634245
  misc_feature: Encodes the peptide sequence at SEQ ID NO 15109
atgatgcagccgccgccgccacagcagcagcagcaatgggcaatggcgccgccgcccccgccgcagtactaccaggcgggacaccccccgccgccgcccccgcagttctaccaggcgggccctccgcctcctgctatgtggggccagccgccgccgcaagcggccccggccccggcgccggcaccgtccggcggtggggcgggggacgaggccaggaccctctggatcggggacctgcagtactggatggacgagaactacctctacagctgcttctcccaggccggcgaggttatttctgtgaagataattcgaaacaagcagactgggcaacctgagggttatggttttattgaattcggcaaccatgctttagctgaacaagttctgcagaattataatggtcaaatgatgcctaatgttaatcaacctttcaaattgaattgggctaccagtggggctggtgagaaacgtggagatgatggttcagattatactatatttgttggggacttggcctcggatgttacagatttcattctacaagatacattcaagagtcgttatccatcagttaagagtgcaaaagttgtcttcgacagaactacaggccgctcgaaaggctatggttttgttaagtttgcagatttggatgaacagacacgggcaatgactgaaatgaatggacaatactgttctagcaggcccatgcgccttggaccagcatccaacaagaagaatactggtggacaaccacagccatcgagtactatttaccagaatacccaaggaactgattctgatagtgatccaaacaatactactgtatttgttggtggtcttgatccgagtgtgactgatgagcttctcaagcaaaccttcagtccatacggagagcttctctatgtcaaaatacctgtaggaaagcgttgtggatttgtccaatattctaacagggcttcagctgaggaggccataaggatgctaaatggaagccagctgggaggtcagagcataaggctctcatggggtcgtagccctgcaaacaagcagcctcagcaagagcagaaccaatggagtggtggtggctattatgggtatccccaaggatatgatccatatggttatgctcgcccccctcaagatcctgccatgtacgcctacacaccatatccagggtatggaaattaccagcagcagccaccacagcagcccccaccacaacagcaaaaaaaaggtattgccacgcaatgcatgtaa

SEQ ID NO: 15109 - protein, 419 aa, Sorghum bicolor
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO 536 in the 10/666,642 US patent application
  misc_feature: Useful for making plants with altered terpenoid content
  misc_feature: Functional homolog of the protein sequence given in SEQ ID NO 12954
  misc_feature: Ceres ANNOT ID no. 8634245
  misc_feature (275)..(360): SWISSPROT Homolog: EC 5.2.1.8 Peptidylprolyl isomerase
  misc_feature (276)..(341): Pfam ID: RRM_1 Pfam Description: RNA recognition motif. (a.k.a. RRM, RBD, or RNP domain)
  misc_feature (167)..(239): Pfam ID: RRM_1 Pfam Description: RNA recognition motif. (a.k.a. RRM, RBD, or RNP domain)
  misc_feature (74)..(145): Pfam ID: RRM_1 Pfam Description: RNA recognition motif. (a.k.a. RRM, RBD, or RNP domain)
MMQPPPPQQQQQWAMAPPPPPQYYQAGHPPPPPPQFYQAGPPPPAMWGQPPPQAAPAPAPAPSGGGAGDEARTLWIGDLQYWMDENYLYSCFSQAGEVISVKIIRNKQTGQPEGYGFIEFGNHALAEQVLQNYNGQMMPNVNQPFKLNWATSGAGEKRGDDGSDYTIFVGDLASDVTDFILQDTFKSRYPSVKSAKVVFDRTTGRSKGYGFVKFADLDEQTRAMTEMNGQYCSSRPMRLGPASNKKNTGGQPQPSSTIYQNTQGTDSDSDPNNTTVFVGGLDPSVTDELLKQTFSPYGELLYVKIPVGKRCGFVQYSNRASAEEAIRMLNGSQLGGQSIRLSWGRSPANKQPQQEQNQWSGGGYYGYPQGYDPYGYARPPQDPAMYAYTPYPGYGNYQQQPPQQPPPQQQKKGIATQCM

SEQ ID NO: 15110 - DNA, 1656 bp, Sorghum bicolor
  misc_feature: Ceres ANNOT ID no. 8634335
  misc_feature: Encodes the peptide sequence at SEQ ID NO 15111
atggcgggcacggcgtcgccggccgcgggctacggctccgacggcgtgtaccgctcgccgcgcgcggcggcgcagatcgcctcggacccgggcctctccctcgcggacctcgtcctgcgccgcgccgcggcgtgcccctccgcgccggcgctcgtggacgccgcgaccggccgcgcgctcaccttcgggtccctccggtccgcggtgctcgtcgcggccgccgcgctctcctcccgcgctggcgtccgccgcggcgacgccgtgctgctcctcgcgcccaactgcgtgctctacccggtctgcttcctcgcggtcacctcgctcggcgccgtcgccaccacggctaacccgcgctacaccccgcgggagatcgccaagcaggcggccgacgcccgcgccaagctcgtcgtcactgtctccgacctcctgcccaagatcgccggcctccgcctccccaccgtcctcctcgacggcgacggcggcggcgcccccgtgcctagttcggactgccccagcagaagcagtaacgtcactctctactcggacctcgtcgccggggttcaggaggcggagtaccgccgcccgccggccgtggggcagggcgacacggcggcgctgttctactcgtcgggcacgaccggggagagcaagggcgtggtgctcacgcaccgcaacttcatcgcggcggcgacgatggtgacgtcggaccaggacgagctcggggaaggaggccgcaacgtgttcctctgcttcctgcccatgttccacatcttcggcatggccgtggtcaccctcggccagctgcagcgcggcaacgccgtcgtcgtcatggcccggttcgacgtcgacgccgtgctcgccgccgtcgagcgccaccgcgtcacgtacatcttcggcgcgccgccggcgatgatcgcgctcgccaagcacggcgggggccgcaggtacgacctcagctcgctcaggtgcatcggctctggcgccgcgccgctcggcaaggacgtcatggtggctatggctgacagattccccggttatggtatgactgaaacctgcgggataatatctctagagtacgtgcaaaagggtcgtgcccgtcagtttggttcaactggagcacttgtcataggagttgaagcaaagattgttgatacaaagacaatgaagcatctgcctccgaaccagctaggagaaatctgtgttcgaggaccaaacataatggaaggttatttcaacaatgtgcaagccactgagtttacaatcaagcaagggtggttgcatactggtgatcttggatactttgatgaaagaggccagcttcatgttgtcgatagacttaaagagctgattaagtacaaaggcttccagattgctcctgctgagcttgaaggattgcttttgtctcatcctgaaattcttgatgctgctgttatcccgtatcctgatcccgaagcaggggaagttcctatcgcctatgttgtacggtcaccaaagagttcactggctgaagttgatgtccagaaatttatcgaaaagcaggtcgcgcactacaagagactgaggaaggtaaagtttgtggacagtgtaccaaaatctgctgcgggaaagattttgagaagagagctcatcgcccaagtcagatcatccaagctgtag

SEQ ID NO: 15111 - protein, 551 aa, Sorghum bicolor
  misc_feature: Useful for making plants with altered cell wall content and/or composition
  misc_feature: Functional homolog of the protein sequence given in SEQ ID NO 14036
  misc_feature: Ceres ANNOT ID no. 8634335
  misc_feature: Up-regulated in root tissues in response to salicylic acid treatment
  misc_feature (16)..(546): SWISSPROT Homolog: EC 6.2.1.12 4-coumarate--CoA ligase
  misc_feature (61)..(477): Pfam ID: AMP-binding Pfam Description: AMP-binding enzyme
MAGTASPAAGYGSDGVYRSPRAAAQIASDPGLSLADLVLRRAAACPSAPALVDAATGRALTFGSLRSAVLVAAAALSSRAGVRRGDAVLLLAPNCVLYPVCFLAVTSLGAVATTANPRYTPREIAKQAADARAKLVVTVSDLLPKIAGLRLPTVLLDGDGGGAPVPSSDCPSRSSNVTLYSDLVAGVQEAEYRRPPAVGQGDTAALFYSSGTTGESKGVVLTHRNFIAAATMVTSDQDELGEGGRNVFLCFLPMFHIFGMAVVTLGQLQRGNAVVVMARFDVDAVLAAVERHRVTYIFGAPPAMIALAKHGGGRRYDLSSLRCIGSGAAPLGKDVMVAMADRFPGYGMTETCGIISLEYVQKGRARQFGSTGALVIGVEAKIVDTKTMKHLPPNQLGEICVRGPNIMEGYFNNVQATEFTIKQGWLHTGDLGYFDERGQLHVVDRLKELIKYKGFQIAPAELEGLLLSHPEILDAAVIPYPDPEAGEVPIAYVVRSPKSSLAEVDVQKFIEKQVAHYKRLRKVKFVDSVPKSAAGKILRRELIAQVRSSKL

SEQ ID NO: 15112 - DNA, 1074 bp, Sorghum bicolor
  misc_feature: Ceres ANNOT ID no. 8634376
  misc_feature: Up-regulated in root tissues in response to salicylic acid treatment
  misc_feature: Encodes the peptide sequence at SEQ ID NO 15113
atggcagcgcgcccggttcttccttctcctgctctcctcttgcttcccctgctgctgcttgtgactgcttcgtcaggtgccgcccatggctacggccacggcggcgacgacgacgacggtgcgggtaagctcagggtcgggttctacaaggactcgtgcccggacgccgaggcgatcgtccgcagggtcgtcgccaaggccgtccacgaggatcccacggccaatgcgccgctgctcaggcttcacttccacgactgcttcgtcaggggctgcgaggggtccgtgctcatcaactccaccaagggcaacaaggcggagaaggacgccaagcccaacctcacgctggacgccttcgacgtcatcgacgacatcaaggacgcgctggagaagcgatgccccggcaccgtctcctgcgccgacatcctcgccatcgccgccagggacgccgtctcgctggccaccaaggcggtgaccaagggaaggtggagcaaggacgggaacctctaccaggtggagaccggcaggcgggacggccgcgtctccagcgccaaggaggccgtcaagaacctgccggactccatggacggcatccgcaagctcatcaggaggttcgcctccaagaacctcagcatcaaggatctcgctgttctctcaggtgcccacgcgatcgggaaatcgcactgcccgtcgatcgccaagcgtctgcgcaactacacggcgcaccgggacagcgacccgacgctggacggcgcgtacgcggcggagctgaggcggacgtgccggagccgccgggacaagacgacggagctggagatggtgcccggcagctccacgacgttcgacacggcctactacggcctggtcgtgaagcggacggcgctcttccactccgacgaggcgctgctcaggaaccaggagaccagggcgctcgtctaccgctacagggacgccgccgccgggtcggagcaggcgttcctgagggactttggggtgtccatggtgaacatgggcagggtcggcgtgctcaccggcgaccagggagagatcaggaagagatgtgccttcgtcaactag

SEQ ID NO: 15113 - protein, 357 aa, Sorghum bicolor
  misc_feature: Useful for making plants with altered cell wall content and/or composition
  misc_feature: Functional homolog of the protein sequence given in SEQ ID NO 14137
  misc_feature: Useful for making plants with modulated phosphate use efficiency
  misc_feature: Functional homolog of the protein sequence given in SEQ ID NO 13134
  misc_feature: Useful for making plants with altered carbohydrate content
  misc_feature: Functional homolog of the protein sequence given in SEQ ID NO 13757
  misc_feature: Useful for making plants with modulated nitrogen use efficiency
  misc_feature: Functional homolog of the protein sequence given in SEQ ID NO 13758
  misc_feature: Useful for making plants with modulated oxidative stress sensitivity
  misc_feature: Functional homolog of the protein sequence given in SEQ ID NO 13607
  misc_feature: Ceres ANNOT ID no. 8634376
  misc_feature: Up-regulated in shoot tissues in response to methyl jasmonate treatment
  misc_feature: Up-regulated in root tissues in response to methyl jasmonate treatment
  misc_feature (44)..(357): SWISSPROT Homolog: EC 1.11.1.7 Peroxidase
  misc_feature (60)..(317): Pfam ID: peroxidase Pfam Description: Peroxidase
MAARPVLPSPALLLLPLLLLVTASSGAAHGYGHGGDDDDGAGKLRVGFYKDSCPDAEAIVRRVVAKAVHEDPTANAPLLRLHFHDCFVRGCEGSVLINSTKGNKAEKDAKPNLTLDAFDVIDDIKDALEKRCPGTVSCADILAIAARDAVSLATKAVTKGRWSKDGNLYQVETGRRDGRVSSAKEAVKNLPDSMDGIRKLIRRFASKNLSIKDLAVLSGAHAIGKSHCPSIAKRLRNYTAHRDSDPTLDGAYAAELRRTCRSRRDKTTELEMVPGSSTTFDTAYYGLVVKRTALFHSDEALLRNQETRALVYRYRDAAAGSEQAFLRDFGVSMVNMGRVGVLTGDQGEIRKRCAFVN

SEQ ID NO: 15114 - DNA, 2037 bp, Sorghum bicolor
  misc_feature: Ceres ANNOT ID no. 8634467
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 15115
atggcggcgtcgctgctcctccgcgccgtgcgccgaagggagctcgcgtcccctctcggatccttgggcgccagcttacagtcaacatgtgctgccaacgtatgctcaaaatggggaaattttgcaagaccttttagtgcaaaagctgctggaaatgaggttattgggattgatttggggacaactaactcatgtgttgctgttatggagggaaagaacccaaaagttattgagaatgctgaaggtgcgagaacaacaccatctgttgttgcatttactcagaagggcgaaagacttgttggaactccagccaagcgccaagcagtaaccaatccccagaatactttctttggaacaaagaggttaatcgggcgacgctttgatgatcctcagacacagaaagagatgaagatggtgccattcaaaatcgtgaaggctccaaatggtgatgcttgggttgaaacaacagatgggaaacagtactcaccaagtcaggtcggtgcatttgtgctgaccaagatgaaggagacagctgaatcttaccttggcaagtctgtctcaaaggcagtgattactgttccagcttatttcaatgatgctcagcgtcaggccacaaaggatgctggccgaattgctggccttgatgttgaaaggatcatcaatgaacctacagcagccgctctgtcctatggaatgaacaacaaggaaggcttgatagcagtatttgatcttggaggaggaacttttgatatctctattctggagatctcaaacggagtttttgaggtcaaagcaacaaatggtgatactttcttgggtggtgaagattttgacaacacactacttgagttcttggtgagtgatttcaagaaagctgagggcattgatctgtcaaaggatagattggccctgcaaaggcttcgtgaagctgctgagaaggcaaaggttgaactttcatcaacttctcagacagaaatcaatctgccattcataacagctgatgcttcaggggcaaaacatttaaacatcacactgacaaggtcgaaatttgaatctcttgtacacaatctgattgagaggactagagagccatgcaagaactgcttgaaggatgccggaatatctactaaagaggtggatgaagtactacttgttggtggaatgactagggttccaaaggtgcaggcggtagtctctgaaatctttggaaagagcccaagcaaaggagtcaacccagatgaagctgtggccatgggtgctgccattcagggtggcattctccgtggagatgttaaggagcttcttcttcttgatgttactcccctgtcactgggtattgagaccctcggtggtatcttcaccagattgatcaacagaaacactacaatccctacaaagaaaagtcaggtgttctcaactgctgctgacaatcagacccaagtgggtatccgtgtcttgcaaggtgagcgtgaaatggctgcagacaacaaacttcttggtgaatttgatcttgtgggcattccgcctgccccaagaggcttgcctcagattgaggttacattcgacatcgacgccaatgggattgtgaccgtctcagccaaagataaggctaccgggaaggagcagaacatcaccatccgatcctcgggtgggctgtccgaggctgacatccagaagatggtgcaagaagctgagctgcatgcccagaaggatcaggaacggaaagcactcattgacatccggaacaatgctgacaccactatctacagcatcgagaagagtctgggagagtacagggacaagatcccttctgaggttgcatctgagatcgaggcggctatcgctgacctccgccaggagatggcctcagatgatatcgagaagatcaaggccaagcttgaggctgccaacaaggctgtctcgaagattggacagcacatgtctggtggtggctctggtggctcgcagtcaggatctggacctcagggtggcggcgaccaggcgccggaggcagagtatgaggaggttaagaagtga

SEQ ID NO: 15115 - protein, 678 aa, Sorghum bicolor
  misc_feature: Useful for making plants with modulated heat sensitivity
  misc_feature: Functional homolog of the protein sequence given in SEQ ID NO 13726
  misc_feature: Ceres ANNOT ID no. 8634467
  misc_feature (54)..(649): Pfam ID: HSP70 Pfam Description: Hsp70 protein
MAASLLLRAVRRRELASPLGSLGASLQSTCAANVCSKWGNFARPFSAKAAGNEVIGIDLGTTNSCVAVMEGKNPKVIENAEGARTTPSVVAFTQKGERLVGTPAKRQAVTNPQNTFFGTKRLIGRRFDDPQTQKEMKMVPFKIVKAPNGDAWVETTDGKQYSPSQVGAFVLTKMKETAESYLGKSVSKAVITVPAYFNDAQRQATKDAGRIAGLDVERIINEPTAAALSYGMNNKEGLIAVFDLGGGTFDISILEISNGVFEVKATNGDTFLGGEDFDNTLLEFLVSDFKKAEGIDLSKDRLALQRLREAAEKAKVELSSTSQTEINLPFITADASGAKHLNITLTRSKFESLVHNLIERTREPCKNCLKDAGISTKEVDEVLLVGGMTRVPKVQAVVSEIFGKSPSKGVNPDEAVAMGAAIQGGILRGDVKELLLLDVTPLSLGIETLGGIFTRLINRNTTIPTKKSQVFSTAADNQTQVGIRVLQGEREMAADNKLLGEFDLVGIPPAPRGLPQIEVTFDIDANGIVTVSAKDKATGKEQNITIRSSGGLSEADIQKMVQEAELHAQKDQERKALIDIRNNADTTIYSIEKSLGEYRDKIPSEVASEIEAAIADLRQEMASDDIEKIKAKLEAANKAVSKIGQHMSGGGSGGSQSGSGPQGGGDQAPEAEYEEVKK

SEQ ID NO: 15116 - DNA, 1914 bp, Sorghum bicolor
  misc_feature: Ceres ANNOT ID no. 8634555
  misc_feature: Encodes the peptide sequence at SEQ ID NO 15117
atggcgaaggaatacccagcttctcccaaagcccagcagctgcaggaatccaagaagcagcgcctgacatacatccttgttgtaagcgcgctctgcattgccttctacgtccttggcgcatggcagaacaccacgcttccaaagcccataggcaactcggggatcacccgggttggctgtgatcccacaactgcctccacgacacagtcctctggctctgtgccgtcgtttgggccaggctccggtgaggtgcttgactttgatgcacaccaccggctcaccatcaacaacacggacggcgatggggaactgcagcagtttccggcatgccctctcaatttcagtgagtacacgccgtgtgaggaccgtaagcgcgggcggcggttcgaccgtgccatgctagtgtaccgggagcgccattgtcctggcaaggacgagcaggtccgatgcctcatcccagcaccgcctgggtacaggacccccttcaagtggcctcatagcagggactacgcctatttcaacaacatcccccacaaggagctcagcattgagaaagcagtgcagaactggatccaggttgagggcgataagttcaagttccctggtggtggcactatgttcccacgtggtgctgatgcctacatagatgatattgataagctcatctcattatcggatggcaagatcaggaccgctgttgacacgggttgtggggttgctagttggggagcttacttgctgaagaggaacatcattgccatgtcatttgcgccaagagacacgcacgaagctcaggtgcaattcgcactggaaagaggtgtccctgccatcattggtgtgatggggaaacaccggttgccttacccatctagggcatttgatatggcacattgctctcgctgtctgattccttggtatgaacatgatgggctataccttgctgaagtcgataggattctaaggccaggaggatattggattctctcgggtcctccaatcaactggaagacgcaccacgtggggtgggagaggacaaaggacgacctcaagcaagagcaagacaatattgaggatatcgcgaggagcctttgctggaacaaagtggttgagaagagggatctctctatctggcagaagcctaagaaccaccttgagtgtgccaacattaagaagacatataagacaccccatatctgcaagagtgacaatcctgatgctgcttggtacagacagatggaagcctgtgttactccattgcctgaagtaagcaaccagggagaagtggcgggaggagcagtggagaaatggccagagagggcattcttagttccccccaggattagaaggggcatgattccaggattggatgcaaagaagtttgatgaggacaagaagttgtgggagaagagggtggcatactacaagcgcatcatacccatagcagagaatagatacagaaatgtgatggacatgaacgcaaacatgggtgggtttgctgcttctttagtgaagtaccctgtgtgggtgatgaatgtcgtccctgttaactctgaccgggacacccttggtgcaatatacgagcgaggcttcattggcacatatcaggactggtgtgaagctttctcaacgtatccaagaacctatgacctcttgcatgctgacaatttgtttagcatctaccaagacaggtgtgatataactgacatcctcttggagatggataggatattaaggcccgagggcacagctatcatccgtgacacagttgacgtgctcacgaaagtccaggcaataaccaagcggatgcggtgggaaagccgcatcatggaccacgaggatggccccttcaatccagagaaggtcctcatggcggttaagacgtactggactgccaaaacggaggaggagcattag

SEQ ID NO: 15117 - protein, 637 aa, Sorghum bicolor
  misc_feature: The sequence is a functional homolog of SEQ ID NO 758 in the 10/412,699 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 1593 in the 11/479,226 US patent application
  misc_feature: Useful for making plants with altered cell wall content and/or composition
  misc_feature: Functional homolog of the protein sequence given in SEQ ID NO 13686
  misc_feature: The sequence is a functional homolog of SEQ ID NO 560 in the 10/412,699 US patent application
  misc_feature: Ceres ANNOT ID no. 8634555
  misc_feature (233)..(328): Pfam ID: Methyltransf_11 Pfam Description: Methyltransferase domain
MAKEYPASPKAQQLQESKKQRLTYILVVSALCIAFYVLGAWQNTTLPKPIGNSGITRVGCDPTTASTTQSSGSVPSFGPGSGEVLDFDAHHRLTINNTDGDGELQQFPACPLNFSEYTPCEDRKRGRRFDRAMLVYRERHCPGKDEQVRCLIPAPPGYRTPFKWPHSRDYAYFNNIPHKELSIEKAVQNWIQVEGDKFKFPGGGTMFPRGADAYIDDIDKLISLSDGKIRTAVDTGCGVASWGAYLLKRNIIAMSFAPRDTHEAQVQFALERGVPAIIGVMGKHRLPYPSRAFDMAHCSRCLIPWYEHDGLYLAEVDRILRPGGYWILSGPPINWKTHHVGWERTKDDLKQEQDNIEDIARSLCWNKVVEKRDLSIWQKPKNHLECANIKKTYKTPHICKSDNPDAAWYRQMEACVTPLPEVSNQGEVAGGAVEKWPERAFLVPPRIRRGMIPGLDAKKFDEDKKLWEKRVAYYKRIIPIAENRYRNVMDMNANMGGFAASLVKYPVWVMNVVPVNSDRDTLGAIYERGFIGTYQDWCEAFSTYPRTYDLLHADNLFSIYQDRCDITDILLEMDRILRPEGTAIIRDTVDVLTKVQAITKRMRWESRIMDHEDGPFNPEKVLMAVKTYWTAKTEEEH

SEQ ID NO: 15118 - DNA, 1590 bp, Sorghum bicolor
  misc_feature: Ceres ANNOT ID no. 8634541
  misc_feature: Encodes the peptide sequence at SEQ ID NO 15119
atggcggccgttgccaagatcgccatggagtggctccaagaccctctgagctgtgtgttcctggtcacgctggccgtggtgctcctgcagctccgtcgacggggcaaagcgcctctgccgcctggcccgaagccgctgccgatcgtgggcaacatggcgatgatggaccagctgacccaccgcggcctggcggcgctggccgacaagtacggcgggctgctccacctccgccttggccggctgcacgcgttcgccgtgtccacgcccgagtacgcgcgcgaggtgctgcagacgcatgacggcgtgttctcgaaccgcccggcgaccatcgccatcgcgtacctgacgtacgaccgcgcggacatggcgttcgcgcactacgggcccttctggcgccagatgcggaagctgtgcgtgatgaagctcttcagccggcggcgcgccgagacgtgggtggccgtgcgcgacgagtgcgcggcgctggtccgcgccgtggcgacgtccggcggcgagaaggcggtgaacctgggcgagctcatcttcaccctgaccaagaacgtgacgttccgggccgcgttcggcacccgcgacggcgaggaccaggaggagttcatcgccatcctgcaggagttctccaagctgttcggcgccttcaacatcggcgacttcctgccgtggctggggtggatggacctgcaggggatcaaccgccgcctccgcgccgcccgctccgcgctggaccgcttcatcgacaagatcatcgacgagcacgtgaagcgcggcaagagccccgacgacgccgacgccgacatggtcgacgacatgctcgccttcttcgccgaggcgaagccggccgccgtgaacggcggcgcggccgcgaacggcgacgacctgcagaacacgctccgcctcacgcgcgacaacatcaaggccatcatcatggacgtgatgtttggcgggacggagacggtggcgtcggcgatcgagtgggcgatggcggagatgatgcacagccccgacgacctccgccgcgtgcagcaggagctcgccgacgtcgttggcctggaccggaacgtgaacgagtcggacctggacaagctccccttcctcaagtgcgtcatcaaggagacgctccgtctccacccgccgatcccgctgctcctccacgagaccgccgacgactgcgtcgtgggcggcggcggcggccgccgctactccgtgcccaggggctcccgcgtcatgatcaacgtgtgggccatcggccgccaccgcgggtcctggaaggacgccgacgtgttccgcccgtcccggttcacccccgacggcgacgccgcggggctcgacttcaagggcggctgcttcgagttcctgcccttcgggtccggccgccggtcctgccccggcacggcgctgggcctgtacgcgctggagctcgccgtcgcccagctcgcgcacggcttcaactggtcgctgcccgacgggatgaagccctcggagctggacatgagcgacgtcttcgggctcaccgcgccgcgcgccacaaggctctacgccgtgccgacgccccggctcaactgccccctgtactga

SEQ ID NO: 15119 - protein, 529 aa, Sorghum bicolor
  misc_feature: Useful for making plants with altered lignin content
  misc_feature: Functional homolog of the protein sequence given in SEQ ID NO 14138
  misc_feature: Useful for making plants with altered cell wall content and/or composition
  misc_feature: Functional homolog of the protein sequence given in SEQ ID NO 14139
  misc_feature: Ceres ANNOT ID no. 8634541
  misc_feature (296)..(529): SWISSPROT Homolog: EC 1.14.13.21 Flavonoid 3'-monooxygenase
  misc_feature (40)..(519): Pfam ID: p450 Pfam Description: Cytochrome P450
MAAVAKIAMEWLQDPLSCVFLVTLAVVLLQLRRRGKAPLPPGPKPLPIVGNMAMMDQLTHRGLAALADKYGGLLHLRLGRLHAFAVSTPEYAREVLQTHDGVFSNRPATIAIAYLTYDRADMAFAHYGPFWRQMRKLCVMKLFSRRRAETWVAVRDECAALVRAVATSGGEKAVNLGELIFTLTKNVTFRAAFGTRDGEDQEEFIAILQEFSKLFGAFNIGDFLPWLGWMDLQGINRRLRAARSALDRFIDKIIDEHVKRGKSPDDADADMVDDMLAFFAEAKPAAVNGGAAANGDDLQNTLRLTRDNIKAIIMDVMFGGTETVASAIEWAMAEMMHSPDDLRRVQQELADVVGLDRNVNESDLDKLPFLKCVIKETLRLHPPIPLLLHETADDCVVGGGGGRRYSVPRGSRVMINVWAIGRHRGSWKDADVFRPSRFTPDGDAAGLDFKGGCFEFLPFGSGRRSCPGTALGLYALELAVAQLAHGFNWSLPDGMKPSELDMSDVFGLTAPRATRLYAVPTPRLNCPLY

SEQ ID NO: 15120 - DNA, 2481 bp, Sorghum bicolor
  misc_feature: Ceres ANNOT ID no. 8634558
  misc_feature: Encodes the peptide sequence at SEQ ID NO 15121
atgggtttccttccgatccacagaatcatattgctgtgtttttgttcgttactgcctcctcctgtatcatcagacagccgtcttcttcccaacaagccgctcactgttggaagcacactcatctgcgatgatggcacttttgccctgggtttcttttccccgtccaactcgacccaaaaacactactactacgttggtatatggtacaacaacatcgccaaggacaacgtcgtgtgggttgccaatcgcgcaacgccagtcaccgatccttcctctgcaacacttgccctgacaaatacatccaatcttgttctgtccagtactagcggccagatgctttggacggcaaacatcagctctacatcggagaccaccgctggagaagccacgcttgacaacactgggaatttcatccttcggacatccgagggcgtcgtcttatggcaaagcttcgattatccggccgacacccttctccctggcatgaaatttagggtcacccacaacacacatgcactgcagcgcctggtttcttggaagggtccccaagacccagccctgggcagcttctcctatggtgcggatcctgaggagttcctgcagcgctttgtctggaatggatccagaccataccggagaagtccggtgtggaataactacttggtagttgggccatatatcggaagtatcaagtccactatgtacttcatagtaagaaatgacgatggtgaggtctatatgtcctttggcatacccggtggctcctcatcgtcaactgtcatcaagatcaaaatggactactcaggaaagatagaaatcctgatctggaacagcaacattttggagtgggatgtcctagaggcagagcctaaccatgaatgcagtacatatggatattgtggtccgtttgggtactgtgataacacacagcctgatgcgacatgcaagtgtctcgacagttttgaaccaataagcaacaaaggcatgagcaatggaaggtccccgggaggatgccaccgcaaggagacactaagatgtggcgaagaaaacactagtttcctaactttgacggccatgaagattcccgacaagttcgtgtatatcaagaatagaagctttgacgaatgcacagcagaatgtgctagcaactgctcctgcacaggttacgcttatgccaatatgagcaccacggctatcaatggggatgacacaaggtgcctattatggatgggagatttgattgacacagagaagcgcattggagaaggagaaaatttttacattcgagtaaacagatcaaataaaaagaggaggagcaatatcctgaaaattattctgccagttgtatcaagtttgctcatactcatattcatgtggcttgtttggacctgtaactcacgagccaaacaaagaaataagaaaacatggaagaagataatatcaggagttttgagcatttctgatgaactcggggatggtaagcttctctctattagcttcagagaaattgtactagcaacagacaatttttctagcaccaacatgcttggacacggaggttttggacatgtttataggggaacattagaatgtggtaaaacaattgctgtgaaaaggcttagtaagggttctggccagggggtattggagttcagaaatgaagtacttctcatcgccaagttgcagcacagaaacctagttaaacttcttggtttctgcattcatggagatgagaaactattgatatatgaatacttatcaaacaaaagtttggatgcctttcttttcaattccacaagaaaaccatcgcttgattggtcaacaagattcaatataatcttagggatagctagaggacttctttatcttcatcaagattcaaggctgaagataatccacagggatctcaaagcaaacaacatattattggatgatgaaatgagccccaggatatctgattttggtatggcaagaattttttatggcaaccagcaacaaggaaataccaaccgcgttgttggcacatatggttacatgtcgcctgaatatgctttggaaggtgtgttttctgtcaagtctgacgtgtatagctttggagttttagttctagagattgtgagtggctcaaagatcatctctacgcacatgacagaagattatcccaaccttatagcccgtgcttggagcttatggaaggatgggaatgcaaaagaatttgttgactcatccattgtggataattgttcacttgatgagacttcgcagtgcatccatatcgggctcttgtgtgttcaagacaacccaaattctcggccattcatgtcatcaattttgtcagttctggagactggagatatatcacttccacctccaaaactgccaacatattttgcagaaaggaatcatggaactgacggagcagcagaagctgttgtgaattctgcaaatagtatgagtgttacagagttggagggacgctag

SEQ ID NO: 15121 - protein, 826 aa, Sorghum bicolor
  misc_feature: Useful for making plants with altered cell wall content and/or composition
  misc_feature: Functional homolog of the protein sequence given in SEQ ID NO 14140
  misc_feature: Useful for making plants with modulated biomass
  misc_feature: Functional homolog of the protein sequence given in SEQ ID NO 14141
  misc_feature: Ceres ANNOT ID no. 8634558
  misc_feature (484)..(782): SWISSPROT Homolog: EC 2.7.11.1 Non-specific serine/threonine protein kinase
  misc_feature (510)..(781): Pfam ID: Pkinase Pfam Description: Protein kinase domain
  misc_feature (74)..(186): Pfam ID: B_lectin Pfam Description: D-mannose binding lectin
  misc_feature (346)..(416): Pfam ID: PAN_2 Pfam Description: PAN-like domain
  misc_feature (200)..(329): Pfam ID: S_locus_glycop Pfam Description: S-locus glycoprotein family
MGFLPIHRIILLCFCSLLPPPVSSDSRLLPNKPLTVGSTLICDDGTFALGFFSPSNSTQKHYYYVGIWYNNIAKDNVVWVANRATPVTDPSSATLALTNTSNLVLSSTSGQMLWTANISSTSETTAGEATLDNTGNFILRTSEGVVLWQSFDYPADTLLPGMKFRVTHNTHALQRLVSWKGPQDPALGSFSYGADPEEFLQRFVWNGSRPYRRSPVWNNYLVVGPYIGSIKSTMYFIVRNDDGEVYMSFGIPGGSSSSTVIKIKMDYSGKIEILIWNSNILEWDVLEAEPNHECSTYGYCGPFGYCDNTQPDATCKCLDSFEPISNKGMSNGRSPGGCHRKETLRCGEENTSFLTLTAMKIPDKFVYIKNRSFDECTAECASNCSCTGYAYANMSTTAINGDDTRCLLWMGDLIDTEKRIGEGENFYIRVNRSNKKRRSNILKIILPVVSSLLILIFMWLVWTCNSRAKQRNKKTWKKIISGVLSISDELGDGKLLSISFREIVLATDNFSSTNMLGHGGFGHVYRGTLECGKTIAVKRLSKGSGQGVLEFRNEVLLIAKLQHRNLVKLLGFCIHGDEKLLIYEYLSNKSLDAFLFNSTRKPSLDWSTRFNIILGIARGLLYLHQDSRLKIIHRDLKANNILLDDEMSPRISDFGMARIFYGNQQQGNTNRVVGTYGYMSPEYALEGVFSVKSDVYSFGVLVLEIVSGSKIISTHMTEDYPNLIARAWSLWKDGNAKEFVDSSIVDNCSLDETSQCIHIGLLCVQDNPNSRPFMSSILSVLETGDISLPPPKLPTYFAERNHGTDGAAEAVVNSANSMSVTELEGR

SEQ ID NO: 15122 - DNA, 2403 bp, Sorghum bicolor
  misc_feature: Ceres ANNOT ID no. 8634562
  misc_feature: Encodes the peptide sequence at SEQ ID NO 15123
atgggtttccttccaatccacagaatcatcttgctgtgtttttgttcgttactgcctcctcctgtatcatcagacagccgtcttcttcccaacaagccgctcactgttggaagcacactcatctccgatgatggcacttttgccctgggcttcttctccccgtccaactcgacccaaaaacactacttctacgttggtatatggtacaacaagatccccaaggacaacgtcgtgtgggttgccaatcgcgcaacgccagtcaccgatccttcctctgcaacacttgccctgacaaatacatccaatcttgttctgtccagtactaacagccagatgctttggacggcaaacatcagctctgcatcggagaccaccgctggagaagccacgcttgacaacactgggaatttcatccttcggacatccgagggcgtcgtcttatggcaaagcttcgattacccggccgacacccttctccctggcatgaaatttaggcgcctggtttcttggaatggtccccaagacccagccctgggcagcttctcctatggtgcggatcctgaggagttcctgcggcactttatctggaatggctcgagaccatcctggagaagtccagtgtggagtagctacttggaagttgggccatatatggaaagtatcaagtccactatctacttaacagtaagcaatgacgatggtgaggtctatatgtcctttggcatacccggtggctcctcatcgtcaactgtcatcaagatcaaaatggactactcaggaaagatagaaatcctgatctggaacagcaacattttggagtgggatgtcctggaggcagagcctagccatgaatgcagtacatatggatattgtggtccgtttgggtactgtgataacacagagcctaatgcgacatgcaagtgtctcgacagtttcgagccaataagcaacaaagacgcgagcaatggaaagcttccggaaggatgccgccgcaaggagacattatgtgaagaaaatactagtttcctaactttgacgaccatgaagattccggacaagttcgtgtatgtcaagaatagaagctttgacgaatgcacagcggaatgtgctagcaactgctcctgcataggttacgcttatgccaatatgggcaccatggctatcaatggggatgacacaaggtgcctattatggatgggtgatttgattgacacagagaagcgcattggaggagaaaatctttacattcgagtaaacagatcaattgtatcaagtttgctcatactcatattcatgtggcttgtttggacctgtaactcacgagccaaacaaagaaataagaaaacatggaagaagataatatcaggagttttgagcatttctgatgagctcggggatggtaagcttctctctattagcttcagagaaattgtactagcaacagacaaattttctagcaccaacatgcttggacacggaggttttggacatgtttataggggaacattagaatgtggtaaaacagttgctgtgaaaaggcttagtaagggttctggccagggggtattggagttcagaaatgaagtacttctcatcgccaagttgcagcacagaaacctagttaaacttcttggtttctgcattcatggagatgagaaactattgatatatgaatacttatcaaacaaaagtttggatgcctttcttttcaattccacaagaaaaccatcgcttgattggtcaacaagattcaatataatcttagggatagctagaggacttctttatcttcatcaagattcaaggctgaagataatccatagggatctcaaagcaaacaacatattattggatgatgaaatgagccccaggatatctgattttggtatggcaagaattttttatggcaaccagcaacaaggaaataccaaccgcgttgttggcacatatggttacatgtcgcctgaatatgctttggaaggtgtgttttctgtcaagtctgacgtgtatagctttggagttttagttctagagattgtgagtggctcaaagatcatctctacgcacatgacagaagattatcccaaccttatagcccgtgcttggagcttatggaaggatgggaatgcaaaagaatttgttgactcatccattgtggataattgttcacttgatgagacttcgcagtgcatccatatcgggctcttgtgtgttcaagacaacccaaattctcggccattcatgtcatcaattttgtcagttctggagactggagatatatcacttccacctccaaaactgccaacatattttgcagaaaggaatcatggaactgacggagcagcagaagctgttgtgaattctgcaaatagtatgagtgttacagagttggagggacgctag

SEQ ID NO: 15123 - protein, 800 aa, Sorghum bicolor
  misc_feature: Useful for making plants with altered cell wall content and/or composition
  misc_feature: Functional homolog of the protein sequence given in SEQ ID NO 14140
  misc_feature: Useful for making plants with modulated biomass
  misc_feature: Functional homolog of the protein sequence given in SEQ ID NO 14141
  misc_feature: Ceres ANNOT ID no. 8634562
  misc_feature (458)..(756): SWISSPROT Homolog: EC 2.7.11.1 Non-specific serine/threonine protein kinase
  misc_feature (484)..(755): Pfam ID: Pkinase Pfam Description: Protein kinase domain
  misc_feature (74)..(183): Pfam ID: B_lectin Pfam Description: D-mannose binding lectin
  misc_feature (336)..(405): Pfam ID: PAN_2 Pfam Description: PAN-like domain
  misc_feature (191)..(320): Pfam ID: S_locus_glycop Pfam Description: S-locus glycoprotein family
MGFLPIHRIILLCFCSLLPPPVSSDSRLLPNKPLTVGSTLISDDGTFALGFFSPSNSTQKHYFYVGIWYNKIPKDNVVWVANRATPVTDPSSATLALTNTSNLVLSSTNSQMLWTANISSASETTAGEATLDNTGNFILRTSEGVVLWQSFDYPADTLLPGMKFRRLVSWNGPQDPALGSFSYGADPEEFLRHFIWNGSRPSWRSPVWSSYLEVGPYMESIKSTIYLTVSNDDGEVYMSFGIPGGSSSSTVIKIKMDYSGKIEILIWNSNILEWDVLEAEPSHECSTYGYCGPFGYCDNTEPNATCKCLDSFEPISNKDASNGKLPEGCRRKETLCEENTSFLTLTTMKIPDKFVYVKNRSFDECTAECASNCSCIGYAYANMGTMAINGDDTRCLLWMGDLIDTEKRIGGENLYIRVNRSIVSSLLILIFMWLVWTCNSRAKQRNKKTWKKIISGVLSISDELGDGKLLSISFREIVLATDKFSSTNMLGHGGFGHVYRGTLECGKTVAVKRLSKGSGQGVLEFRNEVLLIAKLQHRNLVKLLGFCIHGDEKLLIYEYLSNKSLDAFLFNSTRKPSLDWSTRFNIILGIARGLLYLHQDSRLKIIHRDLKANNILLDDEMSPRISDFGMARIFYGNQQQGNTNRVVGTYGYMSPEYALEGVFSVKSDVYSFGVLVLEIVSGSKIISTHMTEDYPNLIARAWSLWKDGNAKEFVDSSIVDNCSLDETSQCIHIGLLCVQDNPNSRPFMSSILSVLETGDISLPPPKLPTYFAERNHGTDGAAEAVVNSANSMSVTELEGR

SEQ ID NO: 15124 - DNA, 780 bp, Sorghum bicolor
  misc_feature: Ceres ANNOT ID no. 8634667
  misc_feature: Encodes the peptide sequence at SEQ ID NO 15125
atggctccttgctcctccgtcgtcgccgcaccatcgctctccgcctcggcgccgtccagccggcggcgcgcgagtacggttgtatgtctccagggtgttcgccgcagcagggtcgcgtcctgccgcgtgcggtgtagcgccgccggcgggcagggcggggtcaaggtccctgcgaagctgtcggagctgtgggcggcggcgaagggcgcgcctcctctggccgtgctcgcgggtgtggcggcggcggtggccgtctacaaggttgggtccagtctctttgcgccgcgccgtcccgcgcctcgtcggctggagacccagacggcccctccgcctccagccccggagccggtgcaggtgggtgagataacggaggaggagttgcggcagtacgacgggtccgaccccgagaagccgcttctgatggccatcaaggggcagatctatgatgtctcacagagcaggatgttctatggacctggcggagcatattcgttatttgctggtaaagatgccagtagggcattggccaagatgtcctttgaaccaccggatctgaatggtgatatatctggcctaacgccaatggagctcggttccttgaatgactgggagtacaagttcaccagcaagtatgtgaaggtaggaaccataagaagaacagtgcctgctgaagaggtttatggcagcatttcacctgaaataagggaagaagttactgtgcctgtggttgaggctgagcttgaacctgagcctgagccgcatgatggcgatgcaccatga

SEQ ID NO: 15125 - protein, 259 aa, Sorghum bicolor
  misc_feature: Useful for making plants with modulated nitrogen use efficiency
  misc_feature: Functional homolog of the protein sequence given in SEQ ID NO 14142
  misc_feature: Ceres ANNOT ID no. 8634667
  misc_feature (121)..(218): Pfam ID: Cyt-b5 Pfam Description: Cytochrome b5-like Heme/Steroid binding domain
MAPCSSVVAAPSLSASAPSSRRRASTVVCLQGVRRSRVASCRVRCSAAGGQGGVKVPAKLSELWAAAKGAPPLAVLAGVAAAVAVYKVGSSLFAPRRPAPRRLETQTAPPPPAPEPVQVGEITEEELRQYDGSDPEKPLLMAIKGQIYDVSQSRMFYGPGGAYSLFAGKDASRALAKMSFEPPDLNGDISGLTPMELGSLNDWEYKFTSKYVKVGTIRRTVPAEEVYGSISPEIREEVTVPVVEAELEPEPEPHDGDAP

SEQ ID NO: 15126 - DNA, 672 bp, Sorghum bicolor
  misc_feature: Ceres ANNOT ID no. 8634666
  misc_feature: Encodes the peptide sequence at SEQ ID NO 15127
atggcggtggcggagctgtgggagacgctgaagcaggcgatcgttgcgtacacgggcctgtcgccggcggccttcttcacggccgtcgcggtggcggccgctctgtaccacgtcgtgtcggggctcttcgcggccccgccgccgccgccgccgcgcccgcgggaggagcccgaggcggagccgctcccgccccccgtgcagttgggggaggtctccgaggaggagctccgccagtacgacggctccgacactaagaagccgctcctcatggccatcatgggccagatctacgacgtcacccagagcagaatgttctatggacctggcggaccttatgccctatttgctggtaaagatgccagcagagccctagcaaagatgtcctttgagccacaggatcttactggcgacatctctggcctaggcccatttgagcttgacgccctgcaggattgggaatacaagttcatgagcaagtatgtgaaggttggtactgtcaagaagactgtccctgttgaagacggcagcaccgcaagcacggcccctgaagccagtgaggccaccactgaggctgagaaggcacagacaaccgaagagaagccaagggaggtatctgcggaggcggtaaaggagaaggaagccccatctgatgaaggtgcccaggaaaactag

SEQ ID NO: 15127 - protein, 223 aa, Sorghum bicolor
  misc_feature: Useful for making plants with modulated nitrogen use efficiency
  misc_feature: Functional homolog of the protein sequence given in SEQ ID NO 14142
  misc_feature: Ceres ANNOT ID no. 8634666
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (70)..(167): Pfam ID: Cyt-b5 Pfam Description: Cytochrome b5-like Heme/Steroid binding domain
MAVAELWETLKQAIVAYTGLSPAAFFTAVAVAAALYHVVSGLFAAPPPPPPRPREEPEAEPLPPPVQLGEVSEEELRQYDGSDTKKPLLMAIMGQIYDVTQSRMFYGPGGPYALFAGKDASRALAKMSFEPQDLTGDISGLGPFELDALQDWEYKFMSKYVKVGTVKKTVPVEDGSTASTAPEASEATTEAEKAQTTEEKPREVSAEAVKEKEAPSDEGAQEN

SEQ ID NO: 15128 - DNA, 2502 bp, Sorghum bicolor
  misc_feature: Ceres ANNOT ID no. 8634697
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 15129
atggctggcccgccgaaagggttcgacagccgatctcgagcgctagagtcagggatccccagcgagcggtcgaagatcgaggcccgcctcgaggactcgctggtgatgttcaaggtcatgggaggcgtgatagggagcaagcttctgtcccatcgttctttttgcagccttcccaccgaacgacccagggcgtgtcaggacgcaggaaacaaggatggaacgtctaatcgggaccccctcgagacgcccaaggtcagcgctccagataccagcatattacacggcgtccgaccctcgaccaaacagggcaccttcccaggaacaagttgggcgtcgaatgacttcatcacagctaccccgtcgggtccgccgacataccgtacaagcgtgcgacctcagaaccagcacaaggcggctggcagggtagaacacaggagcacgcgtaatcatcaccgagctatcaagatgggacggctcgaggccatgccgtacggaagcctcgaggggtctagccttctatttatagcccgatgggatggatacgcgccgttggatcaaaccgacttaacaagcggccaagatggctcctcggaggtggtggaggaagctattgatccaaggtttctttgcgctttctctagtggtacattcttgtccattattattgtttcacatagttcaattgcatcaatatttttctcatctttggagctagcaatccatgtggagaaggttgttcactcgccgaacaagggcaagtatgatggaaaaatgatgttcttgggtcaacgctgtcgacttgctttgatagaagtgaaatcaactgttgaagtgaagctccctcatgatggttctagaccccggtacaatgagaaggtgacagttcattttgatgttgagaaacgtggcattagacaaggaaatgtaattagcttctccaatgtggatcctcgctacctaccagagagatctcttatcgttctgaagattgagaaggtgatagggtcttgtgaaaaggattcttctccgtggaagcgtgttaatgtggtacaaggggagatatttgcatttactgtagttcttttttttggggtaaattacagtaaattaccatgttccaaagagagacctactggacgccccaatggtaatttaccaaaaagtcatgaaaaaattgcccatgttatgaacagagaccctgacaatctattccaaaccctgcactcggtgcacaacggcaatattcatatcgactccgctccgcctcaggccctcagcctaccgcttttggtgacttccgacgtccgtggccggtgcacggctgctttccacggaaaatacacactcctcttgcttttaccaccaccggacacgggtaaaacgagagctgggccggcagacgggcaggggcaaggggcaggcgcccagacccaccgggggatctcacgcatcccgaacgcggccacgcccgccgcgggcacacgcggcgcgctctgctcccccctgtctgcctccgcgcccggcacgcacgcgcacactcgcgctcggccctgtcgtgtccctgcccaccacacgccctcatcgtctcctcctctccttccctcaaagcccaccaccgctgcccccacgccacccacccccaccccatccccacccccaccgcgcggcgcccgagaacccagaccagacccctctcctcaccttccttccttccttccttcccatcgcaatcgcaagggcgggcggcggcggcggaggaggaggaggaggaggatgcggaaggcgtacagggactccatcaaggtgctcgaagctgacatccagcacgccaacaccctggcctccgagtttccccgggactatgacggtgcgtgtctgcagatgcggctgtcgtacagtcccgcagctcatatattcctcttcctggtgcagtggacagactgcagcctcgccggggcgcttggtctgctgagaatcctcatatacaaggtttatgtggatggcacgacaaccatgtcgactcatgagaggaaagcaagtatcaaagaattctatgctgtgatatttccttctttgctgcaactgcaaagggggatcactgatgtggaggacaagaagcagaaggccgtgtgcatggagaggtacacaaagaaagatgaggacgaacggggctccttatctgatattgatgtcgagagggaagaggagtgtgggatttgcatggagatgaacagcaaagttgtgctgcccaactgcacccatgctatgtgcctcagatgttaccaagactggagttcaagatcgcagtcctgcccattctgccgcgacaacctgaagaagacctgtcctggtgacttgtggatctatgtcgaggaccaagatgtggttgacatggagacagtgtcaagcgagaacctcagacggctgttcatgtacataagcaagctgcctctgattgtcccagacgtcattttcagtgtttatgattcccacataaaatga

SEQ ID NO: 15129 - protein, 833 aa, Sorghum bicolor
  misc_feature: Useful for making plants with altered lignin content
  misc_feature: Functional homolog of the protein sequence given in SEQ ID NO 13283
  misc_feature: Ceres ANNOT ID no. 8634697
MAGPPKGFDSRSRALESGIPSERSKIEARLEDSLVMFKVMGGVIGSKLLSHRSFCSLPTERPRACQDAGNKDGTSNRDPLETPKVSAPDTSILHGVRPSTKQGTFPGTSWASNDFITATPSGPPTYRTSVRPQNQHKAAGRVEHRSTRNHHRAIKMGRLEAMPYGSLEGSSLLFIARWDGYAPLDQTDLTSGQDGSSEVVEEAIDPRFLCAFSSGTFLSIIIVSHSSIASIFFSSLELAIHVEKVVHSPNKGKYDGKMMFLGQRCRLALIEVKSTVEVKLPHDGSRPRYNEKVTVHFDVEKRGIRQGNVISFSNVDPRYLPERSLIVLKIEKVIGSCEKDSSPWKRVNVVQGEIFAFTVVLFFGVNYSKLPCSKERPTGRPNGNLPKSHEKIAHVMNRDPDNLFQTLHSVHNGNIHIDSAPPQALSLPLLVTSDVRGRCTAAFHGKYTLLLLLPPPDTGKTRAGPADGQGQGAGAQTHRGISRIPNAATPAAGTRGALCSPLSASAPGTHAHTRARPCRVPAHHTPSSSPPLLPSKPTTAAPTPPTPTPSPPPPRGAREPRPDPSPHLPSFLPSHRNRKGGRRRRRRRRRRMRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKAVCMERYTKKDEDERGSLSDIDVEREEECGICMEMNSKVVLPNCTHAMCLRCYQDWSSRSQSCPFCRDNLKKTCPGDLWIYVEDQDVVDMETVSSENLRRLFMYISKLPLIVPDVIFSVYDSHIK

SEQ ID NO: 15130 - DNA, 483 bp, Sorghum bicolor
  misc_feature: Ceres ANNOT ID no. 8634765
  misc_feature: Encodes the peptide sequence at SEQ ID NO 15131
atgcagctcttcgtgaggtcgctgacgaggacgatcacgctggaggtcgagccgtcgtcggacacggtggcgtccgtgaaggccaaggtgcaggacatcgagggcatcccgccggacgagcagcggctcatcttcgcggggaaggagctgaaggacggccccacgctggcggactacagcgtccacaaggaggatatgctgaacctgtgcctccgcctcctcggcggcggcaagaagcgcaagaagaagacgttcaccacccccaagaagggcaagcacgagcacaagagcgccgggctcgacgccgtgctcgggcggtacagggtcgatgaggccacggggaaggtggagaggctgcgcaaggaatgccccaacgcggagtgcggccctggcgtgttcatggcggcgcacgccgacaggcacgcctgcggcaggtgcggcctcacctacgtcgtcgtcgagaaccatatgtttttcttatga

SEQ ID NO: 15131 - protein, 160 aa, Sorghum bicolor
  misc_feature: Useful for making plants with modulated cold sensitivity
  misc_feature: Functional homolog of the protein sequence given in SEQ ID NO 13521
  misc_feature: Ceres ANNOT ID no. 8634765
  misc_feature (102)..(149): Pfam ID: Ribosomal_S27 Pfam Description: Ribosomal protein S27a
  misc_feature (6)..(74): Pfam ID: ubiquitin Pfam Description: Ubiquitin family
MQLFVRSLTRTITLEVEPSSDTVASVKAKVQDIEGIPPDEQRLIFAGKELKDGPTLADYSVHKEDMLNLCLRLLGGGKKRKKKTFTTPKKGKHEHKSAGLDAVLGRYRVDEATGKVERLRKECPNAECGPGVFMAAHADRHACGRCGLTYVVVENHMFFL

SEQ ID NO: 15132 - DNA, 2517 bp, Sorghum bicolor
  misc_feature: Ceres ANNOT ID no. 8634955
  misc_feature: Encodes the peptide sequence at SEQ ID NO 15133
atggcagcagccgtagcgatgcggagcgggagcagcgatggcggcggcgggtacgagaagggcgggatggacacgggcaagtatgtgcggtacacgccggagcaggtggagacgctggagcgggtgtacgctgagtgccccaagcccagctccgcgcgaaggcagcagctgctacgcgagtgccccatcctctcaaacatcgagcccaagcagattaaagtctggttccagaaccggaggtgccgtgataagcagcggaaggagtcttcgaggctccaagccgtgaacagaaaattgaccgcaatgaacaagcttctcatggaggagaatgagcgattgcagaagcaggtttcccagctggttcacgagaatgcgtacatgaagcagcagctacagaatccgtcattggcaaatgatgccagctgtgattcaaatgtgaccgctcctgcaaacctaagggatgcgagtaacccatcagggctcctttcaattgcagaggagaccttgacagagttcctctcaaaggctacagggactgctattgattgggtccaaatgcctgggatgaagcctggtccggattcttttggtattgtgaccatttcacatggtggccgtggtgttgctgcccgtgcctgtggtctggtgaacctagaaccaacaaagattgtagaaatcttgaaagaccgcccatcttggttccgtgattgtcggagtcttgaagtctttacaatgttaccagctggaaatggtgggaccattgaacttgtttacatgcagatgtatgctcctactactttagttcctgcacgggacttttggacactgaggtacacaaccactatggaggatggcagtcttgtggtttgtgagagatctttaagtggttctggagatggtcaaagcgctgccacagcacaacagtttgtaagagccgagatgcttcctagtggctatttagttcgccaatgtgagggtggcggctcgattgtgcgaatagtggaccatctcgaccttgacgcttggagtgttcctgaagttcttcgccccctctatgagtcgtcccgggtagttgctcagaagatgacaaccgcagcgctacggcacctcagacaaattgctcaagaaacaagtggagaggttgtatatgctatggggaggcaaccagctgttctacgaacatttagtcagaggctgagtagaggttttaatgatgctataagtggtttcaatgatgatggttggtccattatggctggagatggcatagaagatgttatcattgcttgcaactcgaagaagattaggagcggtagcaatcctgcaactgcttttggagcccctggaggtatcatctgtgctaaagcatccatgttgctgcagagtgttcctccagcagtccttgttaggttcctgagggaacatcggtctgagtgggcagattataacttcgatgcatattcagcttcagcgctgaaaacaagcccttgttcccttcctgggttgcggcctatgagattttctgggagccagatcatcatgccccttgctcacacggtggagaatgaggagatcttagaagttgttcggcttgaaggacagactcttacacatgacgagggccttttatcaagagatatccatctgcttcagctttgcactggaatagacgagaaatcaatgggatcctgcttccagcttgtctttgcaccaatcgatgagcttttccctgatgatgctccattaatatcctcaggcttccgtgttatcccattggacataaaaacagatggactatcctctggaagaacgttagatttggcctctagccttgaagttggtgcaaccacacaacaagcatcagcagatggatctcaggatgcttgcaacctgcgatctgtgttgacaattgcctttcaatttccctatgaaatacatctccaagatactgttgcagctatggcccgtcaatatgttcgaagcattgtctctgctgttcaaagagtatcaatggctatttctccctcccagtctggcttgaatactgggcagaagataatttctggcttccctgaagctgcaacacttgttcgctggatttgccaaagctaccggtatcacatgggggtggatttggtcagccactcggatcaagctggggaatcactattgagaatgttctgggatcatcaggacgctgtcttgtgctgctctttcaaggaaaagcctgtgtttacttttggcaaccagatgggaattgacatgttagaaacaactctaattgctctacaagatctcaccctggacaagatttttgacgagcctggcagaaaggcattacacgcggaggttccgaaactgatggaacagggatatgcgtacttgccggctggggtatgcttgtctgggatgggccgccatgtctcctatgaggaagctgttgcgtggaaagttctcggtgaagatggcaacgtacactgcctcgccttctgtttcgtcaactggtccttcgtttga

SEQ ID NO: 15133 - protein, 838 aa, Sorghum bicolor
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 2 in US patent 7056739
  misc_feature: Useful for making plants with altered lignin content
  misc_feature: Useful for making plants with altered carbohydrate content
  misc_feature: Functional homolog of the protein sequence given in SEQ ID NO 13708
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
  misc_feature: The sequence is a functional homolog of SEQ ID NO 1108 in the 10/412,699 US patent application
  misc_feature: The sequence is a functional homolog of SEQ ID NO 665 in the 10/374,780 US patent application
  misc_feature: The sequence is a functional homolog of SEQ ID NO 782 in the 10/666,642 US patent application
  misc_feature: Ceres ANNOT ID no. 8634955
  misc_feature (691)..(838): Pfam ID: MEKHLA Pfam Description: MEKHLA domain
  misc_feature (163)..(373): Pfam ID: START Pfam Description: START domain
  misc_feature (27)..(85): Pfam ID: Homeobox Pfam Description: Homeobox domain
MAAAVAMRSGSSDGGGGYEKGGMDTGKYVRYTPEQVETLERVYAECPKPSSARRQQLLRECPILSNIEPKQIKVWFQNRRCRDKQRKESSRLQAVNRKLTAMNKLLMEENERLQKQVSQLVHENAYMKQQLQNPSLANDASCDSNVTAPANLRDASNPSGLLSIAEETLTEFLSKATGTAIDWVQMPGMKPGPDSFGIVTISHGGRGVAARACGLVNLEPTKIVEILKDRPSWFRDCRSLEVFTMLPAGNGGTIELVYMQMYAPTTLVPARDFWTLRYTTTMEDGSLVVCERSLSGSGDGQSAATAQQFVRAEMLPSGYLVRQCEGGGSIVRIVDHLDLDAWSVPEVLRPLYESSRVVAQKMTTAALRHLRQIAQETSGEVVYAMGRQPAVLRTFSQRLSRGFNDAISGFNDDGWSIMAGDGIEDVIIACNSKKIRSGSNPATAFGAPGGIICAKASMLLQSVPPAVLVRFLREHRSEWADYNFDAYSASALKTSPCSLPGLRPMRFSGSQIIMPLAHTVENEEILEVVRLEGQTLTHDEGLLSRDIHLLQLCTGIDEKSMGSCFQLVFAPIDELFPDDAPLISSGFRVIPLDIKTDGLSSGRTLDLASSLEVGATTQQASADGSQDACNLRSVLTIAFQFPYEIHLQDTVAAMARQYVRSIVSAVQRVSMAISPSQSGLNTGQKIISGFPEAATLVRWICQSYRYHMGVDLVSHSDQAGESLLRMFWDHQDAVLCCSFKEKPVFTFGNQMGIDMLETTLIALQDLTLDKIFDEPGRKALHAEVPKLMEQGYAYLPAGVCLSGMGRHVSYEEAVAWKVLGEDGNVHCLAFCFVNWSFV

SEQ ID NO: 15134 - DNA, 2070 bp, Sorghum bicolor
  misc_feature: Ceres ANNOT ID no. 8634958
  misc_feature: Encodes the peptide sequence at SEQ ID NO 15135
atgaaggaggcgcgcgaggaggagaggtgccttgacccgcagctgtggcacgcgtgcgccggcggcatggtgcagatgccccccgtgcgctcccgtgtctactacttcccgcagggccacgcggagcacgcgcacgccggcggcgccgccgacctcgccgccggggcgcggccgctcccgccgctcgtgctctgcgccgtcaccggggtgcgcttcctggccgatccggagaccgacgaggtcttcgccaagatccgcctggtgccgctcgcgcccggcgaggtggagttccgagagcccgacgagttcggcctcggcgtcggcggcgtcggcgtcgaccccgcggacgcccgggagaagctgtcctccttcgccaagacgctcacgcagtccgacgccaacaacggcggcggcttctccgtgccgcgctactgcgccgagaccatcttccccaagctcgactaccgggccgacccgcccgtacagacggtgctcgccaaggacgtgcacggggaggtctggaagttccgacacatttaccggggcacgccgcgccggcatttgctcaccacgggatggagcaccttcgtcaaccagaagaagctcgtcgccggggactccatcgtcttcctgcgcaccgagcatggcgagctgtgcgtcgggatacgccgtgccaagcgggtgtcctgtggtggcatggagtgcatgtctggctggaacgccccggggtatggggccctgtcggccttcttgaaggatgaggagggtaagatgatcaagggtcctggtgggtacatgagaggcagggggaaggtcaagatcacggatgttgttgaggccgcaagccttgcggccagcggccaaccatttgaggtggtgtactacccgagagctagcacaccggagtttgttgtcaaggcagcatcggtgcagaacgcgatgaggaaccagtggtgccccgggatgaggttcaagatggcatttgagacagaggattcatcaaggatcagctggtttatggggaccatagcttctgctcaggttgccgacccaatcagatggccaaattcaccgtggaggcttcttcaggtgacatgggatgaacctgacttgctgcagaatgtgaaatgtgtcaatccatggcttgtggagattgtatcaagtattccacccattcacctgggaccattttctccacctagaaagaagttgcggatgccccaacatccagactttccatttgacggtcagctgttgaatccaattttccacggcaacccacttggtccaagcaacagcgctcttcgctgtttctcggacattgctcctgcaggcatacagggagccaggcatgctcaatttggtttacccctaacagaccaccagcttagcaagctgcacctcggtctgttccaaggcggcggttttaaccggtttgatgctatcactccgccatcccatatatccaagggttttgtgatcagcagtgcaccagtcaatgagagtgtctcttgcttgttgacaattggcacaccacaggccacagagaaatctgatgacagaaagaaaccccatataatgctgtttggcaagccgatccttactgagcagcagatgaattctagaggatcaagggaaacattctcccctgaggttactgggaacagttcttctgatggcaatgttcagaagacaggaaatgtatctgatggttctggttcatcgatttgcatcggtttctcatcccaaggtcacgaggcttctgagcttgggttagaagccgggcactgcaaggtatttatggaatcagaggatgttggtcgcaccattgacttgtctgtctttggttcatacgaagagctgtacggtcagttagctgacatgtttggaattgagaaggcagaaataatgagccacctttgttaccgtgatgctgctggtgctgtcaagcatactggtgaagagccattcagtgacttcatgaaagtagcacggaggctcaccataatagagagcaccgaggggagactgcagaaacctctcatcgaatacatgatggagcgggcttga

SEQ ID NO: 15135 - protein, 689 aa, Sorghum bicolor
  misc_feature: The sequence is a functional homolog of SEQ ID NO 1186 in the 10/666,642 US patent application
  misc_feature: The sequence is a functional homolog of SEQ ID NO 1185 in the 10/666,642 US patent application
  misc_feature: The sequence is a functional homolog of SEQ ID NO 1184 in the 10/666,642 US patent application
  misc_feature: The sequence is a functional homolog of SEQ ID NO 442 in the 10/666,642 US patent application
  misc_feature: The sequence is a functional homolog of SEQ ID NO 1428 in the 10/666,642 US patent application
  misc_feature: The sequence is a functional homolog of SEQ ID NO 1431 in the 11/479,226 US patent application
  misc_feature: The sequence is a functional homolog of SEQ ID NO 168 in the 10/666,642 US patent application
  misc_feature: Ceres ANNOT ID no. 8634958
  misc_feature (280)..(363): Pfam ID: Auxin_resp Pfam Description: Auxin response factor
  misc_feature (123)..(228): Pfam ID: B3 Pfam Description: B3 DNA binding domain
MKEAREEERCLDPQLWHACAGGMVQMPPVRSRVYYFPQGHAEHAHAGGAADLAAGARPLPPLVLCAVTGVRFLADPETDEVFAKIRLVPLAPGEVEFREPDEFGLGVGGVGVDPADAREKLSSFAKTLTQSDANNGGGFSVPRYCAETIFPKLDYRADPPVQTVLAKDVHGEVWKFRHIYRGTPRRHLLTTGWSTFVNQKKLVAGDSIVFLRTEHGELCVGIRRAKRVSCGGMECMSGWNAPGYGALSAFLKDEEGKMIKGPGGYMRGRGKVKITDVVEAASLAASGQPFEVVYYPRASTPEFVVKAASVQNAMRNQWCPGMRFKMAFETEDSSRISWFMGTIASAQVADPIRWPNSPWRLLQVTWDEPDLLQNVKCVNPWLVEIVSSIPPIHLGPFSPPRKKLRMPQHPDFPFDGQLLNPIFHGNPLGPSNSALRCFSDIAPAGIQGARHAQFGLPLTDHQLSKLHLGLFQGGGFNRFDAITPPSHISKGFVISSAPVNESVSCLLTIGTPQATEKSDDRKKPHIMLFGKPILTEQQMNSRGSRETFSPEVTGNSSSDGNVQKTGNVSDGSGSSICIGFSSQGHEASELGLEAGHCKVFMESEDVGRTIDLSVFGSYEELYGQLADMFGIEKAEIMSHLCYRDAAGAVKHTGEEPFSDFMKVARRLTIIESTEGRLQKPLIEYMMERA

SEQ ID NO: 15136 - DNA, 672 bp, Sorghum bicolor
  misc_feature: Ceres ANNOT ID no. 8635017
  misc_feature: Encodes the peptide sequence at SEQ ID NO 15137
atggacctgattccgcacccggacagcccgcactccgacaacagcggcggcgtcggcggcggtggcggtggcggcggcgtgggatcggtgtccggggcgctgtcgccggcgggggcgtcgtccgcgggcgcggtgtcggcgctggcgtcgccgagccggtacgagtcgcagaagcgcagggactggaacacgttcgggcagtacctgcggaaccaccgcccgccgctgtccctggcgcgctgcagcggcgcgcacgtgctcgagttcctgcgctacctcgaccagttcggcaagaccaaggtgcacaccccggcctgccccttcttcggccacccggcgccgccggcgccctgcccgtgcccgctccgccaggcgtggggcagcctggacgcgctcgtgggcaggctgcgcgccgcctacgaggagaacggggggcggcccgagaacaaccccttcggcgcgcgcgccgtcaggctctacctccgcgaggtgcgcgaccatcagtcccgcgcccggggcgtcagctacgagaagaagaagcgcaagaaggccccggcgcaccccgtccccgccgccgtcatctcctcctcctcctcccacgacggcaacggacaccaccactacgagcaccaccagatgccgccgccaccaccgcccggcgcagcggcttga

SEQ ID NO: 15137 - protein, 223 aa, Sorghum bicolor
  misc_feature: Useful for making plants with modulated low light sensitivity
  misc_feature: Functional homolog of the protein sequence given in SEQ ID NO 14143
  misc_feature: Useful for making plants with modulated flowering time
  misc_feature: Useful for making plants with modulated nitrogen use efficiency
  misc_feature: Functional homolog of the protein sequence given in SEQ ID NO 13982
  misc_feature: Useful for making plants with modulated biomass
  misc_feature: Functional homolog of the protein sequence given in SEQ ID NO 13338
  misc_feature: Useful for biocontainment applications
  misc_feature: Functional homolog of the protein sequence given in SEQ ID NO 13983
  misc_feature: Ceres ANNOT ID no. 8635017
MDLIPHPDSPHSDNSGGVGGGGGGGGVGSVSGALSPAGASSAGAVSALASPSRYESQKRRDWNTFGQYLRNHRPPLSLARCSGAHVLEFLRYLDQFGKTKVHTPACPFFGHPAPPAPCPCPLRQAWGSLDALVGRLRAAYEENGGRPENNPFGARAVRLYLREVRDHQSRARGVSYEKKKRKKAPAHPVPAAVISSSSSHDGNGHHHYEHHQMPPPPPPGAAA

SEQ ID NO: 15138 - DNA, 576 bp, Sorghum bicolor
  misc_feature: Ceres ANNOT ID no. 8635110
  misc_feature: Encodes the peptide sequence at SEQ ID NO 15139
atgggcaagtacatgcgcaaggtcaaggtttccggcgaggtcgccatcatggatgtgtcctccgctccgctcggagtccgcacccgcgcgcgcgccctcgcgctgcagcgcctgcagaagcagcaggcgcagggggaggagggcgccggcggcgagtacctggagctaaggagccggaggctcgagaagctgccgccaacagcagcgcccatgaggaggaaggccgcggccgcggcagccgccgctaaggaggaggtggaggcgtcgtacggggagaacatgctcgagttggaggccatggagaggggtaccagggagacgacgccctgcagcttgattaactctgagatgattgccactcccagaactcccgggtccacaacaagatccaatcactcttcccaccgcagggtgaaagctcctccggtgcacgccgtcccaagttcaagggagatgaatgagtacttcgctgctgaacagcgacgccaacaacaggctttcattgacaagtacaactttgatcctgtaaatgactgccctctcccaggcaggtttgaatgggtgaagctagactga

SEQ ID NO: 15139 - protein, 191 aa, Sorghum bicolor
  misc_feature: Useful for making plants with modulated light quality response
  misc_feature: Functional homolog of the protein sequence given in SEQ ID NO 14144
  misc_feature: Ceres ANNOT ID no. 8635110
  misc_feature (143)..(191): Pfam ID: CDI Pfam Description: Cyclin-dependent kinase inhibitor
MGKYMRKVKVSGEVAIMDVSSAPLGVRTRARALALQRLQKQQAQGEEGAGGEYLELRSRRLEKLPPTAAPMRRKAAAAAAAAKEEVEASYGENMLELEAMERGTRETTPCSLINSEMIATPRTPGSTTRSNHSSHRRVKAPPVHAVPSSREMNEYFAAEQRRQQQAFIDKYNFDPVNDCPLPGRFEWVKLD

SEQ ID NO: 15140 - DNA, 3177 bp, Sorghum bicolor
  misc_feature: Ceres ANNOT ID no. 8635156
  misc_feature: Encodes the peptide sequence at SEQ ID NO 15141
atggacaacgacgacaaggtccggagcgccgacgtgaagacgtgccgcgtgtgcgccgacgaggtcgggacgcgggaggacgggcagcccttcgtggcgtgcaccgagtgcggcttccccgtctgccggccgtgctacgagtacgagcgcagcgagggcacgcagtgctgcccgcagtgcaacacccgctacaagcgccagaaagggtccccgagggtggaaggggacgaggacgagggcccggagatggacgacttcgaggaggagttccccgtcaagagccccaacaagcctcacgagcccgtcccgttcgacgtctactccgagaacggcgagcagccggcgcagaaatggcggacgggaggccacacgctgtcgtccttcaccggaagcgtggccggtaaggacctggaggcggagagggagatggagggcagcatggagtggaaggaccggatcgacaagtggaagaccaagcaggagaagaggggcaagctgaaccacgacgacagcgacgacgacgacgacgacgacaagaacgaggacgagtacatgctgctggccgaggcccgccagccgctgtggcgcaaggtcccgatcccgtccagcaagatcaacccgtaccgcatcgtcatcgtgctccgccttgttgtcctgtgcttcttcctcaagttccggatcacgacgcccgccatggacgccgtgccgctgtggctggcgtccgtcatctgcgagctctggttcgccttctcctggatcctggaccagctccccaagtgggcgcccgtgacgcgggagacgtacctggaccgcctcgccctgcgctacgaccgcgacggcgaggcgtgccggctgtccccgatcgacttcttcgtcagcacggtggacccgctcaaggagccccccatcatcaccgccaacaccgtgctgtccatcctcgccgtcgactaccccgtcgaccgcgtcagctgctacgtctccgacgacggcgcctccatgctcctcttcgacacgctgtccgagaccgccgagttcgcgcgccgctgggtgcccttctgcaagaagttcgccgtggagccacgcgcgccggagttctacttctcgcacaagatcgactacctcaaggacaaggtgcagccgacgttcgtcaaggagcgtcgcgccatgaagcgagagtacgaggagttcaaggtccggatcaacgcgctggtggccaaggcgcagaagaagcccgaggaagggtgggtgatgcaggacggcacgccgtggcccggcaacaacacgcgcgaccacccgggcatgatccaggtgtacctcggcacccagggcgcgctggacgtggaaggacacgagctgccccggctggtgtacgtgtcccgtgagaagcggcccgggtacaaccaccacaagaaggccggcgccatgaacgcgctggtgcgcgtctccgccgtgctcaccaacgcgcccttcatcctcaacctcgactgcgaccactacgtgaacaacagcaaggccgtgcgcgaggccatgtgcttcctcatggacccgcagctggggaagaagctctgctacgtgcagttcccgcagcggttcgacggcatcgacaggcacgaccgatacgccaaccggaacgtcgtcttcttcgacatcaacatgaaggggctggacggcatccagggccctgtgtacgtcggcacgggatgcgtcttcaaccgccaggcactgtacggctacgacccgccgaggccggagaagaggcccaagatgacgtgcgactgctggccgtcgtggtgctgctgctgctgctgcttcggcggagggaagcgcggcaaggccaggaaggacaagaagggcggcgccgacggcggcgaggagccgcgcaggggcctgctcggcttctacaggaagcggagcaagaaggacaagctcggcggcggcggcgggtcggtggccggcagcaagaagggcggcgcgctgtacaagaagcaccagcgcgcgttcgagctggaggagatcgaggagggcctggaggggtacgacgagctggagcgctcctcgctcatgtcccagaagagcttcgagaagcggttcggccagtcgcccgtgttcatcgcctccacgctcgtcgaggacggcggtctgccgcagggcgccgccgccgaccccgccgcgctcatcaaggaggccatccacgtcatcagctgcgggtacgaggagaagacagagtggggcaaggagattgggtggatctacgggtcggtgacggaggatattctgacggggttcaagatgcactgccggggatggaagtcggtgtactgcacgccgacacggccggcgttcaaggggtcggcgcccatcaacctgtcggatcgtctccaccaggtgctgcgttgggcgctggggtcggtggagatcttcatgagccgccactgcccgctctggtacgcctacggcgggcggctcaagtggctggagcgcttcgcctacaccaacaccatcgtctaccccttcacctccatcccgctgctcgcctactgcaccatccccgccgtctgcctgctcaccggcaagttcatcattcccacgctgaacaaccttgcgagcatctggttcatcgcgctgttcctgtccatcatcgcgacgagcgtgctggagctgcggtggagcggggtgagcatcgaggactggtggcggaacgagcagttctgggtgatcggcggcgtgtcggcgcacctgttcgccgtgttccagggcttcctcaaggtgctgggcggcgtggacaccagcttcaccgtcacctccaaggcggccggcgacgaggcggacgcgttcggggagctctacctcttcaagtggacgacgctgctggtgcccccgacgacgctcatcatcatcaacatggtgggcatcgtggcgggggtctccgacgccgtcaacaacgggtacggctcgtgggggccgctgttcggcaagctcttcttctccttctgggtcatcgtccacctgtacccgttcctcaagggcctgatggggaggcagaaccggacgcccaccatcgtcgtgctctggtccatcctcctcgcctccatcttctcgctcgtctgggtcaggatcgaccccttcatcccaaaggccaagggacccatcctcaagccatgcggagtcgagtgctga

SEQ ID NO: 15141 - protein, 1058 aa, Sorghum bicolor
  misc_feature: Useful for making plants with altered cell wall content and/or composition
  misc_feature: Functional homolog of the protein sequence given in SEQ ID NO 14145
  misc_feature: Useful for making plants with modulated biomass
  misc_feature: Functional homolog of the protein sequence given in SEQ ID NO 14146
  misc_feature: Useful for making plants with modulated plant growth and development
  misc_feature: Functional homolog of the protein sequence given in SEQ ID NO 13629
  misc_feature: Ceres ANNOT ID no. 8635156
  misc_feature: Down-regulated in shoot tissues in response to salicylic acid treatment
  misc_feature (2)..(597): SWISSPROT Homolog: EC 2.4.1.12 Cellulose synthase (UDP-forming)
  misc_feature (193)..(1053): Pfam ID: Cellulose_synt Pfam Description: Cellulose synthase
MDNDDKVRSADVKTCRVCADEVGTREDGQPFVACTECGFPVCRPCYEYERSEGTQCCPQCNTRYKRQKGSPRVEGDEDEGPEMDDFEEEFPVKSPNKPHEPVPFDVYSENGEQPAQKWRTGGHTLSSFTGSVAGKDLEAEREMEGSMEWKDRIDKWKTKQEKRGKLNHDDSDDDDDDDKNEDEYMLLAEARQPLWRKVPIPSSKINPYRIVIVLRLVVLCFFLKFRITTPAMDAVPLWLASVICELWFAFSWILDQLPKWAPVTRETYLDRLALRYDRDGEACRLSPIDFFVSTVDPLKEPPIITANTVLSILAVDYPVDRVSCYVSDDGASMLLFDTLSETAEFARRWVPFCKKFAVEPRAPEFYFSHKIDYLKDKVQPTFVKERRAMKREYEEFKVRINALVAKAQKKPEEGWVMQDGTPWPGNNTRDHPGMIQVYLGTQGALDVEGHELPRLVYVSREKRPGYNHHKKAGAMNALVRVSAVLTNAPFILNLDCDHYVNNSKAVREAMCFLMDPQLGKKLCYVQFPQRFDGIDRHDRYANRNVVFFDINMKGLDGIQGPVYVGTGCVFNRQALYGYDPPRPEKRPKMTCDCWPSWCCCCCCFGGGKRGKARKDKKGGADGGEEPRRGLLGFYRKRSKKDKLGGGGGSVAGSKKGGALYKKHQRAFELEEIEEGLEGYDELERSSLMSQKSFEKRFGQSPVFIASTLVEDGGLPQGAAADPAALIKEAIHVISCGYEEKTEWGKEIGWIYGSVTEDILTGFKMHCRGWKSVYCTPTRPAFKGSAPINLSDRLHQVLRWALGSVEIFMSRHCPLWYAYGGRLKWLERFAYTNTIVYPFTSIPLLAYCTIPAVCLLTGKFIIPTLNNLASIWFIALFLSIIATSVLELRWSGVSIEDWWRNEQFWVIGGVSAHLFAVFQGFLKVLGGVDTSFTVTSKAAGDEADAFGELYLFKWTTLLVPPTTLIIINMVGIVAGVSDAVNNGYGSWGPLFGKLFFSFWVIVHLYPFLKGLMGRQNRTPTIVVLWSILLASIFSLVWVRIDPFIPKAKGPILKPCGVEC

SEQ ID NO: 15142 - DNA, 996 bp, Sorghum bicolor
  misc_feature: Ceres ANNOT ID no. 8635238
  misc_feature: Down-regulated in shoot tissues in response to salicylic acid treatment
  misc_feature: Encodes the peptide sequence at SEQ ID NO 15143
atgcggcggtacgggtgcctcaccaacgactcctccgcggcggccgccgtgttcgtcccgttctacgccggcttcgagttcgcgcgccacgtctgggggtacgacgccgcggcgagggacgccgcctcgctggacctggtgcgctggctcgtgcggcggcccgagtggcgcagggccggcggccgcgaccacttcctggtggcggggcggacggggtgggacttccgccgtgacgtcgacgaccgcaactccacctggggcaccagtcttttcctgctcccggccgtcaagaacatgaccttcctcgtcgtggagacggccaccatgggctggggcaacgacctggccgtaccttaccctacctacttccacccgcgcacggactccgacgtcctgagctggcagcagaggatccggagctccgagcgctggtggttcatgtccttcgtgggcgcggcgcggccgagcgacccgcggtcgatccggtcgcaggtcatggcgcagtgcggcgcgtcgccggcgtgccggcagctcgggtgcgccttcgggagcgcgcagtgccactacccgggcgacatcatggtgctgttccagagctccaccttctgcctccagccgccgggggactcggcgtcgcggcgctcgacgttcgacgccatggtcgcgggctgcatcccggtcttcttccagccgcggtcggcgtacctccagtacaggtggcacctgccgagggaccacgccacgtactcggtgttcataccggcagaggacgtgcgctcggggaacgtgagcgtcgaggcggagctgaggaagataccgccggcagcgatagagaagatgagggaggaggtcatcaagctcgtgccaaggctggtctacgctgacccgagatacaagctggagacggtgaaggatgcgttcgacgtcgccgtggatggcgtcttagagagaatagcggaaacagaggagagcaaaacagggtcctactggcggtga

SEQ ID NO: 15143 - protein, 331 aa, Sorghum bicolor
  misc_feature: Useful for making plants with altered cell wall content and/or composition
  misc_feature: Functional homolog of the protein sequence given in SEQ ID NO 13965
  misc_feature: Ceres ANNOT ID no. 8635238
  misc_feature (1)..(284): Pfam ID: Exostosin Pfam Description: Exostosin family
MRRYGCLTNDSSAAAAVFVPFYAGFEFARHVWGYDAAARDAASLDLVRWLVRRPEWRRAGGRDHFLVAGRTGWDFRRDVDDRNSTWGTSLFLLPAVKNMTFLVVETATMGWGNDLAVPYPTYFHPRTDSDVLSWQQRIRSSERWWFMSFVGAARPSDPRSIRSQVMAQCGASPACRQLGCAFGSAQCHYPGDIMVLFQSSTFCLQPPGDSASRRSTFDAMVAGCIPVFFQPRSAYLQYRWHLPRDHATYSVFIPAEDVRSGNVSVEAELRKIPPAAIEKMREEVIKLVPRLVYADPRYKLETVKDAFDVAVDGVLERIAETEESKTGSYWR

SEQ ID NO: 15144 - DNA, 1488 bp, Sorghum bicolor
  misc_feature: Ceres ANNOT ID no. 8635239
  misc_feature: Encodes the peptide sequence at SEQ ID NO 15145
atgaagcggcacaacgcgggcgagttgccgctgtcgtcgccggcgggcgacggcaagcggctgctggcgaacgaggaggaggcggaggacaagatggacaagtacgacaaagggcggctcggcagccaccccttcgcccgtgcgctggcctcggccgccgacaaggacgacctctgcggcggtcagtacatctacgtgcacgagctgccggcccgcttcaacaaggacatggtccagaactgcgacaagctgtcgccgtggacggacatgtgcaggtacaccaccaacggcggcttcggcccgctgctccgcggcggcaagggcgcgttccagggcaacggcgccggctggtacgacaccgacgagcacgcgctggacatcgtcttccacgagcggatcaagcggtacgagtgcctcaccgacgacccttccctcgcggccgccgtcttcgtcccgttctacgccggcctcgacgtcgcgcggcacctctggggtaacaacgtctcggcgagggacgagatggcgctggacctggcgagcctgctggccaagagccccgagtggcgcgccatgggcggccgcgaccacttcttcgtcgccggccgcaccacgtgggacttccggcggaaggatgacgcccatgctgagtgggggagcaggctgctgaatctccccgccgccaagaacatgaccgcgctcgtcgtggaggccagcccgtggcacctcaacgacgtcgccattccctacccgacgtcgttccacccggcgagcgacgaggacctcttcttctggcaggacagggtgcgcgcgctgaaccgctcgtacctcttctccttcgccggcgtgccgcgccccggcgacgacaagtccatcgagggccacctcgtggaccagtgcaaggcgtcggactcctgctcgctcatggagtgcagcaccacgggtccggacaacaagtgcgagtcgccggccagcgtcatgaagctcttccagagctcgacgttctgcctcctgccgcgaggagccaccgacacgcgccgtcacgccttcgacgccatgctagccgggtgcatcccggtgttcttccaccccggctcggcgtacgtgcagtacgtctggcacctgctcaagacccacaccgactactcggtgtacatccccgaggatgacgtgcgcacgaagaacgagagcgtggaggagaagctccggaaaataccgccggaaacggtcggggcaatgagggacgccgtcgtcggcctcatcccgtcggtgacctacggcgacgcgacgtcgaggcttgagacgacggtgaaggatgcgtttgacatcgcggtggccgctgtcatcaacaaggtgacgaagctgaggaggggcatcgtggagggtcgagcggaggaggagaagatggagaggtatagctggaagtacccgttgttggcagaagggcagaaggcagaggaccatcatgaatgggaccccctgttcaattag

SEQ ID NO: 15145 - protein, 495 aa, Sorghum bicolor
  misc_feature: Useful for making plants with altered cell wall content and/or composition
  misc_feature: Functional homolog of the protein sequence given in SEQ ID NO 13965
  misc_feature: Ceres ANNOT ID no. 8635239
  misc_feature (64)..(416): Pfam ID: Exostosin Pfam Description: Exostosin family
MKRHNAGELPLSSPAGDGKRLLANEEEAEDKMDKYDKGRLGSHPFARALASAADKDDLCGGQYIYVHELPARFNKDMVQNCDKLSPWTDMCRYTTNGGFGPLLRGGKGAFQGNGAGWYDTDEHALDIVFHERIKRYECLTDDPSLAAAVFVPFYAGLDVARHLWGNNVSARDEMALDLASLLAKSPEWRAMGGRDHFFVAGRTTWDFRRKDDAHAEWGSRLLNLPAAKNMTALVVEASPWHLNDVAIPYPTSFHPASDEDLFFWQDRVRALNRSYLFSFAGVPRPGDDKSIEGHLVDQCKASDSCSLMECSTTGPDNKCESPASVMKLFQSSTFCLLPRGATDTRRHAFDAMLAGCIPVFFHPGSAYVQYVWHLLKTHTDYSVYIPEDDVRTKNESVEEKLRKIPPETVGAMRDAVVGLIPSVTYGDATSRLETTVKDAFDIAVAAVINKVTKLRRGIVEGRAEEEKMERYSWKYPLLAEGQKAEDHHEWDPLFN

SEQ ID NO: 15146 - DNA, 654 bp, Sorghum bicolor
  misc_feature: Ceres ANNOT ID no. 8635292
  misc_feature: Encodes the peptide sequence at SEQ ID NO 15147
atggggtcgccgggtgcggggagcagcggcggcggcggccacgagtgctccttcaagatcctcctcatcggggactcgggcgtcggcaagagcagcctcctcgtcagcttcgtcgccgcctccaacctcgacgccgacatcgcccccaccatcggtgtggattttaaaatcaagttccttacagttggtggaaagaaactaaagttgacaatatgggatactgctggccaggagaggtttaggacaattactagttcttactacagaggtgctcagggaattattctagtatatgatgtcacaaagagagaaagtttctcaaatttgtctgatgtttggactaaggaaatagaagcaaactcaacaaacaaagactgcataaaaatgcttgttggaaacaaagttgacaaggatgatgaaaggatggtcacaaaagaagaaggtcttgcttttgctgaagaatctggatgtctgtttctcgagagcagtgcaaaaacacgagaaaatgttgagcaatgttttgaagaacttgcattgaagattcttgaggtccctagtctcctggaggaagggtcgtcttcggttgtcaagaggaacatcctgaaacagaagcaggagagtcatgcaaagaacagtagtggatgctgtcaatag

SEQ ID NO: 15147 - protein, 217 aa, Sorghum bicolor
  misc_feature: Useful for making plants with altered lignin content
  misc_feature: Functional homolog of the protein sequence given in SEQ ID NO 13058
  misc_feature: Ceres ANNOT ID no. 8635292
  misc_feature (19)..(141): SWISSPROT Homolog: EC 2.7.11.1 Non-specific serine/threonine protein kinase
  misc_feature (19)..(183): Pfam ID: Ras Pfam Description: Ras family
  misc_feature (19)..(136): Pfam ID: Miro Pfam Description: Miro-like protein
MGSPGAGSSGGGGHECSFKILLIGDSGVGKSSLLVSFVAASNLDADIAPTIGVDFKIKFLTVGGKKLKLTIWDTAGQERFRTITSSYYRGAQGIILVYDVTKRESFSNLSDVWTKEIEANSTNKDCIKMLVGNKVDKDDERMVTKEEGLAFAEESGCLFLESSAKTRENVEQCFEELALKILEVPSLLEEGSSSVVKRNILKQKQESHAKNSSGCCQ

SEQ ID NO: 15148 - DNA, 1404 bp, Sorghum bicolor
  misc_feature: Ceres ANNOT ID no. 8635287
  misc_feature: Encodes the peptide sequence at SEQ ID NO 15149
atggcccggccccccaaaaccaccgggattgccttctccccccccctggggggaaccgccgccgccccctcggaactccttttcctcaaatccacgctccccgaacccgccgccgttgtcgaggccggcggggccagcggcggcggcgggtgcctgacgggcaacccaatcgacgactgctggcggtgctctgggacggactggcggcaggaccggcagcggcttgcggactgcggcatcgggttcgggcgcaacgcgctgggcggcaagggcggtccggtgtacgtggtgacggactcgtcggacggcgaccccgtgaacccggtccccggcacgctccggcacgccgccatccaggaaggcccgctgtggatcgtgttcgcgtcggacatggccatccgcctgaacgaggagctgctggtgaacagctacaagaccatcgacgggcggggcgcgcgcgtgcacatcggcggcggcggcgcgtgcatcacgctgcagtacgtgtccaacgtgatcatccacaacgtgcacgtccacgactgcgtccccgccggcaacgccaacgtgcggtcctcgccgacgcactacgggtggcgcaccaggtcggacggcgacggcatctcgctgttcggggcacgggacgtgtgggtggaccactgcgcgctgtggcggtgcgccgacgggctggtggacgccatcatggggtcgacggccatcaccgtgtccaacagctacttcgcgcaccacgacgaggtgatgctgctgggcgccagcgacgcgtacctgccggactccgggatgcaggtcaccatcgcgttcaaccggttcggccccgggctggtgcagcggatgccgcgatgccggcgagggtacttccacatcgtcaacaacgactacacgtcgtgggagatgtacgccatcggcggcagcgcaaaccccaccatcaacagccagggcaaccgctacatcgcgcccggcgacccaaacgccaaggaggtgacgaagcgggtggacacggcggagggtcagtggaacgggtggaactggcggacggagggcgacatgatggtgaacggcgccttcttcgtgccgtccggagagggcctggaggagatctacgacaaggcgtccagcaccgacccaaagtcgtcggcgctcgtcgacgtgctcacgcagaacgccggcgtcctcggcgatcccaggaacgatgccgaagaaaccgggtacaggggtgtcaactacgccggcgtgggaactggcggcggtggcggcaacggctacggctacctcgggatggtctatgccaacggtggcggcgatcggagaagcagatcacagtcggcgctgtcattgatttcttcagttaccaccctcattgcgctcggatgcttgcgcttgttgtaa

SEQ ID NO: 15149 - protein, 467 aa, Sorghum bicolor
  misc_feature: Useful for making plants with altered carbohydrate content
  misc_feature: Functional homolog of the protein sequence given in SEQ ID NO 13668
  misc_feature: Useful for making plants with altered cell wall content and/or composition
  misc_feature: Functional homolog of the protein sequence given in SEQ ID NO 14147
  misc_feature: Useful for making plants with modulated phosphate use efficiency
  misc_feature: Functional homolog of the protein sequence given in SEQ ID NO 13129
  misc_feature: Ceres ANNOT ID no. 8635287
  misc_feature (51)..(397): SWISSPROT Homolog: EC 4.2.2.2 Pectate lyase
  misc_feature (136)..(322): Pfam ID: Pec_lyase_C Pfam Description: Pectate lyase
MARPPKTTGIAFSPPLGGTAAAPSELLFLKSTLPEPAAVVEAGGASGGGGCLTGNPIDDCWRCSGTDWRQDRQRLADCGIGFGRNALGGKGGPVYVVTDSSDGDPVNPVPGTLRHAAIQEGPLWIVFASDMAIRLNEELLVNSYKTIDGRGARVHIGGGGACITLQYVSNVIIHNVHVHDCVPAGNANVRSSPTHYGWRTRSDGDGISLFGARDVWVDHCALWRCADGLVDAIMGSTAITVSNSYFAHHDEVMLLGASDAYLPDSGMQVTIAFNRFGPGLVQRMPRCRRGYFHIVNNDYTSWEMYAIGGSANPTINSQGNRYIAPGDPNAKEVTKRVDTAEGQWNGWNWRTEGDMMVNGAFFVPSGEGLEEIYDKASSTDPKSSALVDVLTQNAGVLGDPRNDAEETGYRGVNYAGVGTGGGGGNGYGYLGMVYANGGGDRRSRSQSALSLISSVTTLIALGCLRLL

SEQ ID NO: 15150 - DNA, 1914 bp, Sorghum bicolor
  misc_feature: Ceres ANNOT ID no. 8635303
  misc_feature: Encodes the peptide sequence at SEQ ID NO 15151
atgctggggcgggcggcggcactgtccgcgcggcggtggcgcggcggtgtgccggacctgcgcgccgcgctgcggtcggggggcaacctcctgttcgcgctcttcgtggcggccgtgctcgcattcacgctcctcgcggcggtccacagccccgacgatccgctcctccacccgtcctcgcaccagctcaccgatttcctcacctcctccacatccacctccaccttcctcaccgacgactccgtgctgcgcaccggggaggacttcaactcctcgtccactggcgccgccggcgaggccgccgctgggggtgtcgaagtcgttgcggaggccgtcccgttcatcaagctctccgaggttggcgccgaggccgagaagacggagcccgagacggagcgggccgtcaccgtcgacactgatgccgccacgggcgaaggtgcggcggtggcggaggaaaccgccgttgcggaggcggtttcctgcgacacggaggcgcccgtggactgcacgggggacagggaactcttcaacctgctcatgcgcgcggccatcgagcgcttccccgacctccacttctaccgcttcggccgtcccgtggccgtgccggggagtcccatggagtgtgacctcgcctggcgcttccgccccgctgccgacgccatcggcaccggccggaccacatactacaaggactaccgacggttcacgctcacccgcgacatcaacacctgcaccctcgtcgtcgacaccgtgggtgagtaccactcgggtgtgggtgccaagcgcaacggacggcgcaaggggaagaaagggaagaaggggaagcaggatgcgccagtgacggactttgtgccggctaagacacagattaggctggatgagaacactgccaacaatgaggctgctggggctgcagcggagccggtgtttgttgttggtgaagctgtcaatgacagcttgccagtggttgcttctgagtccgatttcagccgtggaaagtacctcatttacattggtggtggcgagaggtgcaagagcatgaaccacttcatttgggggttcttgtgtgcgctcggtgaggcacagttcttgaaccggactcttgtcatggacttgaatgtctgcctcaatgcacggtatacttcgagtggcaaggatgaagatagagatttcaggctctactttgactttgagcatttgaagcaatcggcgtctgtgatcgaccaaagccagttctggcaagattggggaaagtggcacaagaaagataggctcaagaacttttacactgaagacatcaggatgaccccaatgaaacttcgtgacatcaaggacacactgatcatgaggaagtttgggaatgttgagcctgataactattggtcacgtgtgtgtgagggtgagactgagggagtaatcaagcgcccttggcatttcctgtggaaatctcgtcgcttgatggagattgtatctgccattgcctcacggatgaactgggacttcgactcggtccatgttgtcagaggggagaaagcgcagaacacacgactttggccaaaccttgatagagatacctcgccagacagtattcttgcgtcacttaatgataaggttggtgctggccggtatttgtacattgctaccaatgagcctgacaaatcgttctttgacccacttaaggaaaagtataaaacacacttcctcgatgatttcaagtacctgtgggatgagaatagtgagtggttcactgaaactaaggagctgagcaatggtaagccagtagaatttgatggttacatgaggattgcagttgacacggaggtattcttgagggggaagaggcacgtggagacgttcaacgagcttacacgtgattgcaaggacggcgtgaatacatgcccagcttcttcctga

SEQ ID NO: 15151 - protein, 637 aa, Sorghum bicolor
  misc_feature: Useful for making plants with modulated light quality sensitivity
  misc_feature: Functional homolog of the protein sequence given in SEQ ID NO 14148
  misc_feature: Ceres ANNOT ID no. 8635303
  misc_feature: Down-regulated in root tissues in response to salicylic acid treatment
  misc_feature: Down-regulated in shoot tissues in response to salicylic acid treatment
MLGRAAALSARRWRGGVPDLRAALRSGGNLLFALFVAAVLAFTLLAAVHSPDDPLLHPSSHQLTDFLTSSTSTSTFLTDDSVLRTGEDFNSSSTGAAGEAAAGGVEVVAEAVPFIKLSEVGAEAEKTEPETERAVTVDTDAATGEGAAVAEETAVAEAVSCDTEAPVDCTGDRELFNLLMRAAIERFPDLHFYRFGRPVAVPGSPMECDLAWRFRPAADAIGTGRTTYYKDYRRFTLTRDINTCTLVVDTVGEYHSGVGAKRNGRRKGKKGKKGKQDAPVTDFVPAKTQIRLDENTANNEAAGAAAEPVFVVGEAVNDSLPVVASESDFSRGKYLIYIGGGERCKSMNHFIWGFLCALGEAQFLNRTLVMDLNVCLNARYTSSGKDEDRDFRLYFDFEHLKQSASVIDQSQFWQDWGKWHKKDRLKNFYTEDIRMTPMKLRDIKDTLIMRKFGNVEPDNYWSRVCEGETEGVIKRPWHFLWKSRRLMEIVSAIASRMNWDFDSVHVVRGEKAQNTRLWPNLDRDTSPDSILASLNDKVGAGRYLYIATNEPDKSFFDPLKEKYKTHFLDDFKYLWDENSEWFTETKELSNGKPVEFDGYMRIAVDTEVFLRGKRHVETFNELTRDCKDGVNTCPASS

SEQ ID NO: 15152 - DNA, 171 bp, Sorghum bicolor
  misc_feature: Ceres ANNOT ID no. 8635360
  misc_feature: Down-regulated in root tissues in response to salicylic acid treatment
  misc_feature: Down-regulated in shoot tissues in response to salicylic acid treatment
  misc_feature: Encodes the peptide sequence at SEQ ID NO 15153
atgaataacattcaaggagccacaaaagtggtgggaggatatattcgagtggactcagtgctagtttttgctctgtttgactcgagtgcttcgcattcttttatttccgccaacttggtaaagacgatcgagagagtgaagtgtccaaccaggaagcctttgttagtttga

SEQ ID NO: 15153 - protein, 56 aa, Sorghum bicolor
  misc_feature: The sequence is a functional homolog of SEQ ID NO 1457 in the 10/374,780 US patent application
  misc_feature: Ceres ANNOT ID no. 8635360
MNNIQGATKVVGGYIRVDSVLVFALFDSSASHSFISANLVKTIERVKCPTRKPLLV

SEQ ID NO: 15154 - DNA, 417 bp, Sorghum bicolor
  misc_feature: Ceres ANNOT ID no. 8635463
  misc_feature: Encodes the peptide sequence at SEQ ID NO 15155
atggagggcggcaaggacgccgccggtggtggcggcaccaagtaccgcggcgtccggaagcgtccatggggcaagtttgccgccgagatccgcgacccggagcgcggtggggctagggtctggctcggcacgttcgacacggccgaggaggccgcgcgggcgtacgaccgggcggcgttcgcccagcgtggcgccaccgccgtgctcaacttccccggcgagatcgctggggctaccaggaggggcgccggagggtcgtcgtcgtcgtcgtctgctgctgctgctgctgcccccgccgccgcctcgttgagggcgacggggaggggccgcggggacggggagaagatcgagctggagtgcctggacgacaagatccttgaggacctcctagacgatggcaagtacggccgtaagtga

SEQ ID NO: 15155 - protein, 138 aa, Sorghum bicolor
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: Useful for making plants with altered lignin content
  misc_feature: Functional homolog of the protein sequence given in SEQ ID NO 13219
  misc_feature: Ceres ANNOT ID no. 8635463
  misc_feature (13)..(65): Pfam ID: AP2 Pfam Description: AP2 domain
MEGGKDAAGGGGTKYRGVRKRPWGKFAAEIRDPERGGARVWLGTFDTAEEAARAYDRAAFAQRGATAVLNFPGEIAGATRRGAGGSSSSSSAAAAAAPAAASLRATGRGRGDGEKIELECLDDKILEDLLDDGKYGRK

SEQ ID NO: 15156 - DNA, 981 bp, Sorghum bicolor
  misc_feature: Ceres ANNOT ID no. 8635570
  misc_feature: Encodes the peptide sequence at SEQ ID NO 15157
atggagaactcttactgccgttgggtgcttgtatgttcggttcttgcgctgtgcctcggtagccggggtgcgaggtgtgagctaacaccaaatttctaccacagcacttgccctcagctgtactatattgtgcggcatcatgtgttcgttgccatgagagctgagatgaggatgggtgcctccctcctcaggctacatttccatgactgctttgtcaatgggtgtgacggttcgatccttttggatggctccgatggcgagaagtttgcaagacccaacctgaactcagtcagagggtacgaggtcattgacgcgataaaggctgatctcgagcgcgtctgccccgaggtggtgtcatgcgctgacattgtagcccttgcagccagctatggagtactctttagtggagggccttactacaatgttcttctggggagaaaggacgggctggtggccaatcagtctggagctgacaacggtttgccttcgccgttcgaacccattgatttgattattcagaagttcgacgatgtgggcctgaacacgaccgacgtcgtggtcttatcaggagcccacactatcgggcgagcccggtgcgcgctgttcagcaaccggctgtccaacttctcgaccacggagtcagttgacccgacgctggaggccagcctcgccgacagcctcgagagcctctgcgcaggcggcgacggcaaccagacctctgcgctcgacgtcacgtccccctacgtgttcgacaacaactactacaagaacctcctgacggagaagggcctcctgtcctccgatcagggtctcttctccagccctgaaggcgtcgccaacacaaaggatttggtggagacctacagcagtaatagcgaacagttcttctgtgacttcgtctggtccatgatcaagatggggaacatcccgctcacggccaacgacggggagatccgcaagaactgcagagtagcgaactaa

SEQ ID NO: 15157 - protein, 326 aa, Sorghum bicolor
  misc_feature: Useful for making plants with altered cell wall content and/or composition
  misc_feature: Functional homolog of the protein sequence given in SEQ ID NO 14149
  misc_feature: Useful for making plants with altered carbohydrate content
  misc_feature: Functional homolog of the protein sequence given in SEQ ID NO 13713
  misc_feature: Useful for making plants with modulated light quality response
  misc_feature: Functional homolog of the protein sequence given in SEQ ID NO 13816
  misc_feature: Ceres ANNOT ID no. 8635570
  misc_feature (10)..(326): SWISSPROT Homolog: EC 1.11.1.7 Peroxidase
  misc_feature (44)..(291): Pfam ID: peroxidase Pfam Description: Peroxidase
MENSYCRWVLVCSVLALCLGSRGARCELTPNFYHSTCPQLYYIVRHHVFVAMRAEMRMGASLLRLHFHDCFVNGCDGSILLDGSDGEKFARPNLNSVRGYEVIDAIKADLERVCPEVVSCADIVALAASYGVLFSGGPYYNVLLGRKDGLVANQSGADNGLPSPFEPIDLIIQKFDDVGLNTTDVVVLSGAHTIGRARCALFSNRLSNFSTTESVDPTLEASLADSLESLCAGGDGNQTSALDVTSPYVFDNNYYKNLLTEKGLLSSDQGLFSSPEGVANTKDLVETYSSNSEQFFCDFVWSMIKMGNIPLTANDGEIRKNCRVAN

SEQ ID NO: 15158 - DNA, 1326 bp, Sorghum bicolor
  misc_feature: Ceres ANNOT ID no. 8635594
  misc_feature: Encodes the peptide sequence at SEQ ID NO 15159
atgcactgcttccggttcgcgagctgggagcgggaggccgacgagcggcgcggggcggcggcggcgacgacgacgacgacgggccgttccctgtccgcgcggtccaacagcagcacgacgtcgacggaccgcgacgtgcggcggtcggcgtccgagtgctccctgaacgcgtcggagctcagcagcgcgggctccctgggccggtgccggcagctgtcgctgtcgtcgcagcggccggccaacgcgctgcgcgtcttcaacttccaggagctcaagtcggccacccgcgggttcagccgcgcgctcatgctcggcgagggcggcttcggctgcgtctaccggggcaccatccggagcgcgctggagccgcgccggagcctggacgtcgccatcaagcagctcggccgcaagggcctgcagggccacaaggagtggatgacggaggtgaacgtgctcggggtggtggaccacgccaacctcgtcaagctcatcggctactgcgccgaggacgacgagcgggggatgcagctgctgctcgtctacgagttcatgcccaacggcagcctcgcggaccatctctcctccaggtcgccgcggccggcgtcgtggtcgatgaggctcagggtggcgcttgacacagctcgaggcttgaagtatctccatgaagaatccgaagtcaagataatatttcgtgacctgaagccttcgaacattcttctcgacgacaactggaacgcaaaactgtcagattttggcttggcaagattaggacctcaagaaggaagccatgtctccacagcggtggtggggacaattggatatgcagctcctgaatacatccacacgggacgcctcagcaccaagaatgacatatggagtttcggcgtcgtgctccttgagcttcttacaggccggcgacctctggaccggaacaggccaagaggcgagcaaaatctcgtggactggatgaagccctactcttccggcgccaagaagctcgagactgtaattgatccaaggcttcaagggaactacagcataaaatcagctgcccagcttgcgtcagtggcaaataagtgcctggtgcgccatgccaggtaccgtcccaagatgagtgaggtactggagatggtgcagaagatcgtcgagagcagtgaaattggaacaccggagcatcccctgatcagcaattcaaaggaattagtgagtggtgaaaagaaacggaaaggccttgacttgaaaacaaggattgcagatattaaagctagggaggggagatggtttgcatggcaagggtgcacgcctaagcttgtgagaacacaatga

SEQ ID NO: 15159 - protein, 441 aa, Sorghum bicolor
  misc_feature: Useful for making plants with modulated drought sensitivity
  misc_feature: Functional homolog of the protein sequence given in SEQ ID NO 14078
  misc_feature: Ceres ANNOT ID no. 8635594
  misc_feature (83)..(381): SWISSPROT Homolog: EC 2.7.11.1 Non-specific serine/threonine protein kinase
  misc_feature (98)..(378): Pfam ID: Pkinase Pfam Description: Protein kinase domain
MHCFRFASWEREADERRGAAAATTTTTGRSLSARSNSSTTSTDRDVRRSASECSLNASELSSAGSLGRCRQLSLSSQRPANALRVFNFQELKSATRGFSRALMLGEGGFGCVYRGTIRSALEPRRSLDVAIKQLGRKGLQGHKEWMTEVNVLGVVDHANLVKLIGYCAEDDERGMQLLLVYEFMPNGSLADHLSSRSPRPASWSMRLRVALDTARGLKYLHEESEVKIIFRDLKPSNILLDDNWNAKLSDFGLARLGPQEGSHVSTAVVGTIGYAAPEYIHTGRLSTKNDIWSFGVVLLELLTGRRPLDRNRPRGEQNLVDWMKPYSSGAKKLETVIDPRLQGNYSIKSAAQLASVANKCLVRHARYRPKMSEVLEMVQKIVESSEIGTPEHPLISNSKELVSGEKKRKGLDLKTRIADIKAREGRWFAWQGCTPKLVRTQ

SEQ ID NO: 15160 - DNA, 762 bp, Sorghum bicolor
  misc_feature: Ceres ANNOT ID no. 8635700
  misc_feature: Encodes the peptide sequence at SEQ ID NO 15161
atggcgccgaggacgatgatgttggcgctgtggggtgttcttgcggcgtccaccgtcgtggccggtgtggcgggctggtcgccgggcacggcgaccttctatggcgggtccgacgggtccgggaccatgggcggcgcgtgcgggtacggcaacctgtacagcgccgggtacggcgttaacaacgcggcgctgagccagacgctgttcaacgacggcgcgtcgtgcgggcagtgctacaccatcacgtgcgacgggtcacgatcgggcagccagtactgcaagcccggcaacaccgtcaccgtcacggccaccaacctgtgcccacccaactacgggctccccaacggcgggtggtgcggcccgggacgcccgcacttcgacatgtcgcagccgtcatgggagaagatcggcgtcgtccagggcggcatcatcccggtgctgtaccagcaggtcaagtgctcgcggagcggcggcgtgcgcttcaacatcgccggctccagctacttcctgctcgtcaacatccagaacctgggcggcagcggctcagtgggagccgcttgggtcaagggcaccaacaccgggtggatccagatgtctaggaactggggcgctaattggcaggccctctcggggctcaccggccaggcgctcagcttcgccgtcactaccaccggcgggcagtacatacagttcctgaacgtggcgccgacgtggtggcagttcggacagacctactctaccaaccagcagttttactactga

SEQ ID NO: 15161 - protein, 253 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Useful for making plants with altered lignin content
  misc_feature: Functional homolog of the protein sequence given in SEQ ID NO 12888
  misc_feature: Ceres ANNOT ID no. 8635700
  misc_feature (13)..(119): SWISSPROT Homolog: EC 3.2.1.4 Cellulase
  misc_feature (61)..(148): Pfam ID: DPBB_1 Pfam Description: Rare lipoprotein A (RlpA)-like double-psi beta-barrel
  misc_feature (159)..(236): Pfam ID: Pollen_allerg_1 Pfam Description: Pollen allergen
MAPRTMMLALWGVLAASTVVAGVAGWSPGTATFYGGSDGSGTMGGACGYGNLYSAGYGVNNAALSQTLFNDGASCGQCYTITCDGSRSGSQYCKPGNTVTVTATNLCPPNYGLPNGGWCGPGRPHFDMSQPSWEKIGVVQGGIIPVLYQQVKCSRSGGVRFNIAGSSYFLLVNIQNLGGSGSVGAAWVKGTNTGWIQMSRNWGANWQALSGLTGQALSFAVTTTGGQYIQFLNVAPTWWQFGQTYSTNQQFYY

SEQ ID NO: 15162 - DNA, 756 bp, Sorghum bicolor
  misc_feature: Ceres ANNOT ID no. 8635699
  misc_feature: Encodes the peptide sequence at SEQ ID NO 15163
atgaaaatcaacaagtccctagttttgtgcctatccttctcggcgtgcctagccctcgccgccgcaggctggtctcccggcaccgccacgttctacggcggagccgacggctctggcaccatgggtggtgcgtgcgggtacgacaacctgtacaacgccgggtacggcgtgaacaatgcggcgctgagctcgacgctgttcaacgacggcgcgtcgtgcgggcagtgctacctcatcacctgcgacgcgtcgcgtccgggcgggcagtggtgcaagccgggcaactccatcacggtgtccgccaccaacctgtgcccggccaactacgcgctccccaacggcgggtggtgcggcccggggcgcccccacttcgacatgtcgcagccggcgtgggagcgcatcggcatctacagcgccggcgtcatcccggtcctgtaccagcaggtcaagtgctcgcgcaccggcggcgtgcgcttcggcatcgccggctcccagtatttcctgctcgtcaacatccagaacctcggaggcagtggctccgtgggcgccgcctgggtgaagggcgacaggacggggtggatccagatgtccaggaactggggcgccaactggcaggcgctcgccgggctcgtcggccaggggctcagcttcgccgttaccactaccggcgggcagtacattcagttctggaacgtggtgcctaggtggtggcagttcggacagacctacaccacaacccagaatttctactactaa

SEQ ID NO: 15163 - protein, 251 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Useful for making plants with altered lignin content
  misc_feature: Functional homolog of the protein sequence given in SEQ ID NO 12888
  misc_feature: Ceres ANNOT ID no. 8635699
  misc_feature (54)..(117): SWISSPROT Homolog: EC 3.2.1.4 Cellulase
  misc_feature (59)..(146): Pfam ID: DPBB_1 Pfam Description: Rare lipoprotein A (RlpA)-like double-psi beta-barrel
  misc_feature (157)..(234): Pfam ID: Pollen_allerg_1 Pfam Description: Pollen allergen
MKINKSLVLCLSFSACLALAAAGWSPGTATFYGGADGSGTMGGACGYDNLYNAGYGVNNAALSSTLFNDGASCGQCYLITCDASRPGGQWCKPGNSITVSATNLCPANYALPNGGWCGPGRPHFDMSQPAWERIGIYSAGVIPVLYQQVKCSRTGGVRFGIAGSQYFLLVNIQNLGGSGSVGAAWVKGDRTGWIQMSRNWGANWQALAGLVGQGLSFAVTTTGGQYIQFWNVVPRWWQFGQTYTTTQNFYY

SEQ ID NO: 15164 - DNA, 774 bp, Sorghum bicolor
  misc_feature: Ceres ANNOT ID no. 8635689
  misc_feature: Encodes the peptide sequence at SEQ ID NO 15165
atgggcaccacggtggcgcagctcaagcccttggccgtggtcgtcgtcgtccttgcgctgctggtcgcggcggcaagggcggactactggaactggaacagtgggacggcgacgttctacggcggcgccgacggctccggcaccatgggtggcgcgtgcggctacgacaacctgtacaacgcgggctatggagtgctcaacgccgcgctgagccaggtgctgttcaacgacggcgcctcctgtggccagtgctacgccatcaagtgtgacgccaccaagtccgtgtggtgcaagcccggcaacaccgtcaccgtcaccgccaccaacctgtgcccacccaactacgcgctccccaacggcggctggtgcggcccgccgcgcccccacttcgacatgtcccagccagcgtgggagaacatcggcatctaccgcggcggcatcatccccgtcgtctaccaacgggtgcgatgctcgaggcagggaggcgtgaggttcagaatcaccgggtcccagtacttccagctgattctcatcaccaatgtcggcggcagtggatccatccagtccatgtccgtgaaggggaccaacaccgggtggattggcatgacgcggaactggggcgcgcaatggcagagcaactcggcgctccttaagcaggcgctctccttcatggtcacctccaccggcggccagacgctgtacgtcaacaacgtcgtgccggcgtggtgggtgctgggcatgaccttcgccaccaacgcgcagtttgactattag

SEQ ID NO: 15165 - protein, 257 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Useful for making plants with altered lignin content
  misc_feature: Functional homolog of the protein sequence given in SEQ ID NO 12888
  misc_feature: Ceres ANNOT ID no. 8635689
  misc_feature (67)..(152): Pfam ID: DPBB_1 Pfam Description: Rare lipoprotein A (RlpA)-like double-psi beta-barrel
  misc_feature (163)..(240): Pfam ID: Pollen_allerg_1 Pfam Description: Pollen allergen
MGTTVAQLKPLAVVVVVLALLVAAARADYWNWNSGTATFYGGADGSGTMGGACGYDNLYNAGYGVLNAALSQVLFNDGASCGQCYAIKCDATKSVWCKPGNTVTVTATNLCPPNYALPNGGWCGPPRPHFDMSQPAWENIGIYRGGIIPVVYQRVRCSRQGGVRFRITGSQYFQLILITNVGGSGSIQSMSVKGTNTGWIGMTRNWGAQWQSNSALLKQALSFMVTSTGGQTLYVNNVVPAWWVLGMTFATNAQFDY

SEQ ID NO: 15166 - DNA, 762 bp, Sorghum bicolor
  misc_feature: Ceres ANNOT ID no. 8635690
  misc_feature: Encodes the peptide sequence at SEQ ID NO 15167
atggatacgtcgtccagatccctgataatcctgtgcacagtccttgcagcgtgccttaggctcgccgccgctggctggtctcagggcaccgcgacgttctacggcgatgccgacggatccggcaccatgggtggcgcgtgcgggtacggcaacctgtacaacgccgggtacggcatcaacaacgcggcgctgagccagacgctgttcaacaacggcgcgtcgtgcgggcagtgctacctgatcacgtgcgacaggtcacggtccggcgggcagtggtgcaagccgggcagctccatcacggtgtcggccaccaacctgtgcccgcccaactacgggctccccaacggcgggtggtgcggcccgggccgcccgcacttcgacatgtcgcagccggcgtgggagcacatcggcgtcgtgcaggccggcatcatccccgtcctgtaccagcaggtcaggtgcacccgcaccggcggcgtgcgcttcagcatcgccggctcccagtatttcctgctcgtcaacatccagaacgtcggcggcagcggcgccgtgggcgccgcctgggtgaagggcgacaagaccgggtggatccagatgtccaggaactggggggctaactggcaggcgctgtcgggactcgtcggccaagggctcagcttcgccgtcaccaccaccggcgggcagtacctgcagttcatgtacgtcgtgccggggtggtggcagttcggcatgaccttcggcaccaacagaaatttcgcctactaa

SEQ ID NO: 15167 - protein, 253 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8635690
  misc_feature (14)..(119): SWISSPROT Homolog: EC 3.2.1.4 Cellulase
  misc_feature (61)..(148): Pfam ID: DPBB_1 Pfam Description: Rare lipoprotein A (RlpA)-like double-psi beta-barrel
  misc_feature (159)..(236): Pfam ID: Pollen_allerg_1 Pfam Description: Pollen allergen
MDTSSRSLIILCTVLAACLRLAAAGWSQGTATFYGDADGSGTMGGACGYGNLYNAGYGINNAALSQTLFNNGASCGQCYLITCDRSRSGGQWCKPGSSITVSATNLCPPNYGLPNGGWCGPGRPHFDMSQPAWEHIGVVQAGIIPVLYQQVRCTRTGGVRFSIAGSQYFLLVNIQNVGGSGAVGAAWVKGDKTGWIQMSRNWGANWQALSGLVGQGLSFAVTTTGGQYLQFMYVVPGWWQFGMTFGTNRNFAY

SEQ ID NO: 15168 - DNA, 771 bp, Sorghum bicolor
  misc_feature: Ceres ANNOT ID no. 8635685
  misc_feature: Encodes the peptide sequence at SEQ ID NO 15169
atggagacacccaaacctctggccgtcgtgttcctcgcggtggtcgcgctggctgccgcgccgccggccgtcgacgcctggtccaggggcaccgccacgttctacggcggcggcgacgcctcgggcacaatgggcggggcgtgcgggtacggcaacctgtacgcgacgggctacgggcagtacacggcggccctgagccaggtcctgtacaacgacggcgcgtcgtgcgggcagtgctaccagatctcgtgcgacccgcagacggacgcgcggtggtgccggcagggcgccggccccgtcacggtctcggccaccaacctgtgcccgcccaactacgcctactccggcagcaacggcggctggtgcaacccgccgcgggcgcacttcgacatgtcccagccggcgtggctcaagatcggcatctaccagggcggcatcatcccggtgctgtaccagcgcgtgccctgcgtgaagcagggcggcgtgcgcttcaccatcaccgggttcaaccactacgagctggtgctcatctccaacgtcgccggcagcggctcggtggccagcgcctgggtccagggcgccaacaccaaccgggtgcccatgagcaggaactggggcgccaactggcagtcgctggccgggatcgccggccaggcgctcaccttcggcgtcacgtccacaggcggacagagcatcgtcttcccgtacgtcgtgccgcagaactgggtgttcggcatgtcattcaccagcaacttgcagttctcctactaa

SEQ ID NO: 15169 - protein, 256 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Useful for making plants with altered lignin content
  misc_feature: Functional homolog of the protein sequence given in SEQ ID NO 12888
  misc_feature: Ceres ANNOT ID no. 8635685
  misc_feature (57)..(122): SWISSPROT Homolog: EC 3.2.1.4 Cellulase
  misc_feature (62)..(151): Pfam ID: DPBB_1 Pfam Description: Rare lipoprotein A (RlpA)-like double-psi beta-barrel
  misc_feature (162)..(239): Pfam ID: Pollen_allerg_1 Pfam Description: Pollen allergen
METPKPLAVVFLAVVALAAAPPAVDAWSRGTATFYGGGDASGTMGGACGYGNLYATGYGQYTAALSQVLYNDGASCGQCYQISCDPQTDARWCRQGAGPVTVSATNLCPPNYAYSGSNGGWCNPPRAHFDMSQPAWLKIGIYQGGIIPVLYQRVPCVKQGGVRFTITGFNHYELVLISNVAGSGSVASAWVQGANTNRVPMSRNWGANWQSLAGIAGQALTFGVTSTGGQSIVFPYVVPQNWVFGMSFTSNLQFSY

SEQ ID NO: 15170 - DNA, 750 bp, Sorghum bicolor
  misc_feature: Ceres ANNOT ID no. 8635696
  misc_feature: Encodes the peptide sequence at SEQ ID NO 15171
atggccaagtccctgacgttgctcacagcgctcgcggcgtgcctcgcgcttgccgccgccgactggtctcagggcaccgccacgttctacggtggacccgacggctccggcacgatgggaggcgcatgcggctacgagaacctatacaacgccgggtacggcgtgaacaacgcagcgctgagcccggtgctgttcaacgacggcgcgtcgtgcgggcagtgctacgtcatcatctgcgacgcatcccgtccgggcgggcagtactgcaagcccggcacctggatcaccgtgacggccacgaacctatgcccatccaactacgcgctgcccaacggcgggtggtgcggcccggggcggcctcacttcgacatgtcgcagccggcgtgggagaagatcggcatctacagcggcggcatcatcccggtgcagtaccagcaggtcaagtgctggcgcaacggcggcgtgcgcttcagcatcgccggcaactattacttcctgctcgtcaatatccagaacctcgccggcagcggctctgtggccgccgcctgggtcaagggcgataagacggggtggatccagatgtccaggaactggggcgccaactggcaggcgcacgccgggctcgtcggccaggggcttagcttcgccgtgacaagcacaggagggcactacatccagttcctcaacgtcgtgcccggatggtggcagttcggcatgaccttcaacacaaaccagaatttttactactaa

SEQ ID NO: 15171 - protein, 249 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 13785
  misc_feature: Useful for making plants with altered lignin content
  misc_feature: Functional homolog of the protein sequence given in SEQ ID NO 12888
  misc_feature: Ceres ANNOT ID no. 8635696
  misc_feature (26)..(115): SWISSPROT Homolog: EC 3.2.1.4 Cellulase
  misc_feature (57)..(144): Pfam ID: DPBB_1 Pfam Description: Rare lipoprotein A (RlpA)-like double-psi beta-barrel
  misc_feature (155)..(232): Pfam ID: Pollen_allerg_1 Pfam Description: Pollen allergen
MAKSLTLLTALAACLALAAADWSQGTATFYGGPDGSGTMGGACGYENLYNAGYGVNNAALSPVLFNDGASCGQCYVIICDASRPGGQYCKPGTWITVTATNLCPSNYALPNGGWCGPGRPHFDMSQPAWEKIGIYSGGIIPVQYQQVKCWRNGGVRFSIAGNYYFLLVNIQNLAGSGSVAAAWVKGDKTGWIQMSRNWGANWQAHAGLVGQGLSFAVTSTGGHYIQFLNVVPGWWQFGMTFNTNQNFYY

SEQ ID NO: 15172 - DNA, 1281 bp, Sorghum bicolor
  misc_feature: Ceres ANNOT ID no. 8635744
  misc_feature: Encodes the peptide sequence at SEQ ID NO 15173
atgggtctgagcagcatccggcgtgaggtgctggtctccgccgtcttcacggcgctcctcgtggcgtccatcctcctcctcccttcgctcctcctcacgggcagcaccggcccggccaggaggtggccgtcgttcctgtccccgtccacggccgccgaagacaaggagcagcaggcgcggtacccagtgaggttcgcgtacctgatctcggcgtcgacgggggacgcgccccgcgcggcgcgcctgctggcggcgctgtaccacccggccaacacctacctgcttcacctggaccgggaggcccccgcggaggagcaccggcggctggcggagctggtgtccggtcccgggcgcggcggcgtgtacgcgcgcgctggcaacgtgtggatcgtcggcaggcccaacctggtcacctaccgtggccccaccatgctgaccaccacgctgcacgccgtcgccgttctcctccgcctccgccgccgctgggactggttcatcaacctcagcgcctccgactacccgctcgtcacccaggacgatttgatggaggcgttcgcggggctgcccagggacctcaacttcatccagcacacgagccacctgggctggaagataaagaagcgggcgcggccggtgatcctggacacggcgctgtacgaggacgggagggcggagctcatccgcccggtgaacatcaccaccaacctcaggaggctgcccacggccttcaagctctacacagggtcggcgtggacgatgctgtcgcggtcgttcgcggagtacgtgacgatggggtgggacaaccttccccgggcgcttctcctctaccacgccaacatcgtctcgtcgccggagttctacttccagacggtggcgtgcaactcgcggcggttccgcaacgccacggtgaacagcgacctgcacttcatccgctgggacaacccgcccaagcagcacccgctctacctcacgtccagggactaccgccggatgctcctcagcggcgccgccttcgcgcgcaagttcagggagggagacccggtgctggaccggatcgacagggacatcctgcgccgccgggaacccggacacttcgcctacggcggctggtgctccgacgacggcgagcgcggcggcgccggagccggagcgctctgctccaacccgcaggagcatggtaggcgcggggccgttaaggccggcgccggatccaggcggctcaaggcgatgctgaccaagatgctgtcgccaaggaatttcaggaggcagcagtgtaggtga

SEQ ID NO: 15173 - protein, 426 aa, Sorghum bicolor
  misc_feature: Useful for making plants with altered carbohydrate content
  misc_feature: Functional homolog of the protein sequence given in SEQ ID NO 14022
  misc_feature: Ceres ANNOT ID no. 8635744
  misc_feature (162)..(313): SWISSPROT Homolog: EC 2.4.2.26 Protein xylosyltransferase
  misc_feature (65)..(297): Pfam ID: Branch Pfam Description: Core-2/I-Branching enzyme
MGLSSIRREVLVSAVFTALLVASILLLPSLLLTGSTGPARRWPSFLSPSTAAEDKEQQARYPVRFAYLISASTGDAPRAARLLAALYHPANTYLLHLDREAPAEEHRRLAELVSGPGRGGVYARAGNVWIVGRPNLVTYRGPTMLTTTLHAVAVLLRLRRRWDWFINLSASDYPLVTQDDLMEAFAGLPRDLNFIQHTSHLGWKIKKRARPVILDTALYEDGRAELIRPVNITTNLRRLPTAFKLYTGSAWTMLSRSFAEYVTMGWDNLPRALLLYHANIVSSPEFYFQTVACNSRRFRNATVNSDLHFIRWDNPPKQHPLYLTSRDYRRMLLSGAAFARKFREGDPVLDRIDRDILRRREPGHFAYGGWCSDDGERGGAGAGALCSNPQEHGRRGAVKAGAGSRRLKAMLTKMLSPRNFRRQQCR

SEQ ID NO: 15174 - DNA, 753 bp, Sorghum bicolor
  misc_feature: Ceres ANNOT ID no. 8635698
  misc_feature: Encodes the peptide sequence at SEQ ID NO 15175
atggccaattcctttatgctgtgcacggtggttgttgcgtcgtgcctcgccgtcgccgccgccggctggtctcaaggcactgccactttctacggcggagtcgacgcgtccggcacgatgggcggcgcatgcgggtacgacaacctgtacaacgcggggtacggcgtgaacaacgcggcgctgggcccgaccttgttcaacgacggcgcgtcgtgtgggcagtgctacctcatcacctgcgacacgtcacggagcggcgggcagtggtgcaagccgggcaactccatcacggtgtccgccaccaacctgtgcccgtccaactacgcgctgcccaacggcgggtggtgcggcccggggcgcccccacttcgacatgtcgcagccggcgtgggagcacatcggcatctacagcgccggcgtcgtcccggtcctgtaccagcaggtcaagtgctcgcgcaccggcggcgtgcgcttcagcctcgccggctcccagtatttcctgctcgtcaacatccagaacctcggcggcagtggctctgtgggcgctgcgtgggtgaagggtgacaagacggggtggatccagatgtccaggaactggggcgccaactggcaggcgctcgccgggctcgtcggccaggggctcagcttcgccgttaccactaccggcgggcagtacattcagttctggaacgtggtgcctgggtggtggcagttcggacagacctactccacaacccagaatttctactactaa

SEQ ID NO: 15175 - protein, 250 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8635698
  misc_feature (27)..(116): SWISSPROT Homolog: EC 3.2.1.4 Cellulase
  misc_feature (58)..(145): Pfam ID: DPBB_1 Pfam Description: Rare lipoprotein A (RlpA)-like double-psi beta-barrel
  misc_feature (156)..(233): Pfam ID: Pollen_allerg_1 Pfam Description: Pollen allergen
MANSFMLCTVVVASCLAVAAAGWSQGTATFYGGVDASGTMGGACGYDNLYNAGYGVNNAALGPTLFNDGASCGQCYLITCDTSRSGGQWCKPGNSITVSATNLCPSNYALPNGGWCGPGRPHFDMSQPAWEHIGIYSAGVVPVLYQQVKCSRTGGVRFSLAGSQYFLLVNIQNLGGSGSVGAAWVKGDKTGWIQMSRNWGANWQALAGLVGQGLSFAVTTTGGQYIQFWNVVPGWWQFGQTYSTTQNFYY

SEQ ID NO: 15176 - DNA, 1290 bp, Sorghum bicolor
  misc_feature: Ceres ANNOT ID no. 8635754
  misc_feature: Encodes the peptide sequence at SEQ ID NO 15177
atggggaactgcttggggggcagccccgcctacgtcaacaaggtctcctccactgcaaagccagaggagactcttcctaaggtccagagcccgtcggaagtggaccggagcgacgaccgcaagctgccctcgaaccccggcgaggtggaggccctgcggcggggcgcgtcggcggcggcgcggaacccgctggtggccttctccttctccgagctcaggaaggtggccaacgacttccgcaaggaggcgctcatcggcggcggcgggttcggccgtgtctacaagggttccttcgcgccgccagccgccaccaccaccaccaccaccctgccggtggccatcaaggtgcacgacggcgacaacagcttccagggccaccgcgagtggctggcggaggtgatcttcctgggccagctgtcgcacccgaacctggtgaagctggtgggctactgctgcgagggcgaccaccgcgtgctggtgtacgagtacatggcgctgggcagcgtggagtcgcacctcttctcccgaacgtcgccgccgctcccctggtcgacgcggatgaagatcgcgctgggcgccgcccggggcctcgcgttcctccacgacgccgagccacgccccgtgatctaccgcgacttcaagacctccaacatcctgctcgacgccgacttcaacgccaagctctccgacttcggcctcgccaaggacgggcccgtcggggagcagtcgcacgtgtccacgcgcgtcatgggcacctacggctacgccctacggcgtcgtcctgctcgagctgctcacgggccggcggtcgctggaccggtcgcgcccgccgagggagcaggcgctcaccgactgggcgctcccggcgctgccgcacaagaagcgcgtgcagggcatcgtggacccaaggctggcgggcggcgccggcgggtgggacgacccgccgcccgcaagggccgtgcagaagacggccatgctcgcgtaccactgcctcaaccgcaaccccaaggcgcggccgctcatgcgcgacgtcgtcgcgtcgctggagccgctacagcagccacccgaggaccctgcagacgcgcacgccgccgtgtgagtgttctgtccagaggctttgtcgatcggagagccaatgcgaggtggtgctggccggatgcagcaggaacgccgccggccggtcggggctgtccttgtcctgtccggctgtccgtggaacgaacgaagcagggcaacgccatcatcgatgatgtgactgatagattggtcggtagtacagtagcttattag

SEQ ID NO: 15177 - protein, 429 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8635754
  misc_feature (1)..(256): SWISSPROT Homolog: EC 2.7.11.1 Non-specific serine/threonine protein kinase
  misc_feature (79)..(347): Pfam ID: Pkinase_Tyr Pfam Description: Protein tyrosine kinase
MGNCLGGSPAYVNKVSSTAKPEETLPKVQSPSEVDRSDDRKLPSNPGEVEALRRGASAAARNPLVAFSFSELRKVANDFRKEALIGGGGFGRVYKGSFAPPAATTTTTTLPVAIKVHDGDNSFQGHREWLAEVIFLGQLSHPNLVKLVGYCCEGDHRVLVYEYMALGSVESHLFSRTSPPLPWSTRMKIALGAARGLAFLHDAEPRPVIYRDFKTSNILLDADFNAKLSDFGLAKDGPVGEQSHVSTRVMGTYGYALRRRPARAAHGPAVAGPVAPAEGAGAHRLGAPGAAAQEARAGHRGPKAGGRRRRVGRPAARKGRAEDGHARVPLPQPQPQGAAAHARRRRVAGAATAATRGPCRRARRRVSVLSRGFVDRRANARWCWPDAAGTPPAGRGCPCPVRLSVERTKQGNAIIDDVTDRLVGSTVAY

SEQ ID NO: 15178 - DNA, 1089 bp, Sorghum bicolor
  misc_feature: Ceres ANNOT ID no. 8635820
  misc_feature: Encodes the peptide sequence at SEQ ID NO 15179
atggacccttcggtggcgccgggcattgtcaaggaggagctcctggagcagcagcagccgctgcaggacggtgtgggtgacggcgggggtgcgccgcgcccgatggaggggctgcacgaggtgggtcccccgccgttcctcaccaagacgttcgacctggtggaggacccggccaccgacgccgtcgtctcctggagccgtgccggcaacagcttcgtcgtctgggacccgcacgtcttcgccgacacgatgctcccacgcctcttcaagcacagcaacttctccagcttcgtgcgccagctcaacacctatggcttcagaaaggttgatcctgacaggtgggagtttgcaaatgaaggttttctcaggggtcaaaggcacctgcttaagatgataaagagaaggaagccaccatcagctgtgccaccattgcgacagcagcaggcccctgcttcttgcctggaggttggtgagtttggatttgaggaagagattgataggctgaagcgtgacaagaacattttgatcacagaagtagtaaagctaaggcaggagcagcaaactactaaagatcatgtgagggccatggaggaaaggctacgagtggctgaacagaagcaggttcagatgatggggttcttggcaagagcaatgcggaatccagagtttttccagcagttggtccagcagcaagacaagagaaaggagctcgaggatgctatttcaaagaaaagaaggcggcccattgacaacactccgttctacagtactggggaaacaagtcagggcgagcagcttgattcacagtttatgttcgagtcagatgtgctcaatgggctcagtgaacctggaatgcctgagctggagaatttagcagtgaacattcaggagcttgggaagggaagcatagatggcgagaaggtggctcaagctagtgaccagtcagagctgaatgatgacttctgggcagagctgttggtcgaagatttcggagacaaggcaggacagtcagagttggagggaagaactgaagacgtggatgaccttgctcaacaactggggtatctgagtaattctagcccaaagtag

SEQ ID NO: 15179 - protein, 362 aa, Sorghum bicolor
  misc_feature: The sequence is a functional homolog of SEQ ID NO 1685 in the 10/412,699 US patent application
  misc_feature: The sequence is a functional homolog of SEQ ID NO 1687 in the 10/412,699 US patent application
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: The sequence is a functional homolog of SEQ ID NO 1688 in the 10/412,699 US patent application
  misc_feature: The sequence is a functional homolog of SEQ ID NO 1686 in the 10/412,699 US patent application
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: Useful for making plants with modulated biomass
  misc_feature: Useful for making plants with modulated heat sensitivity
  misc_feature: Functional homolog of the protein sequence given in SEQ ID NO 13700
  misc_feature: The sequence is a functional homolog of SEQ ID NO 1418 in the 10/666,642 US patent application
  misc_feature: The sequence is a functional homolog of SEQ ID NO 142 in the 10/666,642 US patent application
  misc_feature: The sequence is a functional homolog of SEQ ID NO 200 in the 10/225,068 US patent application
  misc_feature: The sequence is a functional homolog of SEQ ID NO 2428 in the 10/374,780 US patent application
  misc_feature: The sequence is a functional homolog of SEQ ID NO 942 in the 11/435,388 US patent application
  misc_feature: The sequence is a functional homolog of SEQ ID NO 2203 in the 10/666,642 US patent application
  misc_feature: The sequence is a functional homolog of SEQ ID NO 2205 in the 10/666,642 US patent application
  misc_feature: The sequence is a functional homolog of SEQ ID NO 2207 in the 10/666,642 US patent application
  misc_feature: The sequence is a functional homolog of SEQ ID NO 422 in the 10/666,642 US patent application
  misc_feature: The sequence is a functional homolog of SEQ ID NO 816 in the 11/435,388 US patent application
  misc_feature: Ceres ANNOT ID no. 8635820
  misc_feature (44)..(214): Pfam ID: HSF_DNA-bind Pfam Description: HSF-type DNA-binding
MDPSVAPGIVKEELLEQQQPLQDGVGDGGGAPRPMEGLHEVGPPPFLTKTFDLVEDPATDAVVSWSRAGNSFVVWDPHVFADTMLPRLFKHSNFSSFVRQLNTYGFRKVDPDRWEFANEGFLRGQRHLLKMIKRRKPPSAVPPLRQQQAPASCLEVGEFGFEEEIDRLKRDKNILITEVVKLRQEQQTTKDHVRAMEERLRVAEQKQVQMMGFLARAMRNPEFFQQLVQQQDKRKELEDAISKKRRRPIDNTPFYSTGETSQGEQLDSQFMFESDVLNGLSEPGMPELENLAVNIQELGKGSIDGEKVAQASDQSELNDDFWAELLVEDFGDKAGQSELEGRTEDVDDLAQQLGYLSNSSPK

SEQ ID NO: 15180 - DNA, 930 bp, Sorghum bicolor
  misc_feature: Ceres ANNOT ID no. 8635860
  misc_feature: Encodes the peptide sequence at SEQ ID NO 15181
atggggatctacgagcggcagcgccacctggtggctgccggcgtgtccgtgtggggggagccgttccggcccgacgccgacgccctgcccctgtccgcggtcgtccccacggtcaccctggtgacgacgccggcgccgccgcttgacgtcgtcgaagcagaggaggtcaagttcggcaaacaccagctggcacagcagtacgacgtcccgccgcaggtggaagaagaagcggcgccggcgccgccgccgccgtcgtcggatagcttcggccacgaccacgaccacgacgccgcccgaccaagagacaagattcagagacgcctcgcgcagaacagagaggccgctcggaagagccggctccggaagaaggcgtacatccagaatctggagacgagccggatgaagctggcgcagctggagcaggagctcaccatggccaggcgccagcagcagcacggcgcgtacggtgttggagaaggaggagtcgcggcggcgacggcggccgtggacccgcgggtggccgcgttcgagctggattacacgcgatgggtggaggagcaggggaggcaggcgacggagctgcgggcggcgctacagtcgcacgcgccggaggtgcagctgcgggtgctcgtcgacgccgggctggcgcactacggcgcgctgttccaggccaaggcgcaggcggcgcagtccgacgccttcttcgtgctgtcgggggtgtggcgggcccccgcggagcgcttcttcctctggatcggcgggttccgccccttcgagctgctcaaggtgctggcgccgcggctagacccgctcatggaccaccaggcggccgaggtgcgcaagctgatcctgacgcggcggcaggcggcgcggggcctgctcgcgctcgcggactacggccagcggctgcgcgcgctcagctcgctctga

SEQ ID NO: 15181 - protein, 309 aa, Sorghum bicolor
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
  misc_feature: The sequence is a functional homolog of SEQ ID NO 1798 in the 10/412,699 US patent application
  misc_feature: The sequence is a functional homolog of SEQ ID NO 2044 in the 10/374,780 US patent application
  misc_feature: The sequence is a functional homolog of SEQ ID NO 408 in the 10/412,699 US patent application
  misc_feature: The sequence is a functional homolog of SEQ ID NO 48 in the 10/286,264 US patent application
  misc_feature: The sequence is a functional homolog of SEQ ID NO 938 in the 11/435,388 US patent application
  misc_feature: The sequence is a functional homolog of SEQ ID NO 957 in the 11/479,226 US patent application
  misc_feature: Useful for making plants with altered lignin content
  misc_feature: Functional homolog of the protein sequence given in SEQ ID NO 13093
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
  misc_feature: The sequence is a functional homolog of SEQ ID NO 1493 in the 10/374,780 US patent application
  misc_feature: The sequence is a functional homolog of SEQ ID NO 1563 in the 10/412,699 US patent application
  misc_feature: Useful for making plants with modulated biomass
  misc_feature: Useful for making plants with modulated flowering time
  misc_feature: Functional homolog of the protein sequence given in SEQ ID NO 13559
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: Ceres ANNOT ID no. 8635860
  misc_feature (99)..(152): Pfam ID: bZIP_1 Pfam Description: bZIP transcription factor
MGIYERQRHLVAAGVSVWGEPFRPDADALPLSAVVPTVTLVTTPAPPLDVVEAEEVKFGKHQLAQQYDVPPQVEEEAAPAPPPPSSDSFGHDHDHDAARPRDKIQRRLAQNREAARKSRLRKKAYIQNLETSRMKLAQLEQELTMARRQQQHGAYGVGEGGVAAATAAVDPRVAAFELDYTRWVEEQGRQATELRAALQSHAPEVQLRVLVDAGLAHYGALFQAKAQAAQSDAFFVLSGVWRAPAERFFLWIGGFRPFELLKVLAPRLDPLMDHQAAEVRKLILTRRQAARGLLALADYGQRLRALSSL

SEQ ID NO: 15182 - DNA, 1494 bp, Sorghum bicolor
  misc_feature: Ceres ANNOT ID no. 8636062
  misc_feature: Encodes the peptide sequence at SEQ ID NO 15183
atgagccgccgcgtcgtcatccagctgctcgtcctccttgccgtcgtcgtctttctggccccgccgctgtcgtcgaagatgccgggcagcagcctcctgaaggagatggagaatctggtgggtctgagccccgcggcggtggcggttgcgtgctgggcggcggcggcggcggcgtgggcgtacgcggtgtcccgcccgcggccggtgtacctggtggacctgtccgggtacgtggccggcgcggcgcacgaggcgtcccgcgccaagacgatcgcgcacttcgggcggtgcgggcggttcagcgacgagagcatggcgttccagaagcggatgctggagcggtcggggctcggcgagcggacgcacttcccggcgtcgctcatcagcgtgcccgtcgacatgtgcctccgcacggcgcgggaggagtcgcacgccgtcatcttcggcgtcgtcgacgacctcctccgcagggccgcggtggcgcccgccgaggtcggcgtgctcatcttcaactccagcctgctcagcccgacgccgtccttcacctcgctcatcgtcaaccgctacgggatgcgccacgacgtcgtcagccacaacctcagcgggatggggtgcagcgcgggcatcatcgccatcgacctcgccaagcgactgctccaggtgcaccgggacacgtacgcgctggtggtgagcacggagaacatcaccctcaacgcgtacatgggcaacaaccggccgatgctggtgaccaacacgctcttccgcgtgggcggcgccgccatcctgctctccaaccgcggcgccgaccgccgccgcgccaagtaccagctcatccacacggtgcgcacccaccggggcgcgcacgaccagagcttcggctgcgtgacgcaggaggaggacgacgtcggctgcgtcggcgtctccctctccaaggagctcatggtggtcgccggcgaggccctgcgcaccaacatcaccacgctgggccccctcgtcctgcccatgtccgagcagctccggttcctcgccaccgtcgtcctcaaccgcgtcttccgcgccaacgtccgcgcctacctcccggacttcaagctcgccttcgaccacttctgcatccacgccggcggccgcggcgtgctggacgagctggagcgcagcctcaagctcagcgcatggcacatggagccctccaggatgacgctctgccgcttcggcaacacatccagcagctcgctgtggtacgagctcgcatactgcgaggccaagggacggatcaggaagggggacagggtgtggcagatcgcgttcgggtccggattcaagtgcaacagcgccgtctggaaggcgctccggacggtcgacggcggcgaggagggaaacccgtggacgccggagatggacgtgctcccgatccacgtccccaaggtgtcgccaatcgacgagaccacctacacgttccctgacggcgcaacctacaaggtctcatctcttggttaa

SEQ ID NO: 15183 - protein, 497 aa, Sorghum bicolor
  misc_feature: The sequence is a functional homolog of SEQ ID NO 2 in US patent 7038112
  misc_feature: Ceres ANNOT ID no. 8636062
  misc_feature (64)..(478): SWISSPROT Homolog: EC 2.3.1.119 Icosanoyl-CoA synthase
  misc_feature (61)..(350): Pfam ID: FAE1_CUT1_RppA Pfam Description: FAE1/Type III polyketide synthase-like protein
  misc_feature (364)..(448): Pfam ID: ACP_syn_III_C Pfam Description: 3-Oxoacyl-[acyl-carrier-protein (ACP)] synthase III C terminal
MSRRVVIQLLVLLAVVVFLAPPLSSKMPGSSLLKEMENLVGLSPAAVAVACWAAAAAAWAYAVSRPRPVYLVDLSGYVAGAAHEASRAKTIAHFGRCGRFSDESMAFQKRMLERSGLGERTHFPASLISVPVDMCLRTAREESHAVIFGVVDDLLRRAAVAPAEVGVLIFNSSLLSPTPSFTSLIVNRYGMRHDVVSHNLSGMGCSAGIIAIDLAKRLLQVHRDTYALVVSTENITLNAYMGNNRPMLVTNTLFRVGGAAILLSNRGADRRRAKYQLIHTVRTHRGAHDQSFGCVTQEEDDVGCVGVSLSKELMVVAGEALRTNITTLGPLVLPMSEQLRFLATVVLNRVFRANVRAYLPDFKLAFDHFCIHAGGRGVLDELERSLKLSAWHMEPSRMTLCRFGNTSSSSLWYELAYCEAKGRIRKGDRVWQIAFGSGFKCNSAVWKALRTVDGGEEGNPWTPEMDVLPIHVPKVSPIDETTYTFPDGATYKVSSLG

SEQ ID NO: 15184 - DNA, 2571 bp, Sorghum bicolor
  misc_feature: Ceres ANNOT ID no. 8636116
  misc_feature: Encodes the peptide sequence at SEQ ID NO 15185
atgcagctcctcttgccggccgcatcaccaccctcgtcaccttccttccctcctcgcgtcgtcctcaaagcaggtccatcccgtatcagtatccatggcaaagcaggtgctggtgctggagggggaggtgcgggcgcgacggggccccgcggcaacctcaggctcggcgggctcgccgggtggtggagacggcagcagcagcatccgcaggccccgtcccctgccccggcgacgacaacgcagcagtccgacaacgtatccagtgctaaagtgttccagaccacccgtgtcgaaaccgagactgaaattacgaaatggccagggaaaccacaagatcttgatgagtaccaagtgatccctgaggctgatgagacagagttgcagccacttatcgatcaagtgagggcgatgctaagatcaatgaacgacggggacatcagcatctcggcgtatgatacggcgtgggtggcgctggtgccgaagctggacggcggcgggggctcccagcccgagttcccggccaccgtgcgttggatcgtcgaccaccagctgcctgacggctcctggggcgacccggccttgttctctgcctatgaccgtatgatcaacacccttgcctgcgtcgttgcactcacgaaatggtctctcgagcctgaaaaatgcaaggcagggctctcgtttctccacgagaacatgtggaggctagccgaggaagagcaggagtcgatgcccatcggcttcgagatcgcgttcccttctctcattcagacagctaggaacttgggtgttgagtttccgtatgatcacccggctttgcagagcatatactccaacagggaaatcaagctgaagaggatcccaaaggacatgatgcatagagttcctacgtccattctgcatagccttgaaggaatgcctgatctggactgggcaaggcttctgaatctccaatcaagtgatggatcattcttgtattctccttcagctactgcatatgcacttatgcaaactggtgacaagaagtgcttcgaatatatcgataggattgtcaaaaaattcgatggaggagtccccaatgtttatccggttgatctttttgagcacatctgggtcgtcgatcgattagagagactcgggatctcccgctatttccaacgagagattatgcaatgcatggactatgtgaacaggcactggactgaagatgggatttgctgggctaggaactctaatgtaaaagatgtggatgacacagctatggctttccgactactaaggctacatggatacaatgtctccccaagtgtgtttaagaattttgagaaagatggagagttcttttgttttgtgggacaatcaactcaagccgtcactgggatgtacaatctcaacagagcctctcagatagcttttcaaggggaggatgtattgcaccgtgctaggattttctcatatgagtttctcagacaaagagaagcccaaggcatgctccgtgacaaatggatcattgcgaaggatctagctggcgaggtacaatatacactagactttccttggtatgcaagcttgcctcgtgtcgaggcaagaacctatctagatcagtatggaggtaaagatgatgtttggattggaaagaccctctacaggatgcctcttgtgaataacgacatatatcttgatttggcaataatggatttcaaccgttgccaagctgtacatcagcttgagtgtaatgagtggtacatagagaattgccttgacacttttggagtgcaaccgcaagatgttttaagagcttattttttagctgcatcttgcatttatgaacctagccgtgctgctgagcggcttgcatgggctagaacatcaatgattgccaatgccatttctacacatcttaatgacatttcggcagacaagaagagattagaatgtttcgtccactgtctctatgaagaaagtgatgtatcatggcttaaaataaatcctaatgatgctattctcgagagggcacttcgaagacttattaacttattgacgcaagaagcattgccaattcatgaaggacaaaggttcatccatagtctactaagtcttgcgtggaccgaatggatgctgcaaaaggcaaataaggaagaaaacaaatatcacaaatccagtggtataaaaccacaatacatgattcatgacacacaaacatatttgcttttagtccaggttattgagatttgtgctggacgaattagtgaggctatatcagtgataaacaacaaggatagtgattggtttattcaactcacatgcaatacttgtgatggtcttaaccacaaggtgttactgtcccaggatgctgagaagaatgaagcaacaataaattgcattgacaaggaaatcgagttgaacatgcaagaacttgctcaatctctgctcctgaggtctgatgagaaaaccaccaataagaagaccaaacaaactttatgggatgtcctaagaagttcatactatgttactcattgtccacaacatatcatcgatagacatgtttctagggttatctttgagccagtttaa

SEQ ID NO: 15185 - protein, 856 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 14150
  misc_feature: Ceres ANNOT ID no. 8636116
  misc_feature (103)..(843): SWISSPROT Homolog: EC 5.5.1.13 Ent-copalyl diphosphate synthase
  misc_feature (310)..(540): Pfam ID: Terpene_synth Pfam Description: Terpene synthase, N-terminal domain
  misc_feature (557)..(819): Pfam ID: Terpene_synth_C Pfam Description: Terpene synthase family, metal binding domain
MQLLLPAASPPSSPSFPPRVVLKAGPSRISIHGKAGAGAGGGGAGATGPRGNLRLGGLAGWWRRQQQHPQAPSPAPATTTQQSDNVSSAKVFQTTRVETETEITKWPGKPQDLDEYQVIPEADETELQPLIDQVRAMLRSMNDGDISISAYDTAWVALVPKLDGGGGSQPEFPATVRWIVDHQLPDGSWGDPALFSAYDRMINTLACVVALTKWSLEPEKCKAGLSFLHENMWRLAEEEQESMPIGFEIAFPSLIQTARNLGVEFPYDHPALQSIYSNREIKLKRIPKDMMHRVPTSILHSLEGMPDLDWARLLNLQSSDGSFLYSPSATAYALMQTGDKKCFEYIDRIVKKFDGGVPNVYPVDLFEHIWVVDRLERLGISRYFQREIMQCMDYVNRHWTEDGICWARNSNVKDVDDTAMAFRLLRLHGYNVSPSVFKNFEKDGEFFCFVGQSTQAVTGMYNLNRASQIAFQGEDVLHRARIFSYEFLRQREAQGMLRDKWIIAKDLAGEVQYTLDFPWYASLPRVEARTYLDQYGGKDDVWIGKTLYRMPLVNNDIYLDLAIMDFNRCQAVHQLECNEWYIENCLDTFGVQPQDVLRAYFLAASCIYEPSRAAERLAWARTSMIANAISTHLNDISADKKRLECFVHCLYEESDVSWLKINPNDAILERALRRLINLLTQEALPIHEGQRFIHSLLSLAWTEWMLQKANKEENKYHKSSGIKPQYMIHDTQTYLLLVQVIEICAGRISEAISVINNKDSDWFIQLTCNTCDGLNHKVLLSQDAEKNEATINCIDKEIELNMQELAQSLLLRSDEKTTNKKTKQTLWDVLRSSYYVTHCPQHIIDRHVSRVIFEPV

SEQ ID NO: 15186 - DNA, 948 bp, Sorghum bicolor
  misc_feature: Ceres ANNOT ID no. 8636188
  misc_feature: Encodes the peptide sequence at SEQ ID NO 15187
atggagggcctcgcgggttcgcgtggcggcggggggtgcggtggtcttgacgcgcagatcgagcagctcatggagtgccgcccgctcgcagagacggaggttaaaacactgtgtgagaaggccaaggagatattaatggaggaaagcaatgttcagccagttaaaagccctgtgacaatttgtggtgatattcatggccaattccatgatcttgtagaacttttccggattggtgggaagtgtccagatacgaattatttgtttatgggtgattatgtggatcgtggctattactctgttgagacagtaacgcttttggttgcacttaaggtgcggtacccacaacgcatcacaattcttcgtggaaaccatgagagtaggcagatcacacaggtgtatggcttctatgatgaatgcctacgaaaatatggcagtgcaaatgtctggaagatcttcactgatctttttgattattttccgttgacagcattggtggaatcagaaattttctgcctccatggcggtttatctccatccatagagaatcttgatagtgttcgtagtttagatcgtgtccaagaggtccctcatgagggacctatgtgtgaccttctatggtctgatccagacgatcgatgtggctggggcatatctcctcggggcgctggatacacttttggccaagacatatcggaacagtttaatcacaccaacaatcttaaacttgtagctcgggctcaccagttggttatggagggatacaactgggcacatgaacaaaaggtggtgaccatattcagcgcacctaattactgttaccggtgtggcaacatggcatccatcctcgaggttgatgattgcaggaatcacacatttattcagtttgagccagctcctaggagaggtgaaccagatgtgacacggaggacacctgattatttcctttga

SEQ ID NO: 15187 - protein, 315 aa, Sorghum bicolor
  misc_feature: The sequence is a functional homolog of SEQ ID NO 13 in US patent 7271316
  misc_feature: Ceres ANNOT ID no. 8636188
  misc_feature (16)..(315): SWISSPROT Homolog: EC 3.1.3.16 Phosphoprotein phosphatase
  misc_feature (56)..(251): Pfam ID: Metallophos Pfam Description: Calcineurin-like phosphoesterase
MEGLAGSRGGGGCGGLDAQIEQLMECRPLAETEVKTLCEKAKEILMEESNVQPVKSPVTICGDIHGQFHDLVELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 15188 - DNA, 1560 bp, Sorghum bicolor
  misc_feature: Ceres ANNOT ID no. 8636233
  misc_feature: Encodes the peptide sequence at SEQ ID NO 15189
atggatgcgggcaccgctcgacagttggagacgatcaaggtgatgagtgtcgtagcggtgtcgagtgtacccctgtgtttggagaagttgagtgcgtacctcgacgagaaacgtgttgcggttggcaagcttggtgtcgatggtcagcagcagcaagcaaagccgggagcttgtgtttgtttggatcggagtgagaagaagatgatggcggagtgccaaggaggaggaggaggggatttcctcatcaagctcttcgggaagaccatccccgtgccggagtccggcgacgccaaggagaacccgcacccggactcctccgacccgtccccgcagccggaggtcgtggacgcagaggaccccaagagctcaccggagacgacacaccagaagcccggccagggcaacggcagcggcgacgctgccagccagagggagaagctgaagaagcccgacaaggtgctgccatgcccgcgctgcaacagcatggacaccaagttctgctacttcaacaactacaacgtcaaccagccgcgccacttctgcaagaactgccagcgctactggaccgccggcggcgccatgcgcaacgttcccgtcggggccggtcgccgcaagaacaagaacgccgtcgccgcctcgcacttcctccacagggtcggggcggcctgcggcggcggcggcgacacgctcaagacgaccaacggcacggtgctcagcttcggcggccatggtggcggctgcgtgcctcctggtcctgcatgcttggacctcgtcgagcagctcagccaccacctggcggccccggtgatcaggaacgccggcaacaacccgggtccttgcagcgaaggatcgagcaactgcagggacgacaacaagaccatcaacgacaggtcttgtgtagacgaagccgcagcagcaaacggagacgacggatcagtgcagcacccagcaagcatgaacaacggcggcgcaaccgtgtggccgccgccgtacagctgcgcgccatctccggcggcgtatttctcctcgggcatcgcgatcccgatatacccagccgcaccaggttactggggctgcatggttcccggagcttggagcctgccatggccggtgcaacagcccccgtcgtcgcagtcgcaggggccggcggcgggcctctcgtcgtcgacgtcgcccaccaccaccagtgctccttcggtctcatcatccggggcagccgactcccacacgctggggctgggcaagcacccccgggaccgggaggagggtgacgacgggagaaacgccaaggtgtgggctcccaagaccatccggatagacgacgtggacgaggtggccaggagctccatctggtcgctcatcgggatcaaaggcgacaaggcgaagcagcaggacgacgatgctgctggtgggcacaagcagaagcagcttgttgggatggtgttcgagcccaagcgcgaggccaccaagaagccggcggccatgatgacaagctcgccgctcctgcacgccaaccccgtcgcgctcacgcgctccgtggccttccaggagggctcttga

SEQ ID NO: 15189 - protein, 519 aa, Sorghum bicolor
  misc_feature: The sequence is a functional homolog of SEQ ID NO 1132 in the 10/374,780 US patent application
  misc_feature: The sequence is a functional homolog of SEQ ID NO 1331 in the 10/412,699 US patent application
  misc_feature: Useful for biocontainment applications
  misc_feature: Useful for making plants with modulated biomass
  misc_feature: Useful for making plants with modulated flowering time
  misc_feature: Useful for making plants with modulated light quality response
  misc_feature: Functional homolog of the protein sequence given in SEQ ID NO 13821
  misc_feature: The sequence is a functional homolog of SEQ ID NO 1122 in the 10/374,780 US patent application
  misc_feature: The sequence is a functional homolog of SEQ ID NO 1145 in the 10/666,642 US patent application
  misc_feature: The sequence is a functional homolog of SEQ ID NO 1322 in the 10/412,699 US patent application
  misc_feature: Ceres ANNOT ID no. 8636233
  misc_feature (149)..(211): Pfam ID: zf-Dof Pfam Description: Dof domain, zinc finger
MDAGTARQLETIKVMSVVAVSSVPLCLEKLSAYLDEKRVAVGKLGVDGQQQQAKPGACVCLDRSEKKMMAECQGGGGGDFLIKLFGKTIPVPESGDAKENPHPDSSDPSPQPEVVDAEDPKSSPETTHQKPGQGNGSGDAASQREKLKKPDKVLPCPRCNSMDTKFCYFNNYNVNQPRHFCKNCQRYWTAGGAMRNVPVGAGRRKNKNAVAASHFLHRVGAACGGGGDTLKTTNGTVLSFGGHGGGCVPPGPACLDLVEQLSHHLAAPVIRNAGNNPGPCSEGSSNCRDDNKTINDRSCVDEAAAANGDDGSVQHPASMNNGGATVWPPPYSCAPSPAAYFSSGIAIPIYPAAPGYWGCMVPGAWSLPWPVQQPPSSQSQGPAAGLSSSTSPTTTSAPSVSSSGAADSHTLGLGKHPRDREEGDDGRNAKVWAPKTIRIDDVDEVARSSIWSLIGIKGDKAKQQDDDAAGGHKQKQLVGMVFEPKREATKKPAAMMTSSPLLHANPVALTRSVAFQEGS

SEQ ID NO: 15190 - DNA, 1074 bp, Sorghum bicolor
  misc_feature: Ceres ANNOT ID no. 8636236
  misc_feature: Encodes the peptide sequence at SEQ ID NO 15191
atggcgagcggctttacattcatcgtcagctttaacagctttaccgccacgaccatagaggagaccttgctacaagactcatatttcgccttccagcaagctcggggaatgcatcggcaggagtgcaggaggcgtctgagcggccgcttgtcccgccacttctctaggatctccatccagccgcttcagacagacccagacctcctccatataaccctgctgttgcttcctatattactgtgcttcctgcatcctcgtcctggtgatcacacgcagatcaaatcctatccaaatttggtaaatgacaaaaaactcttgccaaatgcattttttgactgttattatgtagacctagaatttttgttggacttttgctacaattactgccgcaaaattcctgtacattgctcgttccatgcaaggaaattcattgtgatctttctctctagttgttggaccatggctgaagagaagagcgttccacggctgaacgagcggatcatgtccaccctctcaaagcgatcggttgctgcgcattcctggcatgaccttgagataggacctggagcccctgctgttttcaattgtgttgttgagatcacaaagggcagtaaagtgaaatatgaactagacaagaagactggaatgatcaaggttgacagggtgctatactcatcagtagtctatccacacaactatggtttcattccacgaacattgtgtgaagatggagatccaatggatgtgctggtgttgatgcaggaaccggtgatacctggttgttttcttcgggcgagagccatcggccttatgcccatgattgatcagggagagaaagatgataagataattgcagtttgtgttgatgatcctgaataccgtcacttaaccgatctcaaggagctttctccacatcgcctcaatgaaattcgtcgcttctttgaagactataagaagaacgagaacaaggaagttgctgtgaacgatttcttaccaccaactacttccctggaggccattcaacactcaatggacttgtacgctgaatacatcctacacagtttgaggcgctag

SEQ ID NO: 15191 - protein, 357 aa, Sorghum bicolor
  misc_feature: Useful for making plants with modulated nitrogen use efficiency
  misc_feature: Functional homolog of the protein sequence given in SEQ ID NO 13344
  misc_feature: Ceres ANNOT ID no. 8636236
  misc_feature (154)..(357): SWISSPROT Homolog: EC 3.6.1.1 Inorganic diphosphatase
  misc_feature (195)..(349): Pfam ID: Pyrophosphatase Pfam Description: Inorganic pyrophosphatase
MASGFTFIVSFNSFTATTIEETLLQDSYFAFQQARGMHRQECRRRLSGRLSRHFSRISIQPLQTDPDLLHITLLLLPILLCFLHPRPGDHTQIKSYPNLVNDKKLLPNAFFDCYYVDLEFLLDFCYNYCRKIPVHCSFHARKFIVIFLSSCWTMAEEKSVPRLNERIMSTLSKRSVAAHSWHDLEIGPGAPAVFNCVVEITKGSKVKYELDKKTGMIKVDRVLYSSVVYPHNYGFIPRTLCEDGDPMDVLVLMQEPVIPGCFLRARAIGLMPMIDQGEKDDKIIAVCVDDPEYRHLTDLKELSPHRLNEIRRFFEDYKKNENKEVAVNDFLPPTTSLEAIQHSMDLYAEYILHSLRR

SEQ ID NO: 15192 - DNA, 978 bp, Sorghum bicolor
  misc_feature: Ceres ANNOT ID no. 8636222
  misc_feature: Encodes the peptide sequence at SEQ ID NO 15193
atggcgcagcagcagcaggtggtgaggcgggttctgaaggtggcgccgccggggaagggcgacggggagtgctttcccacggtgcaggcggcggtcgacgcggtgccgctgggcaaccgggcgcgcgtcgtcatccgcctcgcgccgggggtctacagggagcccgtctacgtcgccaagaccaagaacttcatcaccatcgcgggggcctcgcccgaggccaccgtcgtgtcgtgggacaacaccgccacgcgcatcaagcactcacagtcatccagggttataggaacaggaacattcggctgtggtacgttcattgttgagggggaggatttcattgcagagaatattacgtttgagaattcagctccccagggctctgggcaggctgttgcactccgggtgaccgcagataggtgcgctttctacaactgcaggttccttggttggcaagacacattatacttacactatggaaaacagtacttaagagactgttacattgaaggccactgtgatttcatcttcggtaactctatcgcccttatggaacattgccatatccattgcaaagcagcaggatttattactgctcatagccggaagtccacatcagaatctactggctatgtattcttgaggtgtactattactggaaatggagatggtggatatatgttcctaggtcggccatgggggccctttggaagggttgtctttgcatacacttttatggatcgatgcattaagccttctgggtggcataactgggacaaatccgagaatgagcgaactgcttgcttttatgagtacaggtgctccgggccaggctcccagccgtcgaaccgggtgacctggtgtagacaattgctggatgttgaagcagagcagttccttgcacacacttttatcgatccagacgttgataggccatggctcctccagatgatggcaataagagtaccagcctcagcatag

SEQ ID NO: 15193 - protein, 325 aa, Sorghum bicolor
  misc_feature: Useful for making plants with altered cell wall content and/or composition
  misc_feature: Functional homolog of the protein sequence given in SEQ ID NO 14151
  misc_feature: Ceres ANNOT ID no. 8636222
  misc_feature (14)..(304): SWISSPROT Homolog: EC 3.1.1.11 Pectinesterase
  misc_feature (14)..(307): Pfam ID: Pectinesterase Pfam Description: Pectinesterase
MAQQQQVVRRVLKVAPPGKGDGECFPTVQAAVDAVPLGNRARVVIRLAPGVYREPVYVAKTKNFITIAGASPEATVVSWDNTATRIKHSQSSRVIGTGTFGCGTFIVEGEDFIAENITFENSAPQGSGQAVALRVTADRCAFYNCRFLGWQDTLYLHYGKQYLRDCYIEGHCDFIFGNSIALMEHCHIHCKAAGFITAHSRKSTSESTGYVFLRCTITGNGDGGYMFLGRPWGPFGRVVFAYTFMDRCIKPSGWHNWDKSENERTACFYEYRCSGPGSQPSNRVTWCRQLLDVEAEQFLAHTFIDPDVDRPWLLQMMAIRVPASA

SEQ ID NO: 15194 - DNA, 1569 bp, Sorghum bicolor
  misc_feature: Ceres ANNOT ID no. 8636227
  misc_feature: Encodes the peptide sequence at SEQ ID NO 15195
atggcggaagcctgggcggttgcggcgctcacggccgcagcgtgggcgctgcgggcggcggtgtgggcgtgcctcgccgcgtcggcgatgctcgtcgccgaggccgcgtacatgggcctcgccagcctcgtcgccgcgatgctgtggcgctggcgccgcctcgacgagaggtaccgatgggagcccatgcccatgcccgtgcccgggtccggcgccgggggccgcgacgacgtcgaggcggcggcggacttccccatggtgctcgtgcagatccccatgtacaacgagagggaggtgtacaagctatccattgctgcggcgtgtgccctcacatggccaccagaccgtattgtaatacaagtcttggatgattccactgatccgattattaaggaactagtggagcttgagtgccaggattgggcaaccaaaaaaattaacatcaagtatgaggttagagataacagaaagggatacaaagcaggtgcgctgaagaagggcatggaacatatatacgccaagcaatgtgacttcgttgctatctttgatgccgatttccaacctgaacctgacttccttttaaaaaccataccgtttcttgtgcataacccaaagattgcacttgtacaagcacgttgggagtttgtgaactatgatgtttgcctgatgacaaggatacagaagatgtctctggactatcatttcaaagttgagcaggaatcgggatcatttgtgtattcattttttggctttaatggtacagctggtgtgtggcgtgtatctgctattaatcagtctggaggatggaaagatcgcaccactgtagaagatatggacctggctgtacgggcaggcctcaagggatgggaattcttgtatgttggtgatattagggttaagagtgaactaccaagtaccttcaaagcctaccgtcatcaacaacataggtggacctgtggtgccgctaatctcttcaggaaaatggcttgggaaatcattacaaacaaggaggtgtcaatatggaagaaacaccatctgctatacagctttttctttgtccgaagggttattgctccccttgtgacattcttgttttattgtgttgtcatccctttgtctgccatggttcctggtgtcagcattcctttatgggggctggtctatattcccactgcaattacatgtatgaacgccataagaaatcctgggtctctccatctgatgcccttctggattctgttcgagaatgttatgtccatgcaccgcatgcgtgctgctgtaactggtttacttgagactgcacgtgcaaatgattgggtagtcactgagaaggtaggagatcttgtgaaggatgacctggatgttccactccttgaaccagtgaagccaacagaatgtgtcgagaggatttattttcctgagctcttgcttgcactactcctcctaatatgtgcttcatatgacttcgtacttggaagccacaaatactatctttacctatacctccaggcctttgcatatgttgtaatggggtttggtttcgttggaacaaaaactccatgttcatag

SEQ ID NO: 15195 - protein, 522 aa, Sorghum bicolor
  misc_feature: Useful for making plants with altered cell wall content and/or composition
  misc_feature: Functional homolog of the protein sequence given in SEQ ID NO 13963
  misc_feature: Useful for making plants with altered carbohydrate content
  misc_feature: Functional homolog of the protein sequence given in SEQ ID NO 13964
  misc_feature: Ceres ANNOT ID no. 8636227
  misc_feature (83)..(435): SWISSPROT Homolog: EC 2.4.1.12 Cellulose synthase (UDP-forming)
  misc_feature (88)..(263): Pfam ID: Glycos_transf_2 Pfam Description: Glycosyl transferase family 2
MAEAWAVAALTAAAWALRAAVWACLAASAMLVAEAAYMGLASLVAAMLWRWRRLDERYRWEPMPMPVPGSGAGGRDDVEAAADFPMVLVQIPMYNEREVYKLSIAAACALTWPPDRIVIQVLDDSTDPIIKELVELECQDWATKKINIKYEVRDNRKGYKAGALKKGMEHIYAKQCDFVAIFDADFQPEPDFLLKTIPFLVHNPKIALVQARWEFVNYDVCLMTRIQKMSLDYHFKVEQESGSFVYSFFGFNGTAGVWRVSAINQSGGWKDRTTVEDMDLAVRAGLKGWEFLYVGDIRVKSELPSTFKAYRHQQHRWTCGAANLFRKMAWEIITNKEVSIWKKHHLLYSFFFVRRVIAPLVTFLFYCVVIPLSAMVPGVSIPLWGLVYIPTAITCMNAIRNPGSLHLMPFWILFENVMSMHRMRAAVTGLLETARANDWVVTEKVGDLVKDDLDVPLLEPVKPTECVERIYFPELLLALLLLICASYDFVLGSHKYYLYLYLQAFAYVVMGFGFVGTKTPCS

SEQ ID NO: 15196 - DNA, 1080 bp, Sorghum bicolor
  misc_feature: Ceres ANNOT ID no. 8636364
  misc_feature: Encodes the peptide sequence at SEQ ID NO 15197
atggccaccaatggcatggccccctccttcttccccgccaacttcctcctccaaatgcagcagcccctccaccaccagcagcagcaggagcaccaccaccaccaccaccaacaccaccatgacgaccaccatctcctggctccccctcccccggcgctcgtcagccccttcctccacgacttcggcggcgccatggccgcgccgccgccaatgctggccggcggcctcggcatgggcggcgacgacagccacctgcacgcggcggagccccagcagcagcaggacggcggaggcgtcgcgtcggacgacgaggaggtgtccgccgcggcgggcggcgggtgcggcggcgagcggaagcggcggctgagcgtggagcaggtgcgcaccctggagcgcagcttcgaggtggccaacaagctggagcccgagcgcaaggcgcagctggcccgcgcgctggggctgcagccccgccaggtggccatctggttccagaaccgccgcgccaggtggaagaccaagcagctggagaaggactacgacgcgctgcgccggcagctcgacgccgcacgcgccgagaacgacacactcctgtcccacaacaagaagctgcaggcagagatcatggcgctcaagggaggcggaggcggcggcggcggcggagggaggcatcaggaggcggcgtcggagctcatcaacctcaacgtcaaagagacggaggcgtcctgcagcaaccgcagcgagaacagctccgagatcaacctcgacatctccaggcctccacaggcgccgccgccggccgccgacgacagccccaccatgaacagctaccgcggcagcctaccgttctacgcctccgccaccgcccgcgccgacatcgaccagctcctgcacagcggcggcggccacccgtctccggcgcccaagatggagctcggccacggcactgccgccgacacgccccccgccacggcggcgccgggtggcggaggaggcacctttggcagcctgctgtgcggcgccgccgtcgacgagcagccgccgttctggccgtgggccgacggccaccacaccttccagtga

SEQ ID NO: 15197 - protein, 359 aa, Sorghum bicolor
  misc_feature: The sequence is a functional homolog of SEQ ID NO 1869 in the 11/479,226 US patent application
  misc_feature: The sequence is a functional homolog of SEQ ID NO 1857 in the 11/479,226 US patent application
  misc_feature: The sequence is a functional homolog of SEQ ID NO 246 in the 10/666,642 US patent application
  misc_feature: Ceres ANNOT ID no. 8636364
  misc_feature (118)..(172): Pfam ID: Homeobox Pfam Description: Homeobox domain
  misc_feature (173)..(217): Pfam ID: HALZ Pfam Description: Homeobox associated leucine zipper
MATNGMAPSFFPANFLLQMQQPLHHQQQQEHHHHHHQHHHDDHHLLAPPPPALVSPFLHDFGGAMAAPPPMLAGGLGMGGDDSHLHAAEPQQQQDGGGVASDDEEVSAAAGGGCGGERKRRLSVEQVRTLERSFEVANKLEPERKAQLARALGLQPRQVAIWFQNRRARWKTKQLEKDYDALRRQLDAARAENDTLLSHNKKLQAEIMALKGGGGGGGGGGRHQEAASELINLNVKETEASCSNRSENSSEINLDISRPPQAPPPAADDSPTMNSYRGSLPFYASATARADIDQLLHSGGGHPSPAPKMELGHGTAADTPPATAAPGGGGGTFGSLLCGAAVDEQPPFWPWADGHHTFQ

SEQ ID NO: 15198 - DNA, 264 bp, Sorghum bicolor
  misc_feature: Ceres ANNOT ID no. 8636396
  misc_feature: Encodes the peptide sequence at SEQ ID NO 15199
atgtcgagccggcggtcgcgttcgagggcgtcgtccggtggtccgtcgcgcatcagcgacgagcagatcagcgacctcgtgaccaagctgcaggcgctcctccccgacgcccgactgcggaccaacgacagcagggagacatgcagctatatccggagcctgcaccgggaggtcgacgacctcagcgacctcctctctgagctcctcaccaccgcagacgtcagcaccgcacaggccgccgtcatccgcagcctcctcatgtag

SEQ ID NO: 15199 - protein, 87 aa, Sorghum bicolor
  misc_feature: Useful for making plants with modulated nitrogen use efficiency
  misc_feature: Useful for making plants with modulated seedling growth
  misc_feature: Functional homolog of the protein sequence given in SEQ ID NO 14152
  misc_feature: Ceres ANNOT ID no. 8636396
MSSRRSRSRASSGGPSRISDEQISDLVTKLQALLPDARLRTNDSRETCSYIRSLHREVDDLSDLLSELLTTADVSTAQAAVIRSLLM

SEQ ID NO: 15200 - DNA, 450 bp, Sorghum bicolor
  misc_feature: Ceres ANNOT ID no. 8636486
  misc_feature: Encodes the peptide sequence at SEQ ID NO 15201
atggaacaatggtgctttaagaaacgcgcagctctggtgattgtggtggtcatcacctcgctgctgctcctaacaattgctcaagctggaggagacgacgacgaggtgtcgtcgtcgttgccggccggcggcgtcgtctcggacgggtgttcaggggaggacgtggtggtgtaccagagcagcgccaaccctctgccgagcggcatcccggcctacaccgtgcagatcatcaacgtctgcagcggagggtgcaccgtgtacgacgtgcacgtctcctgcggcgacttcgcctccacggagctcgtcgacccggccaagttccagcgcgtcagcttcaacgactgcgtcgtcaagggcggtggcgcgctcgagcccagcgagaccgtctccttccagtactccaactcattctcctaccacctcaccgtcgcctccgtcgcctgccattaa

SEQ ID NO: 15201 - protein, 149 aa, Sorghum bicolor
  misc_feature: Useful for making plants with modulated nitrogen use efficiency
  misc_feature: Functional homolog of the protein sequence given in SEQ ID NO 14153
  misc_feature: Ceres ANNOT ID no. 8636486
  misc_feature (44)..(141): SWISSPROT Homolog: EC 2.1.1.43 Histone-lysine N-methyltransferase
MEQWCFKKRAALVIVVVITSLLLLTIAQAGGDDDEVSSSLPAGGVVSDGCSGEDVVVYQSSANPLPSGIPAYTVQIINVCSGGCTVYDVHVSCGDFASTELVDPAKFQRVSFNDCVVKGGGALEPSETVSFQYSNSFSYHLTVASVACH

SEQ ID NO: 15202 - DNA, 1167 bp, Sorghum bicolor
  misc_feature: Ceres ANNOT ID no. 8636856
  misc_feature: Encodes the peptide sequence at SEQ ID NO 15203
atggggaagcccaagtcgtcgtcgacgtcgtggtctgcgctgttgggtttcggctgcttcagctcttcccatgccgaccgctctggctccggctccggctccggcaacggcaacgcggccaaggtggcctcctccagttccaggcctccggcacccgcaccagcgccgctgccttcgccagaggacctatcgctgtcgctggcggggtctgacgtgctcgctttcacggtggaggagctccgggtggcaacgcgggacttctcgatgagcaacttcgtcggcgagggcgggttcggccccgtgtacaagggccgcgtcgacgaccgggtcaggcccggcttgcggcagccgcaggccgtcgccgtcaagctgctcgacctcgagggctcccagggccacaaggagtggctggctgaagttattttccttgggcagctgaggcatccacatcttgtcaaactcatcggctactgctaccaggacgagcacaggcttcttgtgtacgagttcatggccaggggcagcttggagaagcatctcttcaaaaagtacactgcttccctgccgtggctgacgcgtctgaagatcgccattggagctgccaaaggtttggccttcctccacgaagctaccaagcccgtgatctaccgcgacttcaagacctccaacatccttctggactcagactacacggcgaagctgtctgatttcgggctggcaaaggacgggcctggagaagacgagacccacgtgtcgacccgagtgatgggcacgcagggctacgccgcaccagagtacatcatgacggggcatctgacgacgaagagcgacgtgtacagcttcggcgtggtgctgctggagctgctgacggggcgcaaggcggtggacaagaaccggccgccgcgagagcagagcctggtggagtgggcgcgcccatgcctgcgcgacgctcgccggctggagcgcgtcatggaccggaggctgctgcacccgacgcccactcgagctgcccacaaggccgccggggtagcgcaccagtgcctcagtgtaagccccaaatcacggcctcagatgtccgccgtcgtagaggccctggagtcgctgctcgctctagacgatgccgctgtggagccatttgtatacacggcgccgccggcgaacagatga

SEQ ID NO: 15203 - protein, 388 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8636856
  misc_feature (74)..(358): SWISSPROT Homolog: EC 2.7.11.1 Non-specific serine/threonine protein kinase
  misc_feature (87)..(365): Pfam ID: Pkinase_Tyr Pfam Description: Protein tyrosine kinase
MGKPKSSSTSWSALLGFGCFSSSHADRSGSGSGSGNGNAAKVASSSSRPPAPAPAPLPSPEDLSLSLAGSDVLAFTVEELRVATRDFSMSNFVGEGGFGPVYKGRVDDRVRPGLRQPQAVAVKLLDLEGSQGHKEWLAEVIFLGQLRHPHLVKLIGYCYQDEHRLLVYEFMARGSLEKHLFKKYTASLPWLTRLKIAIGAAKGLAFLHEATKPVIYRDFKTSNILLDSDYTAKLSDFGLAKDGPGEDETHVSTRVMGTQGYAAPEYIMTGHLTTKSDVYSFGVVLLELLTGRKAVDKNRPPREQSLVEWARPCLRDARRLERVMDRRLLHPTPTRAAHKAAGVAHQCLSVSPKSRPQMSAVVEALESLLALDDAAVEPFVYTAPPANR

SEQ ID NO: 15204 - DNA, 1167 bp, Sorghum bicolor; identical to SEQ ID NO: 15202
  misc_feature: Ceres ANNOT ID no. 8636853
  misc_feature: Encodes the peptide sequence at SEQ ID NO 15205

SEQ ID NO: 15205 - protein, 388 aa, Sorghum bicolor; identical to SEQ ID NO: 15203
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8636853
  misc_feature (74)..(358): SWISSPROT Homolog: EC 2.7.11.1 Non-specific serine/threonine protein kinase
  misc_feature (87)..(365): Pfam ID: Pkinase_Tyr Pfam Description: Protein tyrosine kinase

SEQ ID NO: 15206 - DNA, 2304 bp, Sorghum bicolor
  misc_feature: Ceres ANNOT ID no. 8636857
  misc_feature: Encodes the peptide sequence at SEQ ID NO 15207
atggagcttgctctccccttcctcctccttgcactccttgcaagcccctcgcttgcccatgccaatggcaacggcagcaacacgacgacgtacatcgtgttcatggacccggcgcgcatgccggccgtgcaccggacaccggcgcactggcacgcggcgcatctcgagtcgctgtccatcgacccgtcccgccacttgctgtactcctactccgccgccgcgcacggattcgcggcggcgctgctaccgggccatttgcccctgctccgcggcagccccgaggtgctccaggtcgtgccggacgaggtgttccagctccacaccacgcgctccccggagttcttgggccttctcacgccggcctaccagcccgccatcggcaatctggaggcggccacgcacgacgtggtcataggggttcttgacaccggcgtatggccggagtcgccgagcttcgcgggcggcaacctgccgccgccgcccgcgcggtggaagggggtgtgcgaggctggcgtggatttcccgccgagcttgtgcgggaggaagctggtgggcgcgcgcagcttctcgcgcggcctccatgcggcaaacggcggcgcaataggcgtggggaagaggacgttcaggtcggcccgggacagggacgggcacggcacgcacacggcgaccacggcggccggcgcggtggtggccaacgcaagcctgctcgggtacgccacggggacggcgcgcgggatggcgcccggggcgcgcgtggccgcgtacaaggtgtgctggccggaggggtgcctcggctccgacatcctagccggcattgacgccgctgtcgctgatggggtgggcgtgctgtcgctgtccctcggcggcggctcagcgccgtacttccgggataccgtagcggtgggcgcctttggtgccgcggcggccggcgtgttcgtctcttgctccgccgggaactccggcccatccggcgccaccgtctcgaactcggctccgtgggtcgccaccgtcggcgccgggacactcgaccgcgatttcccggcatacgtcacgctccccacaggcgtgcgcctgcccggcgtgtccctctacgcggggccttctccctccccacgccccgccatgctcccgctcctatacggcggcgggcgtgacaacgccagcaagctctgcctctctgggacgctggacccggccgcagtgcgcggcaaaatagttctctgcgaccgcggcgtgaacgcgcgcgtggagaagggcgccgtcgtcaaggcggccggcggcgccggcatgatattggccaacacggcggccagcggagaggagctcgtggcggacagccacctgctccccgcggtggcggtggggcggatggtgggtgacaagatacgggagtacgcggcgcgcgggcgcggcggcggcaggcccatggcaatgctgagcttcggcggcacggttcttggcgtccggccgtctccagtcgtggcggcgttcagctcccgcggccccaacaccgtggtgccggagatcttgaagccggacatgatcggcccgggggtaaacatcctggccgcttggaccggcgtcgctggaccgaccggactcgccaaagacggccgccggactcacttcaacatcatctcaggcacatcgatgtcgtgccctcacattagtggagtggctgcgctcatgaaggccgctcaccctgactggagccctgctgccatcaagtctgcgctaatgaccactgcatacaccgttgacaacacaaactcctctctccgggacgccgcggacggttcgcttgcaaacgcgtttgcttacggcgccggccatgtcgacccacagaaggcgctttctccgggcctcgtgtacgacatctctacaaacgactatgctgccttcctctgctccctgaactacagcgccccgcacatccaagtgatcaccaagacgtccaacgtctcctgcccgaagaaattccgccccggtgatctcaactacccatccttctcggtggtgttcaatcagaaatcaaagccggtgcagaggttcagaagggagctaaccaatgttggccccgcgacttcggtttacaacgtgaaggtgatcagccctgaatccgttgctgtcacggtgacaccggcgaaactgaccttcaagaaggcggggcagaagctcaggtaccatgtcacctttgcgtccaaggctggtcagagccacgcgaaaccggatttcgggtggatatcctgggtgaacgatgaacacgtcgttcgcagcccggtcgcgtatacatggaagatgtga

SEQ ID NO: 15207 - protein, 767 aa, Sorghum bicolor
  misc_feature: Useful for making plants with modulated flowering time
  misc_feature: Functional homolog of the protein sequence given in SEQ ID NO 14098
  misc_feature: Ceres ANNOT ID no. 8636857
  misc_feature (212)..(764): SWISSPROT Homolog: EC 3.4.21.25 Cucumisin
  misc_feature (369)..(466): Pfam ID: PA Pfam Description: PA domain
  misc_feature (29)..(107): Pfam ID: Subtilisin_N Pfam Description: Subtilisin N-terminal Region
  misc_feature (122)..(608): Pfam ID: Peptidase_S8 Pfam Description: Subtilase family
MELALPFLLLALLASPSLAHANGNGSNTTTYIVFMDPARMPAVHRTPAHWHAAHLESLSIDPSRHLLYSYSAAAHGFAAALLPGHLPLLRGSPEVLQVVPDEVFQLHTTRSPEFLGLLTPAYQPAIGNLEAATHDVVIGVLDTGVWPESPSFAGGNLPPPPARWKGVCEAGVDFPPSLCGRKLVGARSFSRGLHAANGGAIGVGKRTFRSARDRDGHGTHTATTAAGAVVANASLLGYATGTARGMAPGARVAAYKVCWPEGCLGSDILAGIDAAVADGVGVLSLSLGGGSAPYFRDTVAVGAFGAAAAGVFVSCSAGNSGPSGATVSNSAPWVATVGAGTLDRDFPAYVTLPTGVRLPGVSLYAGPSPSPRPAMLPLLYGGGRDNASKLCLSGTLDPAAVRGKIVLCDRGVNARVEKGAVVKAAGGAGMILANTAASGEELVADSHLLPAVAVGRMVGDKIREYAARGRGGGRPMAMLSFGGTVLGVRPSPVVAAFSSRGPNTVVPEILKPDMIGPGVNILAAWTGVAGPTGLAKDGRRTHFNIISGTSMSCPHISGVAALMKAAHPDWSPAAIKSALMTTAYTVDNTNSSLRDAADGSLANAFAYGAGHVDPQKALSPGLVYDISTNDYAAFLCSLNYSAPHIQVITKTSNVSCPKKFRPGDLNYPSFSVVFNQKSKPVQRFRRELTNVGPATSVYNVKVISPESVAVTVTPAKLTFKKAGQKLRYHVTFASKAGQSHAKPDFGWISWVNDEHVVRSPVAYTWKM

SEQ ID NO: 15208 - DNA, 2304 bp, Sorghum bicolor; identical to SEQ ID NO: 15206
  misc_feature: Ceres ANNOT ID no. 8636854
  misc_feature: Encodes the peptide sequence at SEQ ID NO 15209

SEQ ID NO: 15209 - protein, 767 aa, Sorghum bicolor; identical to SEQ ID NO: 15207
  misc_feature: Useful for making plants with modulated flowering time
  misc_feature: Functional homolog of the protein sequence given in SEQ ID NO 14098
  misc_feature: Ceres ANNOT ID no. 8636854
  misc_feature (212)..(764): SWISSPROT Homolog: EC 3.4.21.25 Cucumisin
  misc_feature (369)..(466): Pfam ID: PA Pfam Description: PA domain
  misc_feature (29)..(107): Pfam ID: Subtilisin_N Pfam Description: Subtilisin N-terminal Region
  misc_feature (122)..(608): Pfam ID: Peptidase_S8 Pfam Description: Subtilase family

SEQ ID NO: 15210 - DNA, 522 bp, Sorghum bicolor
  misc_feature: Ceres ANNOT ID no. 8636993
  misc_feature: Encodes the peptide sequence at SEQ ID NO 15211
atgtgccattccgtcctcgttccgtttattttctttcgtttacagggtctgacacataggtccgaggccacctcccgcctctggaagaacctcgtctacttccgcgtcaactacgccgcggtcaccgcgctgtgcctggctgcgtccctcctggcgcacccgttctcgctagccatgctgctggcggcgtggtgcctcctctacgagctccgccccgccgacgcgccgccagtcgccgcgttttgccgcaccttctccgaccgcgaggtgctgggtggccttgtcgccgcgtccgcgttcgtcgtcttcctcacgtccgtgggctcgctcatcttctccgcgctcgcgctgggtgcggcggtcgtgtgtgcccacggcgcgtgccgcgtgcctgaggacctgttcctcgacgaggctgaccaggctgctggtggcgccaggaacccgttgctgtgcgcctgcgcgacaaccgcggtggctctctgctcagctcgcatctatggtgtgccggctgccgggtga

SEQ ID NO: 15211 - protein, 173 aa, Sorghum bicolor
  misc_feature: The sequence is a functional homolog of SEQ ID NO 2244 in the 10/374,780 US patent application
  misc_feature: The sequence is a functional homolog of SEQ ID NO 82 in the 10/412,699 US patent application
  misc_feature: The sequence is a functional homolog of SEQ ID NO 922 in the 10/225,066 US patent application
  misc_feature: Ceres ANNOT ID no. 8636993
  misc_feature (1)..(145): Pfam ID: PRA1 Pfam Description: PRA1 family protein
MCHSVLVPFIFFRLQGLTHRSEATSRLWKNLVYFRVNYAAVTALCLAASLLAHPFSLAMLLAAWCLLYELRPADAPPVAAFCRTFSDREVLGGLVAASAFVVFLTSVGSLIFSALALGAAVVCAHGACRVPEDLFLDEADQAAGGARNPLLCACATTAVALCSARIYGVPAAG

SEQ ID NO: 15212 - DNA, 1455 bp, Sorghum bicolor
  misc_feature: Ceres ANNOT ID no. 8637130
  misc_feature: Encodes the peptide sequence at SEQ ID NO 15213
atggcccctgcctccagcgtcgccgtggagaacctcaacccaaaggtcttaaaatgtgagtatgcagtccgtggggagattgtcatccatgctcagcgcttgcagcaacaactacaaacgcaaccagggtctcttcctttcgatcagatcctcttctgcaacattgggaatcctcaatctcttggtcagcaacctgtgacattcttcagggaggttcttgctctttgtgatcatccatgcctcttggaaaaagaggaaaccaaatcattgttcagtgctgatgctatttctcgagcaaagcagattcttgcaactattcctggaagggcaaccggtgcatatagtcacagccagggtatcaaaggactgcgtgatgcaattgctgctggtatcacctcacgtgatggattccctgcaaatgcagatgacattttcattacagatggagcaagtcctggggtccacatgatgatgcaattactgattaggaatgagaaggatggcattctgtgcccaattcctcagtaccccttgtactcggcctccatagctcttcatggtggagctcttgtcccctattaccttgatgaaaaaactgggtggggtttggagatctctgatcttaagaagcaactcgaagatgctcggtcaaaaggcattgatgttagggccttggtggttatcaatccaggaaatccgactgggcaggttcttgctgaagacaaccaatatgacatagtgaaattctgcaaaaatgagggccttgttcttctagctgacgaggtatatcaagagaacatctatgttgacaacaagaaatttaactctttcaagaagattgcaagatccatgggatacggcgaggatgatctccctctagtatcatttcagtctgtttccaaaggatactatggagagtgtggtaaaagaggaggttacatggagatcactggcttcagtgctccggtaagagagcagatctacaaggtagcttcagtgaacctgtgctccaatatcactggtcaaatccttgcaagcctcgtcatgaatccaccaaaggttggggacgaatcatatgcttcctacaaggcagagaaagatgcaatccttcagtctttagctcgtcgtgcaaaggcattggaggatgcattcaacaagcttgagggaatttcatgtaacaaggctgaaggagcaatgtaccttttccctcagattcatctgccacagaaggcaattgaggctgctaaagctgctgagaaagcacctgatgcgttctatgctctccgtctccttgaatcaactggaattgttgtggtccctggatctggatttggtcaagttcctggaacatggcacatcagatgcactatcctgccgcaagaagacaaaatccccgcggtgatcacccgcttcaaggctttccatgaggcgttcatggctgagtaccgcgactaa

SEQ ID NO: 15213 - protein, 484 aa, Sorghum bicolor
  misc_feature: Useful for making plants with modulated nitrogen use efficiency
  misc_feature: Functional homolog of the protein sequence given in SEQ ID NO 13731
  misc_feature: Ceres ANNOT ID no. 8637130
  misc_feature (4)..(484): SWISSPROT Homolog: EC 2.6.1.2 Alanine transaminase
  misc_feature (86)..(471): Pfam ID: Aminotran_1_2 Pfam Description: Aminotransferase class I and II
MAPASSVAVENLNPKVLKCEYAVRGEIVIHAQRLQQQLQTQPGSLPFDQILFCNIGNPQSLGQQPVTFFREVLALCDHPCLLEKEETKSLFSADAISRAKQILATIPGRATGAYSHSQGIKGLRDAIAAGITSRDGFPANADDIFITDGASPGVHMMMQLLIRNEKDGILCPIPQYPLYSASIALHGGALVPYYLDEKTGWGLEISDLKKQLEDARSKGIDVRALVVINPGNPTGQVLAEDNQYDIVKFCKNEGLVLLADEVYQENIYVDNKKFNSFKKIARSMGYGEDDLPLVSFQSVSKGYYGECGKRGGYMEITGFSAPVREQIYKVASVNLCSNITGQILASLVMNPPKVGDESYASYKAEKDAILQSLARRAKALEDAFNKLEGISCNKAEGAMYLFPQIHLPQKAIEAAKAAEKAPDAFYALRLLESTGIVVVPGSGFGQVPGTWHIRCTILPQEDKIPAVITRFKAFHEAFMAEYRD

SEQ ID NO: 15214 - DNA, 783 bp, Sorghum bicolor
  misc_feature: Ceres ANNOT ID no. 8637562
  misc_feature: Encodes the peptide sequence at SEQ ID NO 15215
atgagctcttcggtccttggggcgagtgcaggcgctggcggcggcggcagctcatcaagcgtgccgagtgggggcgttggatgtggcggtggtgggccaccatgcggtgcgtgcaagttcctgcggcgcaagtgcgtgaccgggtgcatcttcgccccctactttgactcggagcagggcgcggcacacttcgcggcggtgcacaaggtgttcggcgccagcaacgtgtccaagctgctgctccagatcccgcctcacaagcgcctggacgccgtggtcaccgtgtgctatgaggctcaggcgcgcatccgcgaccccgtctacggctgcgtctcccatgtcttcgccctacagcaacaggtagtgaacctccagaccgagctcacgtacctgcaaggccacctgagcacaattgagctcccaacaccaccaccttttggtgcacagaaccagatgccaatgactgccacattctgtgtttcaaacctgccgtccgcgtccagcaatatcatcccgggcaccgttgacgtgtcaacagtctttgagccgcagacacaggagtcccactgggtctccctctcccagcagcagcaacaggtgcagcaacaccagtttaaccaacagcagtctgtcatggtgggagagggccctggcactggcatgagtggaagcggcgctataggaggtggagacttacaattgctggcaagggagctcctggaccgccatggcataacagcagttggctcgcagtcacagcctaagccgccgccattcacatag

SEQ ID NO: 15215 - protein, 260 aa, Sorghum bicolor
  misc_feature: Useful for making plants with modulated biomass
  misc_feature: Functional homolog of the protein sequence given in SEQ ID NO 14154
  misc_feature: Ceres ANNOT ID no. 8637562
MSSSVLGASAGAGGGGSSSSVPSGGVGCGGGGPPCGACKFLRRKCVTGCIFAPYFDSEQGAAHFAAVHKVFGASNVSKLLLQIPPHKRLDAVVTVCYEAQARIRDPVYGCVSHVFALQQQVVNLQTELTYLQGHLSTIELPTPPPFGAQNQMPMTATFCVSNLPSASSNIIPGTVDVSTVFEPQTQESHWVSLSQQQQQVQQHQFNQQQSVMVGEGPGTGMSGSGAIGGGDLQLLARELLDRHGITAVGSQSQPKPPPFT

SEQ ID NO: 15216 - DNA, 783 bp, Sorghum bicolor; identical to SEQ ID NO: 15214
  misc_feature: Ceres ANNOT ID no. 8637560
  misc_feature: Encodes the peptide sequence at SEQ ID NO 15217

SEQ ID NO: 15217 - protein, 260 aa, Sorghum bicolor; identical to SEQ ID NO: 15215
  misc_feature: Useful for making plants with modulated biomass
  misc_feature: Functional homolog of the protein sequence given in SEQ ID NO 14154
  misc_feature: Ceres ANNOT ID no. 8637560

SEQ ID NO: 15218 - DNA, 3084 bp, Sorghum bicolor
  misc_feature: Ceres ANNOT ID no. 8637674
  misc_feature: Encodes the peptide sequence at SEQ ID NO 15219
atggcggagccctaccaaatgaacggcatactgaatgggatgcctaatttgaggcatccatcctctccatcagagaggtcgacgaattctgtaaagcgcttgatggtgactcgccaatacacaggtgtgctagtcgctaacaatgggatggccgcggtcaagttcatgggcagcatccggatatgggccctggagacctttgggacagagaaggccattcttttggttgctatggaaactccggaggacttgaggataaacgctgagcacataagaatcgctgatcagttcgtagaagttcctggaggaacaaacaataacaactatgcgaatgtacggcttatagtggagattgcagagagaactcgtgtatctgcagtttggcctggctggggtcatgcgtctgagaacccagaacttccagatgctctaaacgagaaaggaatcatttttcttgggccaccatcagctgcaatggctgcacttggtgataagattggttcttctctcattgcacaagcagcaggagttccaactcttccatggagtggatcacatgtaaaagttccaccagaaagctgccattcaattcccgaggagatatataagaatgcttgtgtttccaccacagaggaagcagtggctagttgtcaggttcataacgatgatgaggtgagggcactgttcaagcaagttcaaggagaagtccctggctcgcctatatttattatgaaagtggcatctcagagccgacatctggaggttcaattgctctgtgataaacatggcaatgtggcagcactacacagtcgagattgcagtgttcaaagaaggcaccaaaagattattgaagaggggccaataacagttgctgctccagacactgttaaagagcttgagcaggcagcaaggtggcttgctaagtgtgttcaatacgctggtgctgctaccgtagaatatctgtacagcatggaaacgggcgaatactattttttggagcttaatccacggttgcaggtagaacatcctgtgactgaatggatagctcaaattagacgcttttatggaatggaccatgggggaggctaccatgattggaggaaaatatcagctgttgcaactaagtttgatttggataaagcacagtcagtgaggccgaagggccattgtgttgcagtcagagttactagtgaggatcctgatgatgggtttaagcctacaagtggaagagtggaggagttattaaactttaaaagcaaacaaaatgtttgggcctatttctctgttaagtctggaggagcaattcatgaattttctgattcacagtttggtcatgtttttgcatttggggaatctagatctttggccatagccaatatggtacttgggctaaaagaggttcagatccgtggagagacagtggatctcttgaatgccacagagtaccgcgaaaataagatccatactggttggcttgacagcagaatagctatgcgtgttagagcagagaggcccccatggtacctctcagttgttggaggagctctatatgaagcatcaagcaggagctcaagcgttgttactgattatgttggttatctcagcaaaggtcatataccaccaaagcacatctcgcttgtcaatttaagtgttactctgaacatagaggggaacaaatacacgattgagacagttaggggtggaccccgcagctacaaattaagaatgaatggatcagaaattgaagcagagatacattcactgcgagatggtggacttttaatgcagttggatggaaacagtcatgtaatttatgcagagacagaagctgctggtacgcgccttctcattaatggtagaacatgcttactacagaaagaacacgatccttcaaagttgttggctgatacaccttgcaaacttcttcgtttcttggttgcggatggctctcatgtggatgctgatacaccatatgctgaggtggaagtcatgaagatgtgcatgccactgttactgcctgcctctggtgtcattcactttgttatgcctgagggtcaggcgaatgacctgatagcaagattggaccttgatgacccatcttctgtgaggagagctgaaccatttcatggttcctttcccaaactgggacctcctactgctatctctggcaaagttcatcaaaaatttgctgcaagtgtgaattctgcacacatgatccttgcaggatatgaacataatataaatgacgttgtacaagatttgctgaactgcctagacagccctgagctcccttttctacagtggcaagaacttatgtctgttttagcaacacgacttccaaaagatcttaggaatgagttggatggtaagtacaaggagtatgaattgaatcctgacttctgcaagagtaaggatttccctgcaaagcagctgaggtgtgttattgaggcaaatcttgcatactgttcggagaaagataggattactaatgagaggcttgtggaaccacttatgagcctggtcaagtcatatgagggtggaagagaaagccatgctcgtgttgttgtcaaatctctatttgaggagtatctgtcttctgatgttatagagcgtctacgccttcaacatgcaaaagaccttgagaaggttgtatacattgtgttctcacaccagggtgtgaggagcaaaaataaattaatactacggcttatggaagcattggtatatccaaacccatctgcttacagggatcagctgattcgcttctctgctttgaaccattcatcatattccaagctggcacttaaagcaagccaacttcttgagcacactaaattgagtgaacttcgcacaagcatagcaagaagcctttcagagctggaaatgtttactgaggaaggagagcgtttgtcaacacctaggagaaagatggcgataaatgagagaatggaagatttagttgaagatgctcttgtagcgttgttcgatcacagtgatcctactcttcaacggagagtggttgagacatatgtacgcagattgtatcagaccaatcttcagtcaaggctgcagcttggtgactag

SEQ ID NO: 15219 - protein, 1027 aa, Sorghum bicolor
  misc_feature: Useful for making plants with altered oil content
  misc_feature: Useful for making plants with modulated herbicide sensitivity
  misc_feature: Functional homolog of the protein sequence given in SEQ ID NO 13625
  misc_feature: Ceres ANNOT ID no. 8637674
  misc_feature (40)..(501): SWISSPROT Homolog: EC 6.4.1.1 Pyruvate carboxylase
  misc_feature (39)..(162): Pfam ID: CPSase_L_chain Pfam Description: Carbamoyl-phosphate synthase L chain, N-terminal domain
  misc_feature (392)..(493): Pfam ID: Biotin_carb_C Pfam Description: Biotin carboxylase C-terminal domain
  misc_feature (695)..(1027): Pfam ID: ACC_central Pfam Description: Acetyl-CoA carboxylase, central region
  misc_feature (164)..(359): Pfam ID: CPSase_L_D2 Pfam Description: Carbamoyl-phosphate synthase L chain, ATP binding domain
  misc_feature (631)..(694): Pfam ID: Biotin_lipoyl Pfam Description: Biotin-requiring enzyme
MAEPYQMNGILNGMPNLRHPSSPSERSTNSVKRLMVTRQYTGVLVANNGMAAVKFMGSIRIWALETFGTEKAILLVAMETPEDLRINAEHIRIADQFVEVPGGTNNNNYANVRLIVEIAERTRVSAVWPGWGHASENPELPDALNEKGIIFLGPPSAAMAALGDKIGSSLIAQAAGVPTLPWSGSHVKVPPESCHSIPEEIYKNACVSTTEEAVASCQVHNDDEVRALFKQVQGEVPGSPIFIMKVASQSRHLEVQLLCDKHGNVAALHSRDCSVQRRHQKIIEEGPITVAAPDTVKELEQAARWLAKCVQYAGAATVEYLYSMETGEYYFLELNPRLQVEHPVTEWIAQIRRFYGMDHGGGYHDWRKISAVATKFDLDKAQSVRPKGHCVAVRVTSEDPDDGFKPTSGRVEELLNFKSKQNVWAYFSVKSGGAIHEFSDSQFGHVFAFGESRSLAIANMVLGLKEVQIRGETVDLLNATEYRENKIHTGWLDSRIAMRVRAERPPWYLSVVGGALYEASSRSSSVVTDYVGYLSKGHIPPKHISLVNLSVTLNIEGNKYTIETVRGGPRSYKLRMNGSEIEAEIHSLRDGGLLMQLDGNSHVIYAETEAAGTRLLINGRTCLLQKEHDPSKLLADTPCKLLRFLVADGSHVDADTPYAEVEVMKMCMPLLLPASGVIHFVMPEGQANDLIARLDLDDPSSVRRAEPFHGSFPKLGPPTAISGKVHQKFAASVNSAHMILAGYEHNINDVVQDLLNCLDSPELPFLQWQELMSVLATRLPKDLRNELDGKYKEYELNPDFCKSKDFPAKQLRCVIEANLAYCSEKDRITNERLVEPLMSLVKSYEGGRESHARVVVKSLFEEYLSSDVIERLRLQHAKDLEKVVYIVFSHQGVRSKNKLILRLMEALVYPNPSAYRDQLIRFSALNHSSYSKLALKASQLLEHTKLSELRTSIARSLSELEMFTEEGERLSTPRRKMAINERMEDLVEDALVALFDHSDPTLQRRVVETYVRRLYQTNLQSRLQLGD

SEQ ID NO: 15220 - DNA, 1275 bp, Sorghum bicolor
  misc_feature: Ceres ANNOT ID no. 8638020
  misc_feature: Encodes the peptide sequence at SEQ ID NO 15221
atggcggcttctgtgttgtgtctttgcctctctgtgagcacactgccatcacgcgcaatggcgacactccatctgttgctggccctgctgcttctgctcccttccatctctgaggcgacgtcctcggcgctgctgggcatcagctacgggcgcgttggcaacaacctccctgcagcgacctcagtgccgcagattgtggcctccctgggcatcggccgcgtccgactctacgatgctgaccccaccaccatccgcgccttcgccaacacgggcgtcgagctcgtcgtcggcgtccctgacgagtgccttgccactgtctccacccccaacggcgccgcctcctgggtcggctccaacattgcccccgcgctcccggccaccaagatcgccttcctcaccgtcggcaacgaggtgctcaccggcgtcaacagctcctcgctttccaggtacctcctcccggcgatgcagtgcctccacgacgcgcttgcgcaggccggcctggacaagcaggtcgccgtcaccacggcgcacaacctcggcgtgctggccacgtcgtacccgccgtcgtcggcctacttccgcaaggacctcctcccgatgctctgccccatcctcgacttccacgcgcacgcggggtcgccgttcctggtcaatgcgtacccctacttcgcctacgccgaggaacccacgggcgtggagctcgagtatgcgctgctggaacccggccatgccggcgtcgccgacccggggaccgggctgcactacaccaacatgctcgcggcgcaggtcgacgccgtgtaccatgccatcgcggcggccaacagcgcggcggcgcgggccgtggaggtgcgcgtgtccgagaccgggtggccgtcggcgggggacgccaacgagaccggcgccacgccgcagaacgcggcgaggtacaacggcaatgtgatgcggctcgtggcccaggggaagggcacgccgatgcggccggcggcgccgctgcgcgtctatatgttcgcgctcttcaacgagaacatgaagcccgggccgacatcggagcgcagctacggcctcttcaagcccgacggaacgccggcgtacgagctctcctaccgcctcccgcaggacaacaccaccacctcctcctccggtggcagcgttaccggcggtggcggctaccatggccacggctacgggtcggacaacgccgggtactacagcatctcggccgctgccaaggtagctgtggcagcacgtgtggctgtactggccatgccactgtga

SEQ ID NO: 15221 - protein, 424 aa, Sorghum bicolor
  misc_feature: Useful for making plants with altered carbohydrate content
  misc_feature: Functional homolog of the protein sequence given in SEQ ID NO 14155
  misc_feature: Useful for making plants with altered cell wall content and/or composition
  misc_feature: Useful for making plants with altered lignin content
  misc_feature: Functional homolog of the protein sequence given in SEQ ID NO 14156
  misc_feature: Ceres ANNOT ID no. 8638020
  misc_feature (39)..(366): SWISSPROT Homolog: EC 3.2.1.39 Glucan endo-1,3-beta-D-glucosidase
  misc_feature (45)..(368): Pfam ID: Glyco_hydro_17 Pfam Description: Glycosyl hydrolases family 17
MAASVLCLCLSVSTLPSRAMATLHLLLALLLLLPSISEATSSALLGISYGRVGNNLPAATSVPQIVASLGIGRVRLYDADPTTIRAFANTGVELVVGVPDECLATVSTPNGAASWVGSNIAPALPATKIAFLTVGNEVLTGVNSSSLSRYLLPAMQCLHDALAQAGLDKQVAVTTAHNLGVLATSYPPSSAYFRKDLLPMLCPILDFHAHAGSPFLVNAYPYFAYAEEPTGVELEYALLEPGHAGVADPGTGLHYTNMLAAQVDAVYHAIAAANSAAARAVEVRVSETGWPSAGDANETGATPQNAARYNGNVMRLVAQGKGTPMRPAAPLRVYMFALFNENMKPGPTSERSYGLFKPDGTPAYELSYRLPQDNTTTSSSGGSVTGGGGYHGHGYGSDNAGYYSISAAAKVAVAARVAVLAMPL

SEQ ID NO: 15222 - DNA, 198 bp, Sorghum bicolor
  misc_feature: Ceres ANNOT ID no. 8638529
  misc_feature: Encodes the peptide sequence at SEQ ID NO 15223
atgcaaggacagcctgtaggggcggttgctggctccagccccaaccaagtgacttcaaagtcagctgtgctcgccgccgccgggttcgtgcttctggtgttggatgacgtccttctgttgccagagatgcagattttcgtgaagggccttactggcagactattcaccatccaagtggagtcctctgaacacggttga

SEQ ID NO: 15223 - protein, 65 aa, Sorghum bicolor
  misc_feature: Useful for making plants with modulated cold sensitivity
  misc_feature: Functional homolog of the protein sequence given in SEQ ID NO 13521
  misc_feature: Ceres ANNOT ID no. 8638529
MQGQPVGAVAGSSPNQVTSKSAVLAAAGFVLLVLDDVLLLPEMQIFVKGLTGRLFTIQVESSEHG

SEQ ID NO: 15224 - DNA, 3198 bp, Sorghum bicolor
  misc_feature: Ceres ANNOT ID no. 8638530
  misc_feature: Encodes the peptide sequence at SEQ ID NO 15225
atggccaaccccgacgaggtgctcctgtggcactccgtcgaacaggccacgccccagcgggccaggaaggagcgtcaagatagtcgccttggtgtgcgagctggaagactggaactcccgccagttctggctcacctcctggaccctatcatctgcgaactgatcagcagctatgcaactcctatgtacttgaaggcatcagtgttagttgttccaccttgggtttcttttgggcgcatacaaattgttggttgccctgtccgaagcctaataattgagataattacttctgcagcttatacttcaggtacaactcctcttgttacaaatgacagttcgaagtgtgatttctgtacattcaagctacttgacagtagaaaagctcagaaaaacttccaaatgaatgcactgttgaaagttccttggtcaccacatgttggcgcatgcagttcagtggttctgtggtttcagcaatttttctttacctcactgattattaaaggatatgcttttagtgagatgcactttggatctgtcaacgcaacaattatgctatattttatactacctattggagagaatgagctgctgagtgcaccattggttgaatttgagttgctgggtgattttgagctactcgagacatggattgcaagagatgtttttgcgcatccatcagttactgctcagtctgaacttcacgtgctccattatattagttcctgttgcatctatggtggattggttgaacctgtccggctgttacacttgctgtcccaatgggcttctaattctctcttattcttgttaagtggaagtgttgaagatgctcccttattgcctgtatgctttgcaagatggatggctaaaagtttgtttctgcgtgagagaaaagttgttggagtgacacacatcgacatgaaggtttggttcccctacaatctaacctcagtacttgtgttgagcaagtgttgggcaactgctgggttactcagaatcagattggattggttccctacttgctgcattgcgttgcttccatggccacctcctgcaatatttcatagtaacattgccagtgagcttgttgaaacaatatcagttggcagcaagctgaatgttcgtgatcatgtgacattagctgcttctgatctaacattgggttatgatgagcttcagttgggtcagaacaaaaatcatgatgtcagatatactgatgtgaagacttggctggactgcaaaatgacttcaatgcctatctgtggtaggactctggcatatggtttcgttgagtctatctggccaactcatacaagaacatacaacatgatggttacaataagcatcaatcctgtgaaagggatgtcagatacccagacacgcacaagcaacaccatcgcgctccaagtggagccgtcagacacggtcactgatgtcaagaaaaagattagtggccaccagagcctcttcttggccggcaacaggcttcaggatgatcgaacatttgaatcctatcatgaaacccagaacgacactaccctgcacctcgacttcggcatgcagattttcgtgaagatgctgaacggcaagaccatcacccttgaggtagacccatctgatacagtcggtgatgtcaaggcaaagatactggaccaacaccgacttgatggccagcgtcagcttgcctcttacaaggttcagaaccattcgacactgcaccttgacctctgtccgtgtgatggcatgcagatttccgtgaagacactcccactccctggcagcgaggccatcaggttcaaagtgcagattactgacacgattggcgatttgaaggcaaagattcaggaccaacagaggctcctctttaacggacagcagcttgttgatgagcagacgctcgccgattacgatgtccacagactatccaccctgcaccttgactgtcccatgcaggtttttgtgaagagatccactggccagacgatcactcttgaggtggagccgtcgaacaccattgacgatgtcaagggaaagatcagtggtcaccagagtctcactttttatggcaacgagcttgacgatgggaagacacttgctgagtgcaatgtccatatggggtctaccttgcaccttgatatgcagatcttcctaaagggcttcgctggcagacactacaccatcgaagtgcagtcctctgacacggttgacagcctcaaggcaaaggtcgaggagttggaggccgttcctgctaagctgcagcgccttcttgtcggtggctaccagctcgaggatgggcacaaactttccaaatacaaaatcgtggaatttgccaccgtgcaccttgtcctgcgtcttctttcttgtcgtcagtgtccatccagtactgacaggtatatctacgtacagacacgcacaagcaacaccatcgcgctccaagtgcagccgtcagacacggtcactgatgtcaggaaaaatattagtggccaccagagcctcttcttggccggcaacaggctccaggatgatcgaacatttggatactactatcaaatccaaaacgacgctaccctgcacctcgacttcggcatgcagattttcgtgaagacgttcaacggcaagaccagcacccttgaggtagacccatctgatacagtcggtgatgtcaaggcaaagatgctggaccagcagaagatcatctttgacggcagccgacttgatgaccagcgcaagcttggctcttgcaaggttcagaaccattccacactgcaccttgatctctgcccgcgtgatggaaatggaatgcagattgccgtgaagacactcccactccctggcagcgaggccatcaggttcaaggtgcagattactgacacgattggcgatttgaaggcaaagattcaggaccaacagaggctcctctttaacggacagcagcttgttgatgagcagacgctcgccgattacgatgtccagagactatccaccctgcaccttgactgtcccatgcaggtttttatgaagatgtccactggccagacgatcactctagaggtggagccatctaataccgttgacgatgtcatgaagaaaattggccaccacatgagtctcacctttgatggcaacgagcttgacaatgggaagacacttgctgagtgcaatgtccatatggggtctaccctgcaccttgatgcttag

SEQ ID NO: 15225 - protein, 1065 aa, Sorghum bicolor
  misc_feature: Useful for making plants with modulated cold sensitivity
  misc_feature: Functional homolog of the protein sequence given in SEQ ID NO 13521
  misc_feature: Ceres ANNOT ID no. 8638530
  misc_feature (718)..(786): Pfam ID: ubiquitin Pfam Description: Ubiquitin family
  misc_feature (868)..(929): Pfam ID: ubiquitin Pfam Description: Ubiquitin family
  misc_feature (942)..(1003): Pfam ID: ubiquitin Pfam Description: Ubiquitin family
  misc_feature (590)..(651): Pfam ID: ubiquitin Pfam Description: Ubiquitin family
  misc_feature (655)..(716): Pfam ID: ubiquitin Pfam Description: Ubiquitin family
  misc_feature (525)..(579): Pfam ID: ubiquitin Pfam Description: Ubiquitin family
  misc_feature (459)..(521): Pfam ID: ubiquitin Pfam Description: Ubiquitin family
  misc_feature (1007)..(1064): Pfam ID: ubiquitin Pfam Description: Ubiquitin family
MANPDEVLLWHSVEQATPQRARKERQDSRLGVRAGRLELPPVLAHLLDPIICELISSYATPMYLKASVLVVPPWVSFGRIQIVGCPVRSLIIEIITSAAYTSGTTPLVTNDSSKCDFCTFKLLDSRKAQKNFQMNALLKVPWSPHVGACSSVVLWFQQFFFTSLIIKGYAFSEMHFGSVNATIMLYFILPIGENELLSAPLVEFELLGDFELLETWIARDVFAHPSVTAQSELHVLHYISSCCIYGGLVEPVRLLHLLSQWASNSLLFLLSGSVEDAPLLPVCFARWMAKSLFLRERKVVGVTHIDMKVWFPYNLTSVLVLSKCWATAGLLRIRLDWFPTCCIALLPWPPPAIFHSNIASELVETISVGSKLNVRDHVTLAASDLTLGYDELQLGQNKNHDVRYTDVKTWLDCKMTSMPICGRTLAYGFVESIWPTHTRTYNMMVTISINPVKGMSDTQTRTSNTIALQVEPSDTVTDVKKKISGHQSLFLAGNRLQDDRTFESYHETQNDTTLHLDFGMQIFVKMLNGKTITLEVDPSDTVGDVKAKILDQHRLDGQRQLASYKVQNHSTLHLDLCPCDGMQISVKTLPLPGSEAIRFKVQITDTIGDLKAKIQDQQRLLFNGQQLVDEQTLADYDVHRLSTLHLDCPMQVFVKRSTGQTITLEVEPSNTIDDVKGKISGHQSLTFYGNELDDGKTLAECNVHMGSTLHLDMQIFLKGFAGRHYTIEVQSSDTVDSLKAKVEELEAVPAKLQRLLVGGYQLEDGHKLSKYKIVEFATVHLVLRLLSCRQCPSSTDRYIYVQTRTSNTIALQVQPSDTVTDVRKNISGHQSLFLAGNRLQDDRTFGYYYQIQNDATLHLDFGMQIFVKTFNGKTSTLEVDPSDTVGDVKAKMLDQQKIIFDGSRLDDQRKLGSCKVQNHSTLHLDLCPRDGNGMQIAVKTLPLPGSEAIRFKVQITDTIGDLKAKIQDQQRLLFNGQQLVDEQTLADYDVQRLSTLHLDCPMQVFMKMSTGQTITLEVEPSNTVDDVMKKIGHHMSLTFDGNELDNGKTLAECNVHMGSTLHLDA

SEQ ID NO: 15226 - DNA, 198 bp, Sorghum bicolor; identical to SEQ ID NO: 15222
  misc_feature: Ceres ANNOT ID no. 8638531
  misc_feature: Encodes the peptide sequence at SEQ ID NO 15227

SEQ ID NO: 15227 - protein, 65 aa, Sorghum bicolor; identical to SEQ ID NO: 15223
  misc_feature: Useful for making plants with modulated cold sensitivity
  misc_feature: Functional homolog of the protein sequence given in SEQ ID NO 13521
  misc_feature: Ceres ANNOT ID no. 8638531

SEQ ID NO: 15228 - DNA, 3198 bp, Sorghum bicolor; identical to SEQ ID NO: 15224
  misc_feature: Ceres ANNOT ID no. 8638532
  misc_feature: Encodes the peptide sequence at SEQ ID NO 15229

SEQ ID NO: 15229 - protein, 1065 aa, Sorghum bicolor; identical to SEQ ID NO: 15225
  misc_feature: Useful for making plants with modulated cold sensitivity
  misc_feature: Functional homolog of the protein sequence given in SEQ ID NO 13521
  misc_feature: Ceres ANNOT ID no. 8638532
  misc_feature (718)..(786): Pfam ID: ubiquitin Pfam Description: Ubiquitin family
  misc_feature (868)..(929): Pfam ID: ubiquitin Pfam Description: Ubiquitin family
  misc_feature (942)..(1003): Pfam ID: ubiquitin Pfam Description: Ubiquitin family
  misc_feature (590)..(651): Pfam ID: ubiquitin Pfam Description: Ubiquitin family
  misc_feature (655)..(716): Pfam ID: ubiquitin Pfam Description: Ubiquitin family
  misc_feature (525)..(579): Pfam ID: ubiquitin Pfam Description: Ubiquitin family
  misc_feature (459)..(521): Pfam ID: ubiquitin Pfam Description: Ubiquitin family
  misc_feature (1007)..(1064): Pfam ID: ubiquitin Pfam Description: Ubiquitin family

SEQ ID NO: 15230 - DNA, 96 bp, Sorghum bicolor
  misc_feature: Ceres ANNOT ID no. 8638768
  misc_feature: Encodes the peptide sequence at SEQ ID NO 15231
atgtacaaagtccaatggaatcgatgcaccgaagaggtggttatttgtaaaagagaagaggatttaagaaaaacatacccgcagtggtttgagtaa

SEQ ID NO: 15231 - protein, 31 aa, Sorghum bicolor
  misc_feature: The sequence is a functional homolog of SEQ ID NO 1584 in the 10/374,780 US patent application
  misc_feature: The sequence is a functional homolog of SEQ ID NO 1583 in the 10/374,780 US patent application
  misc_feature: Ceres ANNOT ID no. 8638768
MYKVQWNRCTEEVVICKREEDLRKTYPQWFE

SEQ ID NO: 15232 - DNA, 489 bp, Sorghum bicolor
  misc_feature: Ceres ANNOT ID no. 8638900
  misc_feature: Encodes the peptide sequence at SEQ ID NO 15233
atggctcaagcgtcgagctctttctccattgttctgttgtttctcgcactagtacttgtggttgaggtttctgctagaagcgcaaatggagagctttacaaacctgctggtgcagaaggctctgtccccatagaacgtaatgaatcttctctactctctacatactcagttttgtgccaccttgtttactttttcttagcattagaaagaagtttcagaaagcagattacaaaaccaatttctcaaaaggggcgtaatggcagtcgtaatccttctcaactaatatttgtatctcgtgcatgtacagaatgtccagataaatgtggctaccggtgctcggctacatcacacaggaagccatgccttttcttctgcaactattgctgccagaagtgcctgtgtgtcccatctggtacatacggcaacaaggaagagtgcccgtgctacgacaacctgaagaccaaggaaggcggccccaaatgcccgtga

SEQ ID NO: 15233 - protein, 162 aa, Sorghum bicolor
  misc_feature: Useful for making plants with altered alkaloid content
  misc_feature: Useful for making plants with modulated nitrogen use efficiency
  misc_feature: Functional homolog of the protein sequence given in SEQ ID NO 12973
  misc_feature: Useful for making plants with altered lignin content
  misc_feature: Functional homolog of the protein sequence given in SEQ ID NO 14096
  misc_feature: Ceres ANNOT ID no. 8638900
  misc_feature (52)..(162): Pfam ID: GASA Pfam Description: Gibberellin regulated protein
MAQASSSFSIVLLFLALVLVVEVSARSANGELYKPAGAEGSVPIERNESSLLSTYSVLCHLVYFFLALERSFRKQITKPISQKGRNGSRNPSQLIFVSRACTECPDKCGYRCSATSHRKPCLFFCNYCCQKCLCVPSGTYGNKEECPCYDNLKTKEGGPKCP

SEQ ID NO: 15234 - DNA, 489 bp, Sorghum bicolor; identical to SEQ ID NO: 15232
  misc_feature: Ceres ANNOT ID no. 8638903
  misc_feature: Encodes the peptide sequence at SEQ ID NO 15235

SEQ ID NO: 15235 - protein, 162 aa, Sorghum bicolor; identical to SEQ ID NO: 15233
  misc_feature: Useful for making plants with altered alkaloid content
  misc_feature: Useful for making plants with modulated nitrogen use efficiency
  misc_feature: Functional homolog of the protein sequence given in SEQ ID NO 12973
  misc_feature: Useful for making plants with altered lignin content
  misc_feature: Functional homolog of the protein sequence given in SEQ ID NO 14096
  misc_feature: Ceres ANNOT ID no. 8638903
  misc_feature (52)..(162): Pfam ID: GASA Pfam Description: Gibberellin regulated protein

SEQ ID NO: 15236 - DNA, 123 bp, Sorghum bicolor
  misc_feature: Ceres ANNOT ID no. 8638908
  misc_feature: Encodes the peptide sequence at SEQ ID NO 15237
atggtgcgcaagccactgccgtggaaccgcgatcagcacaccaaggtggagggctgcggtgggcggatccgcatgatgttgtcaagttgcgcgacgaggatcttccagctgacgcggatctag

SEQ ID NO: 15237 - protein, 40 aa, Sorghum bicolor
  misc_feature: The sequence is a functional homolog of SEQ ID NO 316 in the 10/666,642 US patent application
  misc_feature: The sequence is a functional homolog of SEQ ID NO 1222 in the 11/479,226 US patent application
  misc_feature: The sequence is a functional homolog of SEQ ID NO 136 in the 10/225,068 US patent application
  misc_feature: The sequence is a functional homolog of SEQ ID NO 162 in the 10/374,780 US patent application
  misc_feature: The sequence is a functional homolog of SEQ ID NO 550 in the 10/412,699 US patent application
  misc_feature: The sequence is a functional homolog of SEQ ID NO 970 in the 10/225,066 US patent application
  misc_feature: The sequence is a functional homolog of SEQ ID NO 941 in the 11/479,226 US patent application
  misc_feature: The sequence is a functional homolog of SEQ ID NO 2426 in the 10/374,780 US patent application
  misc_feature: The sequence is a functional homolog of SEQ ID NO 246 in the 10/225,068 US patent application
  misc_feature: The sequence is a functional homolog of SEQ ID NO 554 in the 10/412,699 US patent application
  misc_feature: The sequence is a functional homolog of SEQ ID NO 2782 in the 10/374,780 US patent application
  misc_feature: The sequence is a functional homolog of SEQ ID NO 680 in the 10/225,066 US patent application
  misc_feature: The sequence is a functional homolog of SEQ ID NO 1392 in the 10/374,780 US patent application
  misc_feature: The sequence is a functional homolog of SEQ ID NO 1391 in the 10/374,780 US patent application
  misc_feature: Useful for making plants with modulated low light sensitivity
  misc_feature: Useful for making plants with modulated nitrogen use efficiency
  misc_feature: Functional homolog of the protein sequence given in SEQ ID NO 14157
  misc_feature: The sequence is a functional homolog of SEQ ID NO 166 in the 10/225,068 US patent application
  misc_feature: The sequence is a functional homolog of SEQ ID NO 220 in the 10/374,780 US patent application
  misc_feature: The sequence is a functional homolog of SEQ ID NO 1229 in the 11/479,226 US patent application
  misc_feature: The sequence is a functional homolog of SEQ ID NO 226 in the 10/225,066 US patent application
  misc_feature: The sequence is a functional homolog of SEQ ID NO 2424 in the 10/374,780 US patent application
  misc_feature: Ceres ANNOT ID no. 8638908
MVRKPLPWNRDQHTKVEGCGGRIRMMLSSCATRIFQLTRI

SEQ ID NO: 15238 - DNA, 1821 bp, Sorghum bicolor
  misc_feature: Ceres ANNOT ID no. 8638949
  misc_feature: Encodes the peptide sequence at SEQ ID NO 15239
atggaggatgaagaaaactttgaggaggaactgttgcttgtggagtcagaacttgatgacattcaaggacaaattaaaagattacttgatcgccaagaggagctatatgagcgccagtcacaattaaaagctttgctggaagtatcaaaagtgtccagaaataaatcaaattgcaaaccttcagttactctggaagactggtctgggagcttcccatgggattctcaggctgatgatacccgattgaatatatttggcatcacatcataccggtcaaatcaacgagaaataattaacgcagtcatgagtggaagagatgttctggtaataatggctgctggtggagggaagagcctgtgttaccaactcccagctgtacttcgtgatggaattgcattggttgtcagccctctgctttctcttatacaggaccaggtcatgggactgacagctttaggtataccagcatacatgctgacttcaactaccaacaaggaagttgaaaagttcatctatagggcacttgataaaggtgaaggagagctgaagatattatatgtgacaccagaaaagatatcaaaaagtaaaaggttcatgtctaaggttgagaaatgccatcatgcgggacgtctttctcttgttgcagtagatgaggcacactgctgtagtcaatggggtcatgatttccgtccagactacaagaatcttagtatcttaaagatccaatttcccactgttcctatgatagctctaactgcaactgcaacaagtaaagtccaaacagatttgatagagatgcttcatataccaagatgcgtcaaatttgtcagcacagttaacaggcccaacctcttttataaggtgtatcaaaaatcgccagttggaaaggttgtcattgatgagatcacaaattttataactgaatcatacccaaataatgaatctggaattgtgtattgcttttcaaggaaggaatgtgaacaggtcgcaaaagaattgcgtgataggggtgttttggcagagcattatcacgctgatatggatattgttgctcgtgagaaaatccacatgcgttggagcaaaggacaatcacaggtcatcgttggaacagtggcgtttggaatgggaatcaacaaaccggatgttagatttgtgattcatcatagccttagcaagtctatggagacatactaccaggaaagtggtcgggcagggcgggatggattaccttcagagtgtgtattgtattatcgacctggtgatgttccacggcagagttcaatggtcttctatgaaaactgtggccttcaaaatctatatgacattgtgcgatactgtcagtctaagagctgccgacgtggtgctttctttcggcattttggagaggctctgcaggactgcaatggaatgtgtgacaattgtgcttctagtattgagctcaaggatatagatgccacgtgtcataccaaaattctagtttcacttctacacgacttgcaacttaatgaccaaagagctacactgttgcagctggtggataagttcaaggtgaagtggaaaggtttagaaagaagaatttcagcatacagcatattcaaccaatgcttatgttacattaggaccattgtggaagccagcactggaagcgtggaacacccgtacacattgcggtcaactgcctttttctgcattattaggccatgtacttttttttattactggtggtctggtgcgccttggcgagcagtgtggttttgcagtataaacattgcttccttctcttatgccccatttagatccttggaattaaattcattataa

SEQ ID NO: 15239 - protein, 606 aa, Sorghum bicolor
  misc_feature: Useful for making plants with altered lignin content
  misc_feature: Useful for making plants with altered terpenoid content
  misc_feature: Functional homolog of the protein sequence given in SEQ ID NO 13152
  misc_feature: Ceres ANNOT ID no. 8638949
  misc_feature (91)..(263): Pfam ID: DEAD Pfam Description: DEAD/DEAH box helicase
  misc_feature (332)..(408): Pfam ID: Helicase_C Pfam Description: Helicase conserved C-terminal domain
MEDEENFEEELLLVESELDDIQGQIKRLLDRQEELYERQSQLKALLEVSKVSRNKSNCKPSVTLEDWSGSFPWDSQADDTRLNIFGITSYRSNQREIINAVMSGRDVLVIMAAGGGKSLCYQLPAVLRDGIALVVSPLLSLIQDQVMGLTALGIPAYMLTSTTNKEVEKFIYRALDKGEGELKILYVTPEKISKSKRFMSKVEKCHHAGRLSLVAVDEAHCCSQWGHDFRPDYKNLSILKIQFPTVPMIALTATATSKVQTDLIEMLHIPRCVKFVSTVNRPNLFYKVYQKSPVGKVVIDEITNFITESYPNNESGIVYCFSRKECEQVAKELRDRGVLAEHYHADMDIVAREKIHMRWSKGQSQVIVGTVAFGMGINKPDVRFVIHHSLSKSMETYYQESGRAGRDGLPSECVLYYRPGDVPRQSSMVFYENCGLQNLYDIVRYCQSKSCRRGAFFRHFGEALQDCNGMCDNCASSIELKDIDATCHTKILVSLLHDLQLNDQRATLLQLVDKFKVKWKGLERRISAYSIFNQCLCYIRTIVEASTGSVEHPYTLRSTAFFCIIRPCTFFYYWWSGAPWRAVWFCSINIASFSYAPFRSLELNSL

SEQ ID NO: 15240 - DNA, 1017 bp, Sorghum bicolor
  misc_feature: Ceres ANNOT ID no. 8639062
  misc_feature: Encodes the peptide sequence at SEQ ID NO 15241
atggcttcctctagccctcatcatcgtgcagccgtcgtcgccggcgtgctgctggtggtggcggccgccctgtgctcccgcggcgccatggcgcagctgaccgcggactactacgactgcacatgccctgacgcctacaacatcgtgaagaatgtgctcatcgaggcgcacaagtcggacgtgcgcatctacgccagcctcacccgcctccatttccacgactgcttcgtccagggctgcgacggctcggtgctgttggacgccttgccgggggtggccaactctacggagaaattggcgccggcgaacaacaactcggcgcgggggttcccggtggtggacaaagtgaaggcggcgctggagaacgcctgccccggcgtcgtctcctgcgccgacatcctcgccctcgccgcagagatctccgtcgagctgtccggaggcccaaagtggagcgtgcttcttgggaggctagacagcaagacggccaacttcaaaagcgcagagaacctgccgtcgcccttcgacaacctcaccgtgctgcagcaaaagttcaccgccgtcggccttcacaccgtcgacctcgtcgccctctcaggggctcacacatttggccgggtgcagtgccagttcgtgacgagccggctgtacaacttcagcggcaccggccggccggaccctacgctcaacggcggctaccgggcgttcctgacccagaggtgccctctgaacggcaacgggtcagccctgaacgacttggatcccacgacgcccaacctcttcgacaaccactactacaccaacctcgaggtgaaccgaggcttcctcaactccgatcaggagctcaagtcctcgccgccggcgcagggcgtcacggcgcccatcgtcgaccagttcgccagcagccaggacgccttcttcgacaacttcgcgcagtccatgatcaacatgggcaacattcagccactcacggacccctccaagggagaagtccgctgcaactgccgagtggctaattaa

SEQ ID NO: 15241 - protein, 338 aa, Sorghum bicolor
  misc_feature: Useful for making plants with modulated nitrogen use efficiency
  misc_feature: Functional homolog of the protein sequence given in SEQ ID NO 13820
  misc_feature: Useful for making plants with altered cell wall content and/or composition
  misc_feature: Functional homolog of the protein sequence given in SEQ ID NO 14158
  misc_feature: Useful for making plants with altered carbohydrate content
  misc_feature: Functional homolog of the protein sequence given in SEQ ID NO 14159
  misc_feature: Useful for making plants with modulated oxidative stress sensitivity
  misc_feature: Functional homolog of the protein sequence given in SEQ ID NO 13607
  misc_feature: Ceres ANNOT ID no. 8639062
  misc_feature (31)..(338): SWISSPROT Homolog: EC 1.11.1.7 Peroxidase
  misc_feature (49)..(301): Pfam ID: peroxidase Pfam Description: Peroxidase
MASSSPHHRAAVVAGVLLVVAAALCSRGAMAQLTADYYDCTCPDAYNIVKNVLIEAHKSDVRIYASLTRLHFHDCFVQGCDGSVLLDALPGVANSTEKLAPANNNSARGFPVVDKVKAALENACPGVVSCADILALAAEISVELSGGPKWSVLLGRLDSKTANFKSAENLPSPFDNLTVLQQKFTAVGLHTVDLVALSGAHTFGRVQCQFVTSRLYNFSGTGRPDPTLNGGYRAFLTQRCPLNGNGSALNDLDPTTPNLFDNHYYTNLEVNRGFLNSDQELKSSPPAQGVTAPIVDQFASSQDAFFDNFAQSMINMGNIQPLTDPSKGEVRCNCRVAN

SEQ ID NO: 15242 - DNA, 765 bp, Sorghum bicolor
  misc_feature: Ceres ANNOT ID no. 8639122
  misc_feature: Encodes the peptide sequence at SEQ ID NO 15243
atggagcaagaagaggtcgggctagccctgggcctctccctcggctccggtcatcaccagcagctcaaggaacagccaccgccttcttcgcatccatgtgcgctgttggagccgactctgtcgctgagcagcctcccggccaaagatggcctgacgaccacaccgatgaggaggatcgctgccgtgaaaagggagctgcaggtggaggaggacgatgaggccaccgacagggcgcttatttactcggtggcatcgtcggcggtggtcactgccgacgacgacgaagggtgcaacagccggaagaagctgaggctgtccaaggagcagtcggcgctgctggaggaccacttcaaggagcacagcaccctcaaccctaagcaaaaggctgctttggccaggcaactgaacctgaggccaaggcaagtggaggtgtggttccaaaacagaagagcaagaacaaagttgaagcagacagaagtggactgcgagcttctcaagcgctgctgcgagacgttaacagaggagaaccggcgtctccaccgcgagctccagcagctccgcgccctcagccacccccacccggcagctgcctttttcatgcccgccgccgctgctctctccatctgtccctcctgcgagcgcatcgccaccggagcgtctgccgccgccaccaccaccggtgcagatcgccctaataaggccggtggtggccctgtccgagcaccgcacttgttcagccctttcaccaaatctgctgcctgctga

SEQ ID NO: 15243 - protein, 254 aa, Sorghum bicolor
  misc_feature: The sequence is a functional homolog of SEQ ID NO 2326 in the 10/374,780 US patent application
  misc_feature: The sequence is a functional homolog of SEQ ID NO 252 in the 10/412,699 US patent application
  misc_feature: The sequence is a functional homolog of SEQ ID NO 546 in the 11/479,226 US patent application
  misc_feature: The sequence is a functional homolog of SEQ ID NO 8 in the 10/225,068 US patent application
  misc_feature: The sequence is a functional homolog of SEQ ID NO 254 in the 10/412,699 US patent application
  misc_feature: The sequence is a functional homolog of SEQ ID NO 550 in the 11/479,226 US patent application
  misc_feature: The sequence is a functional homolog of SEQ ID NO 542 in the 11/479,226 US patent application
  misc_feature: The sequence is a functional homolog of SEQ ID NO 2328 in the 10/374,780 US patent application
  misc_feature: The sequence is a functional homolog of SEQ ID NO 524 in the 10/225,066 US patent application
  misc_feature: The sequence is a functional homolog of SEQ ID NO 553 in the 11/479,226 US patent application
  misc_feature: Useful for making plants with altered lignin content
  misc_feature: Useful for making plants with modulated biomass
  misc_feature: Functional homolog of the protein sequence given in SEQ ID NO 12880
  misc_feature: Useful for making plants with altered alkaloid content
  misc_feature: Functional homolog of the protein sequence given in SEQ ID NO 13109
  misc_feature: Ceres ANNOT ID no. 8639122
  misc_feature (156)..(200): Pfam ID: HALZ Pfam Description: Homeobox associated leucine zipper
  misc_feature (101)..(155): Pfam ID: Homeobox Pfam Description: Homeobox domain
MEQEEVGLALGLSLGSGHHQQLKEQPPPSSHPCALLEPTLSLSSLPAKDGLTTTPMRRIAAVKRELQVEEDDEATDRALIYSVASSAVVTADDDEGCNSRKKLRLSKEQSALLEDHFKEHSTLNPKQKAALARQLNLRPRQVEVWFQNRRARTKLKQTEVDCELLKRCCETLTEENRRLHRELQQLRALSHPHPAAAFFMPAAAALSICPSCERIATGASAAATTTGADRPNKAGGGPVRAPHLFSPFTKSAAC

SEQ ID NO: 15244 - DNA, 957 bp, Sorghum bicolor
  misc_feature: Ceres ANNOT ID no. 8639107
  misc_feature: Encodes the peptide sequence at SEQ ID NO 15245
atggctggcagaacttgtaagatcccacacgaccaaatttcggagaaggatgatgaccttggggagctggagttgattgacccactgagcatgcagcagctcgcggaatccctggccaacgagctctggagccagcagcagcctccacaacaagagcagcggccaacaaccacgggtttctcattcgctggggttgggggctctgcggcgacgggtgttggttgcaacaacatcttgatgtccttcaccaatgacggcggctcgtcgtcgtcgtcgtctaccacggtcgttgggactgcgaataattgctgcccaccactgacgatgctgccgctgacggagaagaaacaaggcacaggcagtggcggcggccggagggcgagctcgagcctgaaggagcacgtcgtcgcagagaggaagcgccgggagaagatgcacaaccagttcgccacgttagcgtccatcgtcccggacatcaccaagaccgacaaggtgtccgtcctgggcagcaccatcgagtacgtgcaccacctcaaggacaggctcaagacgctgcagcagaagaaggagcaccaccacttcgccggcagcggcagcggcacggcggagtcggagtcgccgccaccgtcggacgcacagtgctgtactactgggactggctccaaggacgatgaagctgttaacaagtccgatgatgagagcccaaagatcgaggtggacgtgcgagggaaaacgattttgctgagggtggtgtgccggcagaagaagggggtgctcatcatggtgctcacggagctgatcgaaaaccacggcctctccatcatcaacaccaacgtcgtgcccttcgccgaatcatcactcaacatcaccatcacggcacagattgaagacggaacttctagcacaggtgaacttgtgaacaatattacatctgctctaaataaaaaattaatgtaa

SEQ ID NO: 15245 - protein, 318 aa, Sorghum bicolor
  misc_feature: The sequence is a functional homolog of SEQ ID NO 1273 in the 10/666,642 US patent application
  misc_feature: The sequence is a functional homolog of SEQ ID NO 1702 in the 10/374,780 US patent application
  misc_feature: Ceres ANNOT ID no. 8639107
  misc_feature (131)..(179): Pfam ID: HLH Pfam Description: Helix-loop-helix DNA-binding domain
MAGRTCKIPHDQISEKDDDLGELELIDPLSMQQLAESLANELWSQQQPPQQEQRPTTTGFSFAGVGGSAATGVGCNNILMSFTNDGGSSSSSSTTVVGTANNCCPPLTMLPLTEKKQGTGSGGGRRASSSLKEHVVAERKRREKMHNQFATLASIVPDITKTDKVSVLGSTIEYVHHLKDRLKTLQQKKEHHHFAGSGSGTAESESPPPSDAQCCTTGTGSKDDEAVNKSDDESPKIEVDVRGKTILLRVVCRQKKGVLIMVLTELIENHGLSIINTNVVPFAESSLNITITAQIEDGTSSTGELVNNITSALNKKLM

SEQ ID NO: 15246 - DNA, 1488 bp, Sorghum bicolor
  misc_feature: Ceres ANNOT ID no. 8639180
  misc_feature: Encodes the peptide sequence at SEQ ID NO 15247
atgggcgcctattatcgccgcccctcgccgctccagcggcaactactccccacggcggtgctggtgctgctcgccatcgccgccagcagcagtggcttctcgagtgcggcggcggcggcgggccggaacgtgatcacgcacatcaagggattcgaaggcccgctgcccttccacctcgagacagggtacgtggaggtggacgaggagcacggcgcccggctcttctactacttcatcgagtcggagaggaatccggcggaggatccgctcatcctctggatcaccggcggccccggatgctccgcactctctggactcctcttcgagatcggccccctcaagttcgatgtggcggggtacacggaagggttcccgcggctggtctacttcgaggattcatggaccaaggtgagcaacgtcatcttcctggacgcgccggtgggcacgggcttctcctactccgtcgaggaggcggggctcaacgtcagcctgacggagtccgggcggcagcaccatgcgttcctgcgcaaatggctggcggagcacccggagttcgcgtccaacccgctctacatcggcggcgactcctactccggctacaccgtgcccgtggcggcgatggacatcgccgccagcccgcctgatgaccccaagaagccgaacctggtgggctacctggtgggcaacgccggcacggacgaccggtacgacacgggcggcaaggtgccgttcatgcacggcatggggctcatctccgacgagctgtacgaggccgccaagctgggctgcggcggcgacttctacaagacgccggaccccacgaacgcgcagtgcgccagcgccatgtttgccatcaacatggtgaccttcgccgtgaaccccgtgcacattctggagcccttctgcggcgccgccgtgcgagtcggtagcattttccagggctatggcggcggcgacggcggcggcaggcggtcgatgctggtgcaggacgacgtcgcccacccgggattcttggcgaagcagaggctgaacctgccggtggagtgcagggacaacgggtaccggctgtcctacatctgggcggacgacccggaggtgagggaggcgctgggcatccacgagggctccatcggctcgtggagtcgatgcaccatgctgacgcacttcaggcacgacctcgccaccgtcatcccttaccatgtcaaccttaccaaggcaggctacagggcgctcgtctacaacggcgatcatgacatggacatgacctacgtgggcacccaagagtggatcagaaccatgggctaccccatcgtcagcgactggagaccatggtacgccaaccgacaggtcgcagggttcacaaggacttacgcccacaacctcacttttgccactgtgaagggaggagggcacacagctccggagtacaggcccaaagagtgccaggccatgttggatcgatggacatcagcagcaggccaactctga

SEQ ID NO: 15247 - protein, 495 aa, Sorghum bicolor
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14160
  misc_feature: Ceres ANNOT ID no. 8639180
  misc_feature (43)..(302): SWISSPROT Homolog: EC 2.3.1.92 Sinapoylglucose--malate O-sinapoyltransferase
  misc_feature (50)..(491): Pfam ID: Peptidase_S10 Pfam Description: Serine carboxypeptidase
MGAYYRRPSPLQRQLLPTAVLVLLAIAASSSGFSSAAAAAGRNVITHIKGFEGPLPFHLETGYVEVDEEHGARLFYYFIESERNPAEDPLILWITGGPGCSALSGLLFEIGPLKFDVAGYTEGFPRLVYFEDSWTKVSNVIFLDAPVGTGFSYSVEEAGLNVSLTESGRQHHAFLRKWLAEHPEFASNPLYIGGDSYSGYTVPVAAMDIAASPPDDPKKPNLVGYLVGNAGTDDRYDTGGKVPFMHGMGLISDELYEAAKLGCGGDFYKTPDPTNAQCASAMFAINMVTFAVNPVHILEPFCGAAVRVGSIFQGYGGGDGGGRRSMLVQDDVAHPGFLAKQRLNLPVECRDNGYRLSYIWADDPEVREALGIHEGSIGSWSRCTMLTHFRHDLATVIPYHVNLTKAGYRALVYNGDHDMDMTYVGTQEWIRTMGYPIVSDWRPWYANRQVAGFTRTYAHNLTFATVKGGGHTAPEYRPKECQAMLDRWTSAAGQL

SEQ ID NO: 15248 - DNA, 1842 bp, Sorghum bicolor
  misc_feature: Ceres ANNOT ID no. 8639246
  misc_feature: Encodes the peptide sequence at SEQ ID NO 15249
atgaagtacagcaaggaagataagcccgagagggcgggaggcgccggcgcagggtccagggcggtgccggtgacgctcgtcgtcatcgtgctctgcgccttctccttctacctcggcggcatctacagcacggggcggagcctcctggacgccatccagccggcgccaacgactctggtcaccctcggcggcggcggcaccaccaccacaacgacccgtcgttcctccgacaacgaccaagcacggccggcactggccgccgtggcgttccccgagtgccccgccgacctgcaggactacaccccctgcaccgaccccaagcgctggcggcggtacggcaactaccgcctgagcttcatggagcggcactgcccgccgccgcccgaccggcagcagtgcctggtgccgccgcccaaggggtacaagccgcccatccggtggcccaagagcaaggaccactgctggtaccggaacgtcccctacgactggatcaacagccagaagtccaaccagcactggctcgtcaaggaaggcgaccgcttccgcttccccggcggcggcaccatgttccccaacggcgtcggcgagtacgtggacctgatgcagggcctcatcccgggcatgcgcgacggcaccgtccgcaccgcgctcgacaccggctgcggcgtcgccagctggggcggcgacctgctgggcaggggcatcctcaccgtctccctcgccccccgggacaaccacgaggcccaggtgcagttcgcgctggagcgcggcatcccggccatcctcggcatcatctccacgcagcgcctgccgttcccgtccgccgccttcgacatggcgcactgctcccgctgcctcatcccctggaccgagttcggcggcctctacctcctggagatccaccgcgtcctccgcccgggcgggttctgggtgctctccggcccgcccgtcaactacgagaaccggtggcacggctggaacaccacggcgcaggcgcagaaggccgacttcgacaggctcaagaagatgctggccagcatgtgcttcaagctctacaacatgaagggagacatcgccgtgtggcagaagtccggcgacgccaccgcctgctacgacaagctcaccgcgatcaccacgcccgccaagtgcgacgacagcgtcgacccggacgccgcctggtacgtgcccatgcgctcctgcgtcacggcgcccagcgccaagtacaagaagctggggctcaacgccacgcccaagtggccccagaggctcgccgtcgcgccggagcgcatcaacgtcgtcccgggcagcagcgccgccgccttcaagcaggacgacgccaggtggaagctcagggccaagcactacaagacgctgctgccggcgctggggagcgacaagatcaggaacgtcatggacatgaacaccgtgtacggaggcttggccggcagcctcatcaaggaccccgtctgggtcatgaacgtcgtctcctcctacgggccaaactccctcggcgtcgtctacgacagagggctcatcggcgtcaaccacgactggtgtgaggcgttctcgacatatccacgcacctatgatctattgcatcttgatggcctgttcacagcagagtctcacaggtgcgagatgaagttcgtactccttgagatggaccgcatccttcgtcccacgggttatgccataatccgggagagcacctacttccttgattctgtggcaccgattgccaaaggaatgagatggagctgcgagaagcataacaccgagaacaaggctgacaaggacaagatcctcatctgccagaaaaagctttgggcaggaaagcagtga

SEQ ID NO: 15249 - protein, 613 aa, Sorghum bicolor
  misc_feature: The sequence is a functional homolog of SEQ ID NO 2546 in the 10/374,780 US patent application
  misc_feature: The sequence is a functional homolog of SEQ ID NO 760 in the 10/412,699 US patent application
  misc_feature: The sequence is a functional homolog of SEQ ID NO 824 in the 10/225,066 US patent application
  misc_feature: Ceres ANNOT ID no. 8639246
  misc_feature (207)..(310): SWISSPROT Homolog: EC 2.1.1.41 Sterol 24-C-methyltransferase
  misc_feature (228)..(312): Pfam ID: Methyltransf_11 Pfam Description: Methyltransferase domain
MKYSKEDKPERAGGAGAGSRAVPVTLVVIVLCAFSFYLGGIYSTGRSLLDAIQPAPTTLVTLGGGGTTTTTTRRSSDNDQARPALAAVAFPECPADLQDYTPCTDPKRWRRYGNYRLSFMERHCPPPPDRQQCLVPPPKGYKPPIRWPKSKDHCWYRNVPYDWINSQKSNQHWLVKEGDRFRFPGGGTMFPNGVGEYVDLMQGLIPGMRDGTVRTALDTGCGVASWGGDLLGRGILTVSLAPRDNHEAQVQFALERGIPAILGIISTQRLPFPSAAFDMAHCSRCLIPWTEFGGLYLLEIHRVLRPGGFWVLSGPPVNYENRWHGWNTTAQAQKADFDRLKKMLASMCFKLYNMKGDIAVWQKSGDATACYDKLTAITTPAKCDDSVDPDAAWYVPMRSCVTAPSAKYKKLGLNATPKWPQRLAVAPERINVVPGSSAAAFKQDDARWKLRAKHYKTLLPALGSDKIRNVMDMNTVYGGLAGSLIKDPVWVMNVVSSYGPNSLGVVYDRGLIGVNHDWCEAFSTYPRTYDLLHLDGLFTAESHRCEMKFVLLEMDRILRPTGYAIIRESTYFLDSVAPIAKGMRWSCEKHNTENKADKDKILICQKKLWAGKQ

SEQ ID NO: 15250 - DNA, 585 bp, Sorghum bicolor
  misc_feature: Ceres ANNOT ID no. 8639289
  misc_feature: Encodes the peptide sequence at SEQ ID NO 15251
atggggcaggccttccggaagctcttcgatgccttcttcggcaacaaggagatgcgggtggtgatgcttgggttggatgcagctgggaaaaccaccatactctataagcttcacattggtgaagttctctccactgtccccacgataggtttcaatgttgagaaggttcagtacaagaatgtagtgttcactgtgtgggatgttggtggccaggagaagctcaggcccttgtggaggcactacttcaacaacactgatgctctgatttacgtggttgattcactggatagagagagaatcgggagagccagggcggaatttcaggctataatcaatgacccttttatgcttaacagtgtgctattggtgtttgctaacaagcaagacatgaggggagctatgactccgatggaagtgtgtgagggtcttgggctgtatgacctgacgaaccgcatctggcacatccagggcacctgcgctctgaaaggcgatggcctgtatgaagggttggactggctagcgaccactctggatgaaatgcgtgcttctggacgcataacctcagcatcatcatcagcgtcctga

SEQ ID NO: 15251 - protein, 194 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 12945
  misc_feature: Useful for making plants with modulated nitrogen use efficiency
  misc_feature: Functional homolog of the protein sequence given in SEQ ID NO 14003
  misc_feature: Useful for making plants with altered terpenoid content
  misc_feature: Functional homolog of the protein sequence given in SEQ ID NO 13081
  misc_feature: Ceres ANNOT ID no. 8639289
  misc_feature (5)..(177): Pfam ID: Arf Pfam Description: ADP-ribosylation factor family
MGQAFRKLFDAFFGNKEMRVVMLGLDAAGKTTILYKLHIGEVLSTVPTIGFNVEKVQYKNVVFTVWDVGGQEKLRPLWRHYFNNTDALIYVVDSLDRERIGRARAEFQAIINDPFMLNSVLLVFANKQDMRGAMTPMEVCEGLGLYDLTNRIWHIQGTCALKGDGLYEGLDWLATTLDEMRASGRITSASSSAS

SEQ ID NO: 15252 - DNA, 1473 bp, Sorghum bicolor
  misc_feature: Ceres ANNOT ID no. 8639307
  misc_feature: Encodes the peptide sequence at SEQ ID NO 15253
atggtggtgaggccgtcttggagccctcaattgtgcgggcgcaacgcgagctcctcccggtcccttgaccgagagcagaatcatgtcatagccaaagtcggtagacatgaactcgaggctcccgaaccaaatcaccgtggaattttgatcgacccacaatatataatagattgtaacatcagtagtatcatgtgcgacttcttttggctgtcgccggccgatcaagcaggcgacctctcggacgttgtccgggcgagcctgcagccaccgccgccgccgcctcaccaccaccgactgccgccgccggaggaggaagaggggttgctgctgctgcaagcccgagtgaacttcgatggcgacgatcacgatgaagcgcgctcgcagcagctggtgcatggcaatggcagcatgaggctcatgctgggcagcaacggcagtggcggctgcgcttgtgatcatgctgctgccctgtgtccccagcaccatccagaggcagagcgactgattcctcagccgcccatgtccgggccgcagccacagttgtgcgctgcttccagcttcgtcgtcgagagggacgatgatgatgctcccgttctggaggagcatgtcctcgacatggcgacggcccctcaccctcatcctcatacctcggcaatcaagcgaaggaagagccagacgaagaaggtggtgtgcatccctgcgccggtggcagcgccgccaccgggggtgggcgggcggccgagcacgagcggcgaggtggtgccgtcggacctgtgggcgtggaggaagtacgggcagaagccgatcaaggggtcgccgtacccgagggggtactaccgctgcagcagctccaaaggctgctccgcccgcaagcaggtggagcgcagccgcaccgacccttccatgctcgtcatcacctacacctccgaccacaaccacccatggccgacgcagcgcaacgcgctcgctggctcgaccaggccggccttctcctcctcgtcggcggccaggagtcatcaccatcaccaccatcaccatcactccgcggctgccgttccggatacgacactggcccaccgtcacgccagcaacgtcgccgtcgccgacaatgcgacgccagggtggtccatcattagcgccagtgttcatcaccagctgctcaagcaggaggtggtcgacgtggataaccaccccatcagcaagcagccggcgcaggacgctgcagctgaccgtgactgcttggacatgtttgctgatatggacggcgccctcgacgtcctgtgcgcctccaacttccacccaaaaaagcagcaacagcaggtcactgctgctcagcacttggagaagctgccggaggaagaagacgagcacttgctgctgggtccggatcctttcagcttcagcttcttggactgggttggcgcttcatttggagttggagagacagcagcagataacggtgatcacagttag

SEQ ID NO: 15253 - protein, 490 aa, Sorghum bicolor
  misc_feature: Useful for making plants with modulated biomass
  misc_feature: Functional homolog of the protein sequence given in SEQ ID NO 13583
  misc_feature: Ceres ANNOT ID no. 8639307
  misc_feature (255)..(315): Pfam ID: WRKY Pfam Description: WRKY DNA -binding domain
MVVRPSWSPQLCGRNASSSRSLDREQNHVIAKVGRHELEAPEPNHRGILIDPQYIIDCNISSIMCDFFWLSPADQAGDLSDVVRASLQPPPPPPHHHRLPPPEEEEGLLLLQARVNFDGDDHDEARSQQLVHGNGSMRLMLGSNGSGGCACDHAAALCPQHHPEAERLIPQPPMSGPQPQLCAASSFVVERDDDDAPVLEEHVLDMATAPHPHPHTSAIKRRKSQTKKVVCIPAPVAAPPPGVGGRPSTSGEVVPSDLWAWRKYGQKPIKGSPYPRGYYRCSSSKGCSARKQVERSRTDPSMLVITYTSDHNHPWPTQRNALAGSTRPAFSSSSAARSHHHHHHHHHSAAAVPDTTLAHRHASNVAVADNATPGWSIISASVHHQLLKQEVVDVDNHPISKQPAQDAAADRDCLDMFADMDGALDVLCASNFHPKKQQQQVTAAQHLEKLPEEEDEHLLLGPDPFSFSFLDWVGASFGVGETAADNGDHS

SEQ ID NO: 15254 - DNA, 1722 bp, Sorghum bicolor
  misc_feature: Ceres ANNOT ID no. 8639324
  misc_feature: Encodes the peptide sequence at SEQ ID NO 15255
atgcaggacgccgtggcggcctccggacccgccaatgccgccgccaccttctactccgccgccaccggcgtgtacgccagcacgcaccctccggtggctctcccctccgacccttccctctccctcgtcccgcacatcttcgcccgcctgcccgccgcccgccccgacgccccggccctcctcgacgccgccaccgccgaggccctctcccgcgccgacctccgccgcctcgtctccgccctcgcggcgggcctccgccgccgcgggggcctccgcgggggcgatgtcgtgctcctcgccctgcccaactccgtcgccttccccgtcgcgttcctcgccgtcctcgccgccgggtccgtcgccaccaccatgagcccgtccagcgcccccgccgagatcgccgccagggttcgggacaccagccccgccctcgtgttcgccgcgcccgacaacgtcgggaagctcccgccgttgcgcgtcccggtcgtcctcgtccccgacgccttccaccacctcggggacgacggcgcccccgagttcgcgcccttccgcgagttgctgctgttcgattccgagccactgatggcccctccggtgggacaggacgacgcggccgccatcctctactcgtcggggacgggcggccggagcaagggcgtcgtgctcacgcaccgcaacctcatcgccacggtcgagctcttcgtgcgcttcgaggcctcgcagtacgccgcacctgcttgtgacaatgtctacctggcggcgctgcccatgttccacgtctacggactcgcgctcttcgccgtgggcctgctctcgctcggttccacggtggtcgtcatgaagaggttcgacgcgggcgacgccgttaaggccatccacagattcaaggtcacgcacttcccggtcgttccgcccatcatggcggctctggtgcacgccaccaagccagcggcaatgccgttggaatccttggtgcaggtgtccaccggtgcagcgccgtccagcggcaggctcatcgacgactttgtcaaggctttcccccacgtcgatttcattcagggttatggcatgactgaatctgctgctgtaggaactcgtggcttcaatacaaagcagaagaagtatgcttcagtaggactcctcgctccaaacatgcatgcaagaattgttcatatggaaactgcttgctgcctgcctccaggctcttgtggggagctctggctccatggtccagctataatgaaaggttacttgaatcatcaggattcacgtgcaataaatgatggctggctgcgaaccggtgacattgcttacttcgatttcgatgggtacttgtacatagtgggccgcttgaaagaggtgatcaagtacaaaggatttcagatagctccagctgacttggaagcaattttgatcgaacaccctggaattgttgatgtggctgtgacatctactgaggataaagaagctggagagataccagttgccttcgtggtgaggaaatctggaagtggcctttcatgcactcaagtgatggattatgtggccaagcaggtgtccccgtataagaaggtgcggaaggtggtgttcgtggagtcgatccccaagtcgccggctggaaaggttctgaggaggcttctcaaggactctcttgcagctagcgctgttgctggtccaacaagttattctgagtccaatcccatgcgccattcgagactgtaa

SEQ ID NO: 15255 - protein, 573 aa, Sorghum bicolor
  misc_feature: Useful for making plants with altered cell wall content and/or composition
  misc_feature: Functional homolog of the protein sequence given in SEQ ID NO 14161
  misc_feature: Ceres ANNOT ID no. 8639324
  misc_feature (102)..(553): SWISSPROT Homolog: EC 6.2.1.12 4-coumarate--CoA ligase
  misc_feature (70)..(482): Pfam ID: AMP-binding Pfam Description: AMP-binding enzyme
MQDAVAASGPANAAATFYSAATGVYASTHPPVALPSDPSLSLVPHIFARLPAARPDAPALLDAATAEALSRADLRRLVSALAAGLRRRGGLRGGDVVLLALPNSVAFPVAFLAVLAAGSVATTMSPSSAPAEIAARVRDTSPALVFAAPDNVGKLPPLRVPVVLVPDAFHHLGDDGAPEFAPFRELLLFDSEPLMAPPVGQDDAAAILYSSGTGGRSKGVVLTHRNLIATVELFVRFEASQYAAPACDNVYLAALPMFHVYGLALFAVGLLSLGSTVVVMKRFDAGDAVKAIHRFKVTHFPVVPPIMAALVHATKPAAMPLESLVQVSTGAAPSSGRLIDDFVKAFPHVDFIQGYGMTESAAVGTRGFNTKQKKYASVGLLAPNMHARIVHMETACCLPPGSCGELWLHGPAIMKGYLNHQDSRAINDGWLRTGDIAYFDFDGYLYIVGRLKEVIKYKGFQIAPADLEAILIEHPGIVDVAVTSTEDKEAGEIPVAFVVRKSGSGLSCTQVMDYVAKQVSPYKKVRKVVFVESIPKSPAGKVLRRLLKDSLAASAVAGPTSYSESNPMRHSRL

SEQ ID NO: 15256 - DNA, 3495 bp, Sorghum bicolor
  misc_feature: Ceres ANNOT ID no. 8639339
  misc_feature: Encodes the peptide sequence at SEQ ID NO 15257
atggcgtccaaggggatcctcaagaacagcggctccagccgcatgccgccgtcgcagagcgccggcaagccgcccaccgcgcccacgtcggcgcccacggtcgtcttcggccgccggaccgactctggccgcttcatcagctactcgcgcgacgacctcgactcggagatcagcagcgtcgacttccaggactaccacgtccacatccccatgacgcccgacaaccagcccatggacgacgacgatggcggcggcggcggcacggccagggccgaggagcgctacgtctccggctcgctcttcaccggcggcttcaacagcgtcacccgcgcgcacgtcatggacaacaagaccgacgacgacgcagccgccgccggcgggcgccgcggcaagggacccagcgcgtgcatggtcgaggggtgcgacgccagggccatgcgcgacgcccgcggcgacgacgtcctcccctgcgagtgcgacttcaggatctgcgtcgactgcttcaccgacgccgtcaaggccggcggcggcgcctgccccgggtgcaaggagccttacaagaacaccgagtgggaggaccttgccgccggtggcgcggccgagaccacgcgggcgctctcgctgccccgcgggcctgcgggcgccaatggccaccacaagatggacaggcgcctgtcgttggtcaagcagaccaacgtcaaccagtccggcgagttcgatcataaccgctggctcttcgagacaaagggcacctatggctatggcaatgccatctggccccaggatggcacagaagacgacaccgatggcggcgccccagctggacctgggcaccccaaggagctcttgaccaaaccgtggcgcccgctgacccgcaagctcaggattccagctgccgtcatcagtccttacagactcctcgtcctgatccgattggtcgcactggccttcttcctcatgtggcgtatcaagcaccaaaatgaggacgccatctggctctggggaatgtcaattgtctgcgagctctggtttgctttctcatgggtactggaccagcttccaaagctgtgccccatcaaccgtgcaacagacctctccgtgctcaaggagaagtttgagatgcccacacctaacaatccaacaggcaaatccgatctccctggaattgacatatttgtgtcaactgctgatccggagaaggaaccagtcctggtcactgcaaacacaattctctccattctcgcggctgactaccctgttgagaagcttgcgtgttatctgtcagatgatggaggggcactgctcaccttcgaagcaatggctgaagcagcgagctttgccaatctttgggtgccattctgcaggaagcatgacattgaacccaggaaccctgacagctacttcaacctcaagagagatcccttcaagaacaaggtgaagccagactttgtcaaggacagaagacgcattaagcgtgaatatgatgagttcaaggtccgtgttaatggcttgccagatgccatccgccgccgctctgatgcataccatgctcgtgaagagatccaggcaatgaatcttcagagggaaaaattgaagggtggcggtgacgaaccgtttgagccagtgaagattcccaaggcaacatggatggctgatggcactcactggcccggtacctggctccagccttcacaggatcatgctcgaggtgatcatgcaggaattatacaggttatgctgaaaccaccaagtgacatgccgatgtacgggaacatcaatgaaaagacacctcttgactttgcaggagtggatacacggcttccaatgctggtgtatgtatcaagagagaagcgcccaggatatgatcataataagaaagcaggtgctatgaatgcattagtccgtgcatcagcaatcatgtccaatggtccattcattcttaatctggattgtgatcactatatctacaactcaaaggccttaagggagggcatgtgtttcatgatggaccgtggtggtgaccgcctctgctatgtgcagttcccacagcgatttgaaggtatcgacccttctgatcgttatgccaatcacaatacagttttcttcgatgtcaacatgcgcgcacttgatggtcttcaaggaccagtgtacgttggtactggatgcctcttccgtcgaattgccctttatggctttgacccaccccgttccaaggatcacagcccaggattctgtagttgctgtctcccacgccgccgtaaggcatcagcttccaatgctaaccctgaggagacaatggctcttcgcatgggtgattttgatggagacagcatgaaccttgcaacattcccaaagaagtttggaaactcaagctttctgattgactccattccagtagcagagttccagggtagacccttggctgaccatccatctgtgaagaatgggcgtccacctggtgctctaacaatccctcgtgaaatgctagatgcatccatcgtagcagaagcaatcagtgtgatctcatgttggtatgaggagaagacagaatggggtatacgggtggggtggatctatgggtctgtcactgaggatgttgtgacagggtatcgcatgcacaatcgtgggtggaagtcagtatactgtgtcacacagcgtgatgccttccgtggcactgctcctatcaaccttaccgatcggcttcaccaggtgcttcgatgggccactggttcggttgaaatcttcttctcccgcaacaatgcattgtttgccagctccaagatgaaggtgctccaaaggattgcataccttaatgttggtatctatcccttcacatccatcttcctcattgtctactgtttccttccagcactctccctcttctcaggacagttcattgtgcaaacgctcaacgttaccttcctgacatacctacttatcatcaccatcactctttgcctcttggccatgttggagatcaagtggtctggcattgctcttgaggagtggtggcgaaatgaacaattctggctcattggtggaactagtgcccacctggctgctgtgctgcagggtcttctaaaagtgattgcagggattgagatctcgtttacactcacttcaaaacaagtgggtgatgatgtagaggatgaatttgcagaactgtacatagtgaaatggacatcattaatgataccaccgctcaccatcatcatgatcaaccttgttgccattgctgttggattcagccggacgatttacagcacaattccacaatggagcaagctgcttgggggagtgtttttcagcttctgggtgcttgctcatttgtatccatttgcaaaggggctcatgggaaggagaggaaggacacccactattgtgtatgtctggtctggactcgtttccatcaccatctcattgctctggattgcaatcaagcctccatcacaagctgccaactcgcaattcggtgggtcattttctttcccttga

SEQ ID NO: 15257 - protein, 1164 aa, Sorghum bicolor
  misc_feature: Useful for making plants with altered cell wall content and/or composition
  misc_feature: Functional homolog of the protein sequence given in SEQ ID NO 14162
  misc_feature: Useful for making plants with modulated plant growth and development
  misc_feature: Functional homolog of the protein sequence given in SEQ ID NO 13629
  misc_feature: Useful for making plants with altered carbohydrate content
  misc_feature: Functional homolog of the protein sequence given in SEQ ID NO 13628
  misc_feature: The sequence is a functional homolog of SEQ ID NO 6 in US patent 7285702
  misc_feature: Useful for making plants with modulated biomass
  misc_feature: Functional homolog of the protein sequence given in SEQ ID NO 14059
  misc_feature: The sequence is a functional homolog of SEQ ID NO 2 in US patent 7049481
  misc_feature: Ceres ANNOT ID no. 8639339
  misc_feature (607)..(1148): SWISSPROT Homolog: EC 2.4.1.12 Cellulose synthase (UDP-forming)
  misc_feature (289)..(1160): Pfam ID: Cellulose_synt Pfam Description: Cellulose synthase
MASKGILKNSGSSRMPPSQSAGKPPTAPTSAPTVVFGRRTDSGRFISYSRDDLDSEISSVDFQDYHVHIPMTPDNQPMDDDDGGGGGTARAEERYVSGSLFTGGFNSVTRAHVMDNKTDDDAAAAGGRRGKGPSACMVEGCDARAMRDARGDDVLPCECDFRICVDCFTDAVKAGGGACPGCKEPYKNTEWEDLAAGGAAETTRALSLPRGPAGANGHHKMDRRLSLVKQTNVNQSGEFDHNRWLFETKGTYGYGNAIWPQDGTEDDTDGGAPAGPGHPKELLTKPWRPLTRKLRIPAAVISPYRLLVLIRLVALAFFLMWRIKHQNEDAIWLWGMSIVCELWFAFSWVLDQLPKLCPINRATDLSVLKEKFEMPTPNNPTGKSDLPGIDIFVSTADPEKEPVLVTANTILSILAADYPVEKLACYLSDDGGALLTFEAMAEAASFANLWVPFCRKHDIEPRNPDSYFNLKRDPFKNKVKPDFVKDRRRIKREYDEFKVRVNGLPDAIRRRSDAYHAREEIQAMNLQREKLKGGGDEPFEPVKIPKATWMADGTHWPGTWLQPSQDHARGDHAGIIQVMLKPPSDMPMYGNINEKTPLDFAGVDTRLPMLVYVSREKRPGYDHNKKAGAMNALVRASAIMSNGPFILNLDCDHYIYNSKALREGMCFMMDRGGDRLCYVQFPQRFEGIDPSDRYANHNTVFFDVNMRALDGLQGPVYVGTGCLFRRIALYGFDPPRSKDHSPGFCSCCLPRRRKASASNANPEETMALRMGDFDGDSMNLATFPKKFGNSSFLIDSIPVAEFQGRPLADHPSVKNGRPPGALTIPREMLDASIVAEAISVISCWYEEKTEWGIRVGWIYGSVTEDVVTGYRMHNRGWKSVYCVTQRDAFRGTAPINLTDRLHQVLRWATGSVEIFFSRNNALFASSKMKVLQRIAYLNVGIYPFTSIFLIVYCFLPALSLFSGQFIVQTLNVTFLTYLLIITITLCLLAMLEIKWSGIALEEWWRNEQFWLIGGTSAHLAAVLQGLLKVIAGIEISFTLTSKQVGDDVEDEFAELYIVKWTSLMIPPLTIIMINLVAIAVGFSRTIYSTIPQWSKLLGGVFFSFWVLAHLYPFAKGLMGRRGRTPTIVYVWSGLVSITISLLWIAIKPPSQAANSQFGGSFSFP

SEQ ID NO: 15258 - DNA, 1056 bp, Sorghum bicolor
  misc_feature: Ceres ANNOT ID no. 8639373
  misc_feature: Encodes the peptide sequence at SEQ ID NO 15259
atggcatcatcaagtgctaccctcgctttcctgacgctcagctgggcggcggttctcgccggcgcgtcgctggacacgtcgccggtgacgttccacgccggctacatgccgctgttcggcgggggcaacctcgtgccgtcgcccggcggccgctccgtccgcctcaaacttgaccgccacaccggctccgggttcgtatcaaagtcggcttaccaccatggattcttcagtgcttccatcaagctgcccgacgatgacaccgccggtgtcgtcgtcgccttctatctgtcgaacgccgacgtgttccccggcaaccacgacgaggtggacttcgagctactgggcaaccgccgtggccacgagtggcgcgtgcagaccaacatctacggcaacggcagcacctcccgcggccgcgaggagcggtacctcctccccttcgaccccaccctccggccgcacgcctacgccgtcgcctggacccccacggccatcctcttctacgtcgacgggacgcccatccgcgaggtggtccgcgttccggccatgggcggcgacttcccgtccaagcccatgtccgtgtacgccaccatctgggacggctccgcctgggccaccgagggcggacgctacaaggtcgactacgccttcgcgcccttcgccgccgacttctcctcgctcgtcctcagcggctgcggccccgtcgccgccgccgacgacgacgacgacgccgagtgccaggtcgccgcgatgacggcggactgcgccgtcatgacccccgccaagcgcgccgccatgcggcgcttccgccggcggtacctcctctacacggtgtgccacgacatgtaccgctacaacggcaccgtcttccccgagtgcgacgccgacgactcggaacgccacgacttccacaggtggggcgagtccaagcgcgtgtcgcccagcagccgcgggtacaagcagccgcgcgcggacaaggccgccgccgtcgacgtcgccgtcgccgcgcctggacggcccgacacgtggccggtcattggaacgttacgtgtcgactaa

SEQ ID NO: 15259 - protein, 351 aa, Sorghum bicolor
  misc_feature: Useful for making plants with altered carbohydrate content
  misc_feature: Functional homolog of the protein sequence given in SEQ ID NO 13697
  misc_feature: Useful for making plants with altered cell wall content and/or composition
  misc_feature: Functional homolog of the protein sequence given in SEQ ID NO 13698
  misc_feature: Ceres ANNOT ID no. 8639373
  misc_feature (29)..(231): SWISSPROT Homolog: EC 2.4.1.207 Xyloglucan:xyloglucosyl transferase
  misc_feature (31)..(216): Pfam ID: Glyco_hydro_16 Pfam Description: Glycosyl hydrolases family 16
  misc_feature (245)..(292): Pfam ID: XET_C Pfam Description: Xyloglucan endo-transglycosylase (XET) C-terminus
MASSSATLAFLTLSWAAVLAGASLDTSPVTFHAGYMPLFGGGNLVPSPGGRSVRLKLDRHTGSGFVSKSAYHHGFFSASIKLPDDDTAGVVVAFYLSNADVFPGNHDEVDFELLGNRRGHEWRVQTNIYGNGSTSRGREERYLLPFDPTLRPHAYAVAWTPTAILFYVDGTPIREVVRVPAMGGDFPSKPMSVYATIWDGSAWATEGGRYKVDYAFAPFAADFSSLVLSGCGPVAAADDDDDAECQVAAMTADCAVMTPAKRAAMRRFRRRYLLYTVCHDMYRYNGTVFPECDADDSERHDFHRWGESKRVSPSSRGYKQPRADKAAAVDVAVAAPGRPDTWPVIGTLRVD

SEQ ID NO: 15260 - DNA, 1146 bp, Sorghum bicolor
  misc_feature: Ceres ANNOT ID no. 8639432
  misc_feature: Encodes the peptide sequence at SEQ ID NO 15261
atggctcccatcttcgccgcggcgtcccacgcgtccctcctccccctctcccacgtcgaccgccccgccgccggccgcctagtccgtggcactctcaggccccacacctcgggcctccgcttgcgccgccccccgggggcaaccgggcgcggccgcgggcgtggccgaggaggcatccccgacgagtggggcgagcgttcgccgccaggcgcccccgaggcccccgcgcagcccgatccgctcatcgacgacgaggacgactccgccgacggcaactcacgccctatcgtcgtcgacgagtggggcgagcccggggcgcccgagcccgagccgccctccgccgcggacccgcctagccccgccgcagacgacgagtgggaggaggagccagaggcgtcggtgccggacccgaccccggctccggcggcggcggaggaggacgagcaggcggtgaagagggaggagctcaagcgctgcttggtggacacggtgtacggctccgacctcggcttccgggcgtccacggaggtcagaggggaggtcgtcgagctagtcacccagctcgaggcggctaaccctactacggcgcccgtcgagacatcggatctcctcgacggcaactggatcctcatatatacagcatattccgagcttctgcctattctagctgctggggcaacacctttggtcaaagtaaagcagatatcccaagaaattgactccaaaagcatgacgatagtcaatgcttcaacccttacgactccattcgcatcattttcattcagcgcaactgcctcttttgaggttcaaagtccgtcaagaatagaggtccaatttaaggaggggagctttcagcctccggtaatatcatcatctgtggatctacctcaacaaattgatatatttgggcagaagatcagcctggggccagtccagcaggcactgaatccattgcagcaagcatttgctagcattgcagggtccatttctgggcagccacccctcaaggtaccgattcccggcaacaacagagctcgatcctggctcttgactacctacctggacaaagacttaaggatctcgagaggtgatggaggcttgtttattcttgcgaaagaggggagccctttgctagatctattgtaa

SEQ ID NO: 15261 - protein, 381 aa, Sorghum bicolor
  misc_feature: Useful for making plants with modulated nitrogen use efficiency
  misc_feature: Functional homolog of the protein sequence given in SEQ ID NO 13149
  misc_feature: Ceres ANNOT ID no. 8639432
  misc_feature (154)..(371): Pfam ID: PAP_fibrillin Pfam Description: PAP_fibrillin
MAPIFAAASHASLLPLSHVDRPAAGRLVRGTLRPHTSGLRLRRPPGATGRGRGRGRGGIPDEWGERSPPGAPEAPAQPDPLIDDEDDSADGNSRPIVVDEWGEPGAPEPEPPSAADPPSPAADDEWEEEPEASVPDPTPAPAAAEEDEQAVKREELKRCLVDTVYGSDLGFRASTEVRGEVVELVTQLEAANPTTAPVETSDLLDGNWILIYTAYSELLPILAAGATPLVKVKQISQEIDSKSMTIVNASTLTTPFASFSFSATASFEVQSPSRIEVQFKEGSFQPPVISSSVDLPQQIDIFGQKISLGPVQQALNPLQQAFASIAGSISGQPPLKVPIPGNNRARSWLLTTYLDKDLRISRGDGGLFILAKEGSPLLDLL

SEQ ID NO: 15262 - DNA, 2130 bp, Sorghum bicolor
  misc_feature: Ceres ANNOT ID no. 8639463
  misc_feature: Encodes the peptide sequence at SEQ ID NO 15263
atgaacctgtggacggacgacaacgcctccatgatggaggcctttatggcctccgccgacctccccaccttcccctggggggcgacggccgggggcggcaactcgtcggccgccgctgcgacgccgccgccgccgccgcagatgccggcggcggcgatggcgccggggttcaaccaggacacgctgcagcagcggctgcaggccatgatagaagggtccagcgagacatggacctatgccatcttttggcagtcctccctggacgccgccaccggcgcctcgctgctcggctggggggacggctactacaagggctgcgacgacgacaagcgcaagcagaggccgctcacgcccgccgcccaggccgagcaggagcaccgcaagcgcgtgctccgcgagctcaattccctcatctccggcgccgccgcggcgcccgacgaggccgtcgaggaggaggtcaccgacaccgagtggttcttcctcgtctccatgacgcagtcgttcctcaacgggtccgggctccccgggcaggcgctcttcgcggggcagcccacctggatcgcctctggcctctcctccgcgccgtgcgagcgcgcgcgccaggcctacaacttcggcctccgcaccatggtctgcttccccgtcggcaccggggtgctcgagctcggctccaccgacgtcgtgttccagaccgccgagagcatggccaagatccgctcgctcttcgggggcggagcagggggtggctcgtggccgcccgtgcagcctcaggcgccgtcgcatcagcagcccgcggccggacccgaccaggcggagacggacctatggctcgccgacgcgccggtcatggacatcaaagattccatgtcgcacccgtcggctgagatctccgtctccaagccgccgccgccgccgccgccgccacagatccattttgagaacgcgagcacgagcacgctcacggagaaccccagcccatccgtgcacgcggcgccaccccagccggcgccggccgctgcaccgcagcggcagcaccagcaccagaatcaggctcaccagggccccttccgccgggagctcaatttctccgactttgcgtccaccaacccttcttccttggcggcgaccccgcccttcttcaagcccgagtccggcgagatcctcagcttcggcgccgacagcaacgcccggaggaacccgtcgccggctcctcccgccgccaccgccagcctcaccaccgctcccgggagcctcttctcgcagcacacggcgaccatgacacaggccgccgcggcgaacgacgccaagaacaacaataagcgttcaatggaggccacctcccgggcgagcaacaccaaccaccacccggcggcgacggcgaacgagggcatgctgtccttctcgtcggcacccactacgcggccgtcgacgggcacgggcgcgccggccaagtccgagtccgaccactcggacctggatgcgtccgtgcgcgaggtggagagcagccgcgtcgtggcgccgccaccggaggcggagaagcggccgcgaaagcgcgggcggaagccggcgaacgggcgcgaggagccgctgaaccacgtggaggcggagcggcagcggcgagagaagctgaaccagcgcttctacgcgctgcgcgccgtggtgcccaacgtgtccaagatggacaaggcgtcgttgctcggcgacgccatctcctacatcaacgagctccgcggcaagctgacgtcgctggagtccgataaggacacgctgcaggcccagatcgaggcgctcaagaaggagcgcgacgcgcggccacccgcgcacgccgctgggctcggcggacacgacggcgggccgcgctgccacgcggtggagatcgacgccaagatcctaggtctggaggccatgatccgcgtgcagtgccacaagcgcaaccacccgtcggcgcggctgatgacggcgctccgcgagctggacctggacgtctaccacgccagcgtctccgtcgtcaaggacctcatgatccagcaggtcgccgtcaagatggccagccgcatatactcgcaggaccagctcaacgccgcgctctacagccgcctcgcagagcctgggtctgccatgggcaggtaa

SEQ ID NO: 15263 - protein, 709 aa, Sorghum bicolor
  misc_feature: The sequence is a functional homolog of SEQ ID NO 1238 in the 10/412,699 US patent application
  misc_feature: The sequence is a functional homolog of SEQ ID NO 943 in the 10/374,780 US patent application
  misc_feature: Ceres ANNOT ID no. 8639463
  misc_feature (528)..(577): Pfam ID: HLH Pfam Description: Helix-loop-helix DNA-binding domain
MNLWTDDNASMMEAFMASADLPTFPWGATAGGGNSSAAAATPPPPPQMPAAAMAPGFNQDTLQQRLQAMIEGSSETWTYAIFWQSSLDAATGASLLGWGDGYYKGCDDDKRKQRPLTPAAQAEQEHRKRVLRELNSLISGAAAAPDEAVEEEVTDTEWFFLVSMTQSFLNGSGLPGQALFAGQPTWIASGLSSAPCERARQAYNFGLRTMVCFPVGTGVLELGSTDVVFQTAESMAKIRSLFGGGAGGGSWPPVQPQAPSHQQPAAGPDQAETDLWLADAPVMDIKDSMSHPSAEISVSKPPPPPPPPQIHFENASTSTLTENPSPSVHAAPPQPAPAAAPQRQHQHQNQAHQGPFRRELNFSDFASTNPSSLAATPPFFKPESGEILSFGADSNARRNPSPAPPAATASLTTAPGSLFSQHTATMTQAAAANDAKNNNKRSMEATSRASNTNHHPAATANEGMLSFSSAPTTRPSTGTGAPAKSESDHSDLDASVREVESSRVVAPPPEAEKRPRKRGRKPANGREEPLNHVEAERQRREKLNQRFYALRAVVPNVSKMDKASLLGDAISYINELRGKLTSLESDKDTLQAQIEALKKERDARPPAHAAGLGGHDGGPRCHAVEIDAKILGLEAMIRVQCHKRNHPSARLMTALRELDLDVYHASVSVVKDLMIQQVAVKMASRIYSQDQLNAALYSRLAEPGSAMGR

SEQ ID NO: 15264 - DNA, 783 bp, Sorghum bicolor
  misc_feature: Ceres ANNOT ID no. 8639484
  misc_feature: Encodes the peptide sequence at SEQ ID NO 15265
atggcgattgaccacgactccccgttcaaggagctccgcctcaagaaccgcaggatcatgggaggcggcggccctgaccctgagccggaggaggaggaggaggaggccgccacggcggcgtacgcggagcagtggccgcgctggctgcagccgctgctgtccgcgcgcttcttcgcgcattgcaagacgcacagcgactcccaccgcagcggcgagtgcaacatgttctgcctcgactgcagctccgccgccgcgggcgcgggcacgcgcgcgctgtgctcgctgtgcctcgcgcacggccaccgcgaccaccacaccatccagatccgccgctcctcctaccacgacgtcatccgggtctccgacatccagcgcttcatggacatcgcgggggtgcagacctacgtcatcaacagcgcccgcgtcgtcttcctcaacgagcggccgcagcagcagaagccaggctgcggcggcggcggcaaggccgcgtcggcgtccgccaacctctgcgaggtctgcgcacgcagcctcctcgacaacttccgcttctgctccctcggatgcaaggtcatcggctgctcccccgacgccaccaaggccaggaactggctcctcaaggccggagccgacggcgacgactccacatcctcctcctcggccctgcgcaatgccgacaagaagcagagcttcacgccacccacgccgcagccgaccctgccgacgaagcgccgcaagggcatcccgcaccgcgcgccgttcggcagcctcatcgtcgagtactag

SEQ ID NO: 15265 - protein, 260 aa, Sorghum bicolor
  misc_feature: The sequence is a functional homolog of SEQ ID NO 664 in the 10/666,642 US patent application
  misc_feature: The sequence is a functional homolog of SEQ ID NO 668 in the 10/666,642 US patent application
  misc_feature: Ceres ANNOT ID no. 8639484
  misc_feature (61)..(190): Pfam ID: PLATZ Pfam Description: PLATZ transcription factor
MAIDHDSPFKELRLKNRRIMGGGGPDPEPEEEEEEAATAAYAEQWPRWLQPLLSARFFAHCKTHSDSHRSGECNMFCLDCSSAAAGAGTRALCSLCLAHGHRDHHTIQIRRSSYHDVIRVSDIQRFMDIAGVQTYVINSARVVFLNERPQQQKPGCGGGGKAASASANLCEVCARSLLDNFRFCSLGCKVIGCSPDATKARNWLLKAGADGDDSTSSSSALRNADKKQSFTPPTPQPTLPTKRRKGIPHRAPFGSLIVEY

SEQ ID NO: 15266 - DNA, 1272 bp, Sorghum bicolor
  misc_feature: Ceres ANNOT ID no. 8639523
  misc_feature: Encodes the peptide sequence at SEQ ID NO 15267
atggagaccaaagacgtgtcgccgctccccgccaccgccgccgccgccgccgcggcgcctgtgcctgcaccggcctctcagccgccgccggcccctccttctatggcgccgccgccgcagcagcaccagcatcagcaccagcaccagcaccagccgccgccgccgttcgcgcagcaggcggccccggcttcgtcgcctgccgggtccatgcctggcggcatgcggctctccttcgaccagatgtccgggaaggcggccggggagcagcaccaccactccgcgcccatgctgtacgcggcgtcaccgcagtccgcaccgggcgccggcgcgccaggcgcaccgggggccaatgtgctgggcatgggcgaactgatgcgcaagaagcgcgggcggccgcgcaagtacgcgcccgacgggagcatggctctggcgctggcccccatctcctccgcctcagccggcggcgccgcggcccccgggcagcagcagcagcacggcgggttctccatcagcagccccccgtccgaccccaacgccaagcgccgcggccggccccccggctccggcaagaagaagcagttcgaagccctgggttcttggggcatcgccttcacccctcacatcctcagcgtcaaggccggcgaggatgttgcttcaaaaataatgacattctcacagcaaggccctcgcacagtctgcatcctttctgcgaatggtgcaattagtaatgttacccttcggcagccagccacatctggtggactagttacttatgaggggcgctttgagatcatctcgctatctggttctttcctgcttgcggaggatggtgatactcgcagcaggactggtggcttgagtgtcgcacttgcaggatctgatggccgagttcttggagggtgtgttgctggaatgcttatggctgcaacacctgttcaggttgtggtggctagttttatcgcagagggaaagaaatcaaagccagctgaagcacggaaggttgaaccaatggctgctcctccaccacagatggctacctttgtgccagctccggtggccaccagccctccatcggagggaacatccagtgcatcatctgatgactctggcagcccaatcaaccacagtgcaatgccgttcaaccactccagccagcatcagcaccctcaccagcaccagcacatgccgcctgcctatgcatcggggggttggtccctctcagtgcaccagcagaataggcatgattctgacatgaagatgatgtcgaactaa

SEQ ID NO: 15267 - protein, 423 aa, Sorghum bicolor
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
  misc_feature: The sequence is a functional homolog of SEQ ID NO 2536 in the 10/374,780 US patent application
  misc_feature: The sequence is a functional homolog of SEQ ID NO 264 in the 10/225,066 US patent application
  misc_feature: Ceres ANNOT ID no. 8639523
METKDVSPLPATAAAAAAAPVPAPASQPPPAPPSMAPPPQQHQHQHQHQHQPPPPFAQQAAPASSPAGSMPGGMRLSFDQMSGKAAGEQHHHSAPMLYAASPQSAPGAGAPGAPGANVLGMGELMRKKRGRPRKYAPDGSMALALAPISSASAGGAAAPGQQQQHGGFSISSPPSDPNAKRRGRPPGSGKKKQFEALGSWGIAFTPHILSVKAGEDVASKIMTFSQQGPRTVCILSANGAISNVTLRQPATSGGLVTYEGRFEIISLSGSFLLAEDGDTRSRTGGLSVALAGSDGRVLGGCVAGMLMAATPVQVVVASFIAEGKKSKPAEARKVEPMAAPPPQMATFVPAPVATSPPSEGTSSASSDDSGSPINHSAMPFNHSSQHQHPHQHQHMPPAYASGGWSLSVHQQNRHDSDMKMMSN

SEQ ID NO: 15268 - DNA, 1062 bp, Sorghum bicolor
  misc_feature: Ceres ANNOT ID no. 8639530
  misc_feature: Encodes the peptide sequence at SEQ ID NO 15269
atgggaaccatgactctgccgcccggcttccggttccacccgacggacgacgagctggtgggctactacctcaagaggaaagtggacaacctcaagatcgagctcgaggtcatccccgtcattgatctctacaaatccgagccatgggaactaccagagaagtctttcctgccgaaacgagacctggaatggttcttcttctgcccccgggaccgcaagtaccccaacggctcccgcaccaaccgcgccacgacgacggggtactggaaggccaccggcaaggaccgccgcatcgcctgcgacggcggcgtctacggcctccgcaagacgctcgtcttctaccgcggccgcgcccccggcggcgagcgcaccgactgggtcatgcacgagtaccgcctctgccaggacatcgcccacggcgcatgcaacttcatcggtgcctacgcgctgtgccgcgtgatcaagcggcacgagctgcagggcggcgagccgccggcgggcagcagggcgaaaggcgccgccgccagcagcagcagcggcagcgcgagagggcagatgagcaaggtctccagcagctcgtccctcgtcaccagcgagcagctcagcgcgtcgttcacgccctccaactccaacagtccacctcctactctggacgtggggatgttccagttccagagccccgttggcgttgggtacgccggcgtgacggcgacggccaccaccggcacaggggggctgccgtggagcccactgcctccgcccctgctcctgtcgtcgtctccccacgacacgtttttcatcggcgacgacttccccgccacggccgcggacgagtcgcgttcgcacgcgcacttgttcggcggcgacatcatggggctgggcagcatctcggagcacgagctgaaatgggacagcttcccaaatacattctcgagtggtgccgacacgtggaacacggcggcggtggcggcgagcccgacgatgctgtgccggcaggccagcgacggcatcgaggacctggcggccatcttcttcccggacgacaacaggatcgtcttctga

SEQ ID NO: 15269 - protein, 353 aa, Sorghum bicolor
  misc_feature: The sequence is a functional homolog of SEQ ID NO 344 in the 10/666,642 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: Useful for biocontainment applications
  misc_feature: Functional homolog of the protein sequence given in SEQ ID NO 13623
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: Useful for making plants with altered carbohydrate content
  misc_feature: Functional homolog of the protein sequence given in SEQ ID NO 13622
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: Ceres ANNOT ID no. 8639530
  misc_feature (6)..(134): Pfam ID: NAM Pfam Description: No apical meristem (NAM) protein
MGTMTLPPGFRFHPTDDELVGYYLKRKVDNLKIELEVIPVIDLYKSEPWELPEKSFLPKRDLEWFFFCPRDRKYPNGSRTNRATTTGYWKATGKDRRIACDGGVYGLRKTLVFYRGRAPGGERTDWVMHEYRLCQDIAHGACNFIGAYALCRVIKRHELQGGEPPAGSRAKGAAASSSSGSARGQMSKVSSSSSLVTSEQLSASFTPSNSNSPPPTLDVGMFQFQSPVGVGYAGVTATATTGTGGLPWSPLPPPLLLSSSPHDTFFIGDDFPATAADESRSHAHLFGGDIMGLGSISEHELKWDSFPNTFSSGADTWNTAAVAASPTMLCRQASDGIEDLAAIFFPDDNRIVF

SEQ ID NO: 15270 - DNA, 1002 bp, Sorghum bicolor
  misc_feature: Ceres ANNOT ID no. 8639634
  misc_feature: Encodes the peptide sequence at SEQ ID NO 15271
atggaggagaggtacgaggcgctgaaggagcttggggccggcaacttcggggtggcgaggctggtcagggacaagcggaccaaggagctcgtcgccgtcaagtacatcgagaggggcaagaagattgatgagaatgtgcagagggagatcatcaatcaccagtcgctccggcaccctaacattgtacggttcaaggaggtttgtttaacacccacacatcttgctattgtcatggaatatgctgctggtggagagctatttgagaaaatcaccacagcagggcgattcagtgaagatgagtccaggtatttctttcagcagttgatatcaggggtcagctactgtcactctatggaaatttgtcaccgtgatcttaaacttgagaataccctccttgatgggagtccaacacctcgcgtgaaaatttgtgactttggttactcaaagtctgctttgctgcattccaaaccaaaatcaacagttggaactccagcatacatagcgccggaggttctttccagaaaagagtatgacggaaaggtagcagacgtttggtcctgtggtgtcacactgtacgtgatgctcgtgggatcatatccatttgaagatcctgaggatccaaggaacttccggaaaacgatcagcagaattcttggcgtgcaatactccatcccggattatgtgagagtgtcttcagagtgcaggcgccttctgtctcaaatattcgttgccgatccttcaaagaggatcacgatcccggagataaagcatcacccgtggttcctgaagaacctgccgagggagatctcggagagggagaaggccaactacaaggactcggatgccgccgagccggcgcaggccgtggacgagatcatgcggattgttcaggaggccaagacccccggtgacatgtccaaggtggtcgactcggcgctgctggccgagatggcagagctggagagcgacgacgaagaggcagacgccgatgacgcctactga

SEQ ID NO: 15271 - protein, 333 aa, Sorghum bicolor
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 14093
  misc_feature: Useful for making plants with modulated water use efficiency
  misc_feature: Functional homolog of the protein sequence given in SEQ ID NO 14094
  misc_feature: Ceres ANNOT ID no. 8639634
  misc_feature (1)..(306): SWISSPROT Homolog: EC 2.7.11.1 Non-specific serine/threonine protein kinase
  misc_feature (5)..(261): Pfam ID: Pkinase Pfam Description: Protein kinase domain
MEERYEALKELGAGNFGVARLVRDKRTKELVAVKYIERGKKIDENVQREIINHQSLRHPNIVRFKEVCLTPTHLAIVMEYAAGGELFEKITTAGRFSEDESRYFFQQLISGVSYCHSMEICHRDLKLENTLLDGSPTPRVKICDFGYSKSALLHSKPKSTVGTPAYIAPEVLSRKEYDGKVADVWSCGVTLYVMLVGSYPFEDPEDPRNFRKTISRILGVQYSIPDYVRVSSECRRLLSQIFVADPSKRITIPEIKHHPWFLKNLPREISEREKANYKDSDAAEPAQAVDEIMRIVQEAKTPGDMSKVVDSALLAEMAELESDDEEADADDAY

SEQ ID NO: 15272 - DNA, 786 bp, Sorghum bicolor
  misc_feature: Ceres ANNOT ID no. 8639625
  misc_feature: Encodes the peptide sequence at SEQ ID NO 15273
atggaccggaagcgcatcaaggacgccctcgagaagcacctggagaggtcgtcgccgtccacctccaggggcggcgtcgtgcccaaggagagggagcgcctagctgctgccgggaagctgccagcgtcgcttggcaaggcggagaagatgtctgatggtgaggaatttgaaactgacagcgaagattctgatgtcagtggttctgagggggaggacacatcctggatttcatggttctgtacattgcgaggcaatgaattcttttgtgagatcgatgaagactacatacaggatgattttaacctgtgtggtctgagtaatcaggtcccatattatgattatgcacttgatctcatcttagacattgagtcttctaatggtgatgtgttcactgaggagcaaaacgaattaatcgagtcgtctgcagagatgctgtatggattaattcacgcacgatacatcttaaccagcaagggtctagctgcaatgttggagaagttcaagaactatgactttggtagatgccccagagtgtactgctgtggccagccctgtcttccagcagggcaatcagatattcctagatcgagcacagtgaagatatattgtcccaaatgtgaggaacttaattatccaagatccaagtaccaagacattgatggatcatactttgggacgacattcccccatcttttcctgatgacttatccacacttgaagccgcagaagccgttgcagcaatacactccaagagtttttggcttcaaacttcacaagccgtcatga

SEQ ID NO: 15273 - protein, 261 aa, Sorghum bicolor
  misc_feature: Useful for making plants with modulated flowering time
  misc_feature: Functional homolog of the protein sequence given in SEQ ID NO 13452
  misc_feature: Ceres ANNOT ID no. 8639625
  misc_feature (75)..(248): Pfam ID: CK_II_beta Pfam Description: Casein kinase II regulatory subunit
MDRKRIKDALEKHLERSSPSTSRGGVVPKERERLAAAGKLPASLGKAEKMSDGEEFETDSEDSDVSGSEGEDTSWISWFCTLRGNEFFCEIDEDYIQDDFNLCGLSNQVPYYDYALDLILDIESSNGDVFTEEQNELIESSAEMLYGLIHARYILTSKGLAAMLEKFKNYDFGRCPRVYCCGQPCLPAGQSDIPRSSTVKIYCPKCEELNYPRSKYQDIDGSYFGTTFPHLFLMTYPHLKPQKPLQQYTPRVFGFKLHKPS

SEQ ID NO: 15274 - DNA, 1035 bp, Sorghum bicolor
  misc_feature: Ceres ANNOT ID no. 8639713
  misc_feature: Encodes the peptide sequence at SEQ ID NO 15275
atggcggttaatgcgagagacgaggagaagaagtacgacggggacgacaaccatctcgggcttgggctaagcctcagcctcggcatcgccaccaccgcggctactccggtcgaggtcgacccgccgccgcggcagcagcagcagcagcgagctatcagcgtcgcgcccatctcctccctccccgcgccgcagtggtggaacggacccgccggtctcttcttctccccctcctccgggatgaagatggatccatctctggagaggaagcatcagcatcagcagcagcagcagcagcaggcggcggccacgagctacagccacgatatgccgttcctgcgtgggatcgacgtgaaccggcgggccaccgccggagagacccggaggggccgcagctgcagcgaggacgaggagcccggcgcgtcgtcgccgaacagcacgctctccagcctcagcgggaagcgcgccgcgccggcgaggagcagcggagaagtggatcgagaggccgacggccacaccccgagagccggaggcggcggcagcgacgacgaggactccggcgccggcggtgggtcgcgcaagaagctccgcctctccaaggaccaggccgccgtcctcgaggacagcttcaaggagcacaacaccctcaaccccaagcagaaggcggcgctggcgaagcagctgaacctgaagccacgtcaggttgaggtctggttccagaaccgcagagccaggacgaagctgaagcagacggaggtggactgcgagttcctgaagcgctgctgcgagacgctgacggaggagaaccggcggctgcagcgggaggtggcggagctgcgcgcgctcaagctcgtggcgccgcaccactacgcgcggatgccgccgccaaccacgctcaccatgtgcccctcctgcgagcgcctcgcctccgcgcccgccgacgaggcggtggcgggccgtaccgccgcgcccacagggccctggggccctctccccgtgcggccagtgttcgtcgacggcccggcccggaggtcatga

SEQ ID NO: 15275 - protein, 344 aa, Sorghum bicolor
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13544
  misc_feature: The sequence is a functional homolog of SEQ ID NO 2328 in the 10/374,780 US patent application
  misc_feature: The sequence is a functional homolog of SEQ ID NO 524 in the 10/225,066 US patent application
  misc_feature: The sequence is a functional homolog of SEQ ID NO 553 in the 11/479,226 US patent application
  misc_feature: The sequence is a functional homolog of SEQ ID NO 254 in the 10/412,699 US patent application
  misc_feature: The sequence is a functional homolog of SEQ ID NO 550 in the 11/479,226 US patent application
  misc_feature: Useful for making plants with altered lignin content
  misc_feature: Functional homolog of the protein sequence given in SEQ ID NO 12880
  misc_feature: Useful for making plants with altered alkaloid content
  misc_feature: Functional homolog of the protein sequence given in SEQ ID NO 13109
  misc_feature: The sequence is a functional homolog of SEQ ID NO 2326 in the 10/374,780 US patent application
  misc_feature: The sequence is a functional homolog of SEQ ID NO 252 in the 10/412,699 US patent application
  misc_feature: The sequence is a functional homolog of SEQ ID NO 546 in the 11/479,226 US patent application
  misc_feature: The sequence is a functional homolog of SEQ ID NO 8 in the 10/225,068 US patent application
  misc_feature: The sequence is a functional homolog of SEQ ID NO 1674 in the 10/374,780 US patent application
  misc_feature: Ceres ANNOT ID no. 8639713
  misc_feature (3)..(160): Pfam ID: HD-ZIP_N Pfam Description: HD-ZIP protein N terminus
  misc_feature (248)..(292): Pfam ID: HALZ Pfam Description: Homeobox associated leucine zipper
  misc_feature (193)..(247): Pfam ID: Homeobox Pfam Description: Homeobox domain
MAVNARDEEKKYDGDDNHLGLGLSLSLGIATTAATPVEVDPPPRQQQQQRAISVAPISSLPAPQWWNGPAGLFFSPSSGMKMDPSLERKHQHQQQQQQQAAATSYSHDMPFLRGIDVNRRATAGETRRGRSCSEDEEPGASSPNSTLSSLSGKRAAPARSSGEVDREADGHTPRAGGGGSDDEDSGAGGGSRKKLRLSKDQAAVLEDSFKEHNTLNPKQKAALAKQLNLKPRQVEVWFQNRRARTKLKQTEVDCEFLKRCCETLTEENRRLQREVAELRALKLVAPHHYARMPPPTTLTMCPSCERLASAPADEAVAGRTAAPTGPWGPLPVRPVFVDGPARRS

SEQ ID NO: 15276 - DNA, 768 bp, Sorghum bicolor
  misc_feature: Ceres ANNOT ID no. 8639663
  misc_feature: Encodes the peptide sequence at SEQ ID NO 15277
atgcctccgctgctcacctcacccgcctccgcctcctcccctctcctcctcgcctcccgcgtcggcgctctccaccaccgcgccgccgcctcggtccacttcctcgcgccgcgcaggaagacccgcccgagcccgaccccgggccccgcgatgagctggcttgggaagctgggcctgagcgggctgggcggcagcccgcgcgcgtcggaggcgtcggcggcgctggcgcaggggcccgacgaggaccagcccgcgcccgggaacgagttcgcgcagttcggcgccggctgcttctggggcgtggagctcgcgttccagcgcgtgccgggagtcacgcgcaccgaggtcggctacagccagggcaacctccacgagccgacctacgaggacgtctgcaccggcgccacgaaccacaacgaggtcgtccgcgtgcagtacgaccccgccgcctgcaagttcgacgacctcctcgacaccttctgggcgcgccacgaccccaccacgcccaaccgacagggcaatgatgttggaacccagtataggtcagggatctacttctacaccccggagcaagagaaggcggcaagagaatccctggagaagcagcagaagcttctgaaccggacaatcgtcactgagattctaccggcgaagaggttctatagagcagaagagtaccatcagcagtacctggagaagggtggccgcttcggcttcaggcagtctgcatccaagggctgcaatgaccccatccgttgctacggatga

SEQ ID NO: 15277 - protein, 255 aa, Sorghum bicolor
  misc_feature: Useful for making plants with modulated flowering time
  misc_feature: Functional homolog of the protein sequence given in SEQ ID NO 13951
  misc_feature: Ceres ANNOT ID no. 8639663
  misc_feature (44)..(255): SWISSPROT Homolog: EC 1.8.4.11 Peptide-methionine-(S)-S-oxide reductase
  misc_feature (89)..(242): Pfam ID: PMSR Pfam Description: Peptide methionine sulfoxide reductase
MPPLLTSPASASSPLLLASRVGALHHRAAASVHFLAPRRKTRPSPTPGPAMSWLGKLGLSGLGGSPRASEASAALAQGPDEDQPAPGNEFAQFGAGCFWGVELAFQRVPGVTRTEVGYSQGNLHEPTYEDVCTGATNHNEVVRVQYDPAACKFDDLLDTFWARHDPTTPNRQGNDVGTQYRSGIYFYTPEQEKAARESLEKQQKLLNRTIVTEILPAKRFYRAEEYHQQYLEKGGRFGFRQSASKGCNDPIRCYG

SEQ ID NO: 15278 - DNA, 951 bp, Sorghum bicolor
  misc_feature: Ceres ANNOT ID no. 8639721
  misc_feature: Encodes the peptide sequence at SEQ ID NO 15279
atgacgcggcggtgctcgcactgcagccacaacgggcacaactcgcggacgtgccccaaccgcggggtcaagatcttcggggtgcgcctcaccgatggctccgccatccgcaagagcgccagcatggggaacctctccctcctctccgcgggatccaccagcggcggcgcgtcccccgccgacgggcccgacctcgccgacggcggcgccgggggatacgcctccgacgacttcgtccagggctcctcctccgccagccgcgagcgcaagaaaggtgttccttggactgaagaagaacaccggaggtttttgctgggattacaaaagcttgggaaaggtgattggcgaggaatttctcgtaatttcgtggtctcaagaacacctactcaagtagcaagtcatgctcaaaaatattttatacgtcaatcaaatatgagcagaaggaagagaaggtctagcctttttgacatggtgcctgatgagtccatggaccttccaccccttcctggaagtcaagaaccagagacctcagtgttaaatcaagcaccactgccgcctcctgtggaggaggaggtggaatcaatggagtcagatacttctgctgttgcagagagttctacggcttctgctctcatgcccgagagtttacaacctaattatccgatgattgttccagcttatttctcaccgttcttgcaattctcagttcctttctggccaaatcaggaagatggaggcgatctgccccaagaaacacacgagattgtcaagcctgtggcagttcattccaagaatccaattaatgttgatgaacttgtgggcatgtcaaagctaagcataggggagcctggtcaggagacagtttctacttctctgtcgctaaatctgctagggggtcaaaataggcagtcggctttccatgcaaatcctcaaacgagagctcaagcctga

SEQ ID NO: 15279 - protein, 316 aa, Sorghum bicolor
  misc_feature: The sequence is a functional homolog of SEQ ID NO 1045 in the 11/479,226 US patent application
  misc_feature: The sequence is a functional homolog of SEQ ID NO 452 in the 10/412,699 US patent application
  misc_feature: Ceres ANNOT ID no. 8639721
  misc_feature (92)..(139): Pfam ID: Myb_DNA-binding Pfam Description: Myb-like DNA-binding domain
MTRRCSHCSHNGHNSRTCPNRGVKIFGVRLTDGSAIRKSASMGNLSLLSAGSTSGGASPADGPDLADGGAGGYASDDFVQGSSSASRERKKGVPWTEEEHRRFLLGLQKLGKGDWRGISRNFVVSRTPTQVASHAQKYFIRQSNMSRRKRRSSLFDMVPDESMDLPPLPGSQEPETSVLNQAPLPPPVEEEVESMESDTSAVAESSTASALMPESLQPNYPMIVPAYFSPFLQFSVPFWPNQEDGGDLPQETHEIVKPVAVHSKNPINVDELVGMSKLSIGEPGQETVSTSLSLNLLGGQNRQSAFHANPQTRAQA

SEQ ID NO: 15280 - DNA, 900 bp, Sorghum bicolor
  misc_feature: Ceres ANNOT ID no. 8639744
  misc_feature: Encodes the peptide sequence at SEQ ID NO 15281
atggctcaagagctccaattagaaacgtcctcttccgcctctgccaccaccacctcgtcgtgtaccacctcctgctgctcgtccactgtcacggactcgtcgtcttcttcgccggcggcggccaatgccgcgcccgcgccacggaagcggcaggcggcggaggcagaggcagaggcagaggcagaggcagaggccgaggcggtcgaggaggaggaagaaggttgtgctggcaagacgacggcgccggcggcgaagaagcggaagcggagcagcgaggggaagcacccgacgtaccggggcgtgcggatgcgggcgtggggcaagtgggtgtcagagatccgcgagccgcggaagaagtcgcgcatatggctgggcacgttcccgaccgccgagatggcggcgcgcgcccacgacgtcgccgcgctcgccatcaagggccgcgccgcgaccgcgtacctcaacttcccggacctcgccggcgtgctcccgcgcgccgcgtccgcggcgcccaaggacgtccaggccgccgccgcattggccgctgcgttcacgtcgccgtcgtcaccatcatcggagcccggcgacgatgccggcgcgccggcggcgccatgcgacgcacgcgaagagcccgccgccgccgccaagggcggcgccgcgcccgaggagacagccgccgaggaacgggaaccggtgccactaccaccgccggtctctcagccagggacgccgtcgtcgagcggcgtggaggaagagaggcagctgttcgacttgccggacctgctcctcgacatccgggacgggttcgggtgcttcccgccgatgtgggccccgctcgacactgacgtggaggaggtggtcaatgcggagctgcgcctcgaggagccgctgctttgggagtag

SEQ ID NO: 15281 - protein, 299 aa, Sorghum bicolor
  misc_feature: Useful for making plants with altered lignin content
  misc_feature: Functional homolog of the protein sequence given in SEQ ID NO 13219
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: Ceres ANNOT ID no. 8639744
  misc_feature (96)..(147): Pfam ID: AP2 Pfam Description: AP2 domain
MAQELQLETSSSASATTTSSCTTSCCSSTVTDSSSSSPAAANAAPAPRKRQAAEAEAEAEAEAEAEAVEEEEEGCAGKTTAPAAKKRKRSSEGKHPTYRGVRMRAWGKWVSEIREPRKKSRIWLGTFPTAEMAARAHDVAALAIKGRAATAYLNFPDLAGVLPRAASAAPKDVQAAAALAAAFTSPSSPSSEPGDDAGAPAAPCDAREEPAAAAKGGAAPEETAAEEREPVPLPPPVSQPGTPSSSGVEEERQLFDLPDLLLDIRDGFGCFPPMWAPLDTDVEEVVNAELRLEEPLLWE

SEQ ID NO: 15282 - DNA, 1155 bp, Sorghum bicolor
  misc_feature: Ceres ANNOT ID no. 8639777
  misc_feature: Encodes the peptide sequence at SEQ ID NO 15283
atggcgtcggagtgggaaatggccgccatgggggtggagctcggcatgggaatgggcacgtaccaccaccacaacgcctccagcatcaccaccgcgcccatgagcagccaccacagcggcgccgccagctactccacgccgcaccaccaccaccaccattactacgggatgccgcccatgggcggcgacgccatgcgcgtggacgatcttctcgacctctccaccggcgccggcgccggtgcccacgacttcttccccaccgcggccgcggccactgacaaggggcaccagcaccactcgggcgccatgggtgagccgtcgcccaccgccaactcctcggatcaccagacgtcgctcctctccttcgccgatgagttctacatacccagcgaggaagctgccgagctggagtggctatccaagttcgtggacgactcctactccgacatgccgaattactcgtcggccgcgcatgccgcaatggcggcggccgcggctgctaacgcggcagcaggcaatggaggaggaggcacctcggccggcggtcaagacagctgcgtcaccggcgcggcgcctggccgcggcgcgcgtagcaagcggtcccgcgcgaccgccgcggcagccgcggcgtggcactccctcgtgccgcgcccgccgtcgcagtcgtcgccgtcgtcgtcctgctcgtcctcggacttcccgtcgtcgaacaagccgggcggtgcacggggcggcaacggcagccgcggcaagaagagcccggcgagccccggcggcggtcccgctggggtcgaggtgggcttggagggcggcgtgcgtcggtgcacgcactgcgcgtcggagaagacgccgcagtggcggacggggccgctgggccccaagaccctgtgcaacgcgtgcggcgtgcggttcaagtccgggcggctgatgcccgagtaccggccggcggccagccccacgttcgtgctcacgcagcactccaactcgcaccgcaaggtcatggagcttcgccgccagaaggagctcatcctcatccgcggaagccacagccaccgtgacgccgccgcagccgcagctgccgcggcggcggctgctgcaggatccgccgccgggccgaggccggagctcatcttccgtgactacggcgtgtgttaa

SEQ ID NO: 15283 - protein, 384 aa, Sorghum bicolor
  misc_feature: The sequence is a functional homolog of SEQ ID NO 607 in the 10/374,780 US patent application
  misc_feature: Ceres ANNOT ID no. 8639777
  misc_feature (275)..(310): Pfam ID: GATA Pfam Description: GATA zinc finger
MASEWEMAAMGVELGMGMGTYHHHNASSITTAPMSSHHSGAASYSTPHHHHHHYYGMPPMGGDAMRVDDLLDLSTGAGAGAHDFFPTAAAATDKGHQHHSGAMGEPSPTANSSDHQTSLLSFADEFYIPSEEAAELEWLSKFVDDSYSDMPNYSSAAHAAMAAAAAANAAAGNGGGGTSAGGQDSCVTGAAPGRGARSKRSRATAAAAAAWHSLVPRPPSQSSPSSSCSSSDFPSSNKPGGARGGNGSRGKKSPASPGGGPAGVEVGLEGGVRRCTHCASEKTPQWRTGPLGPKTLCNACGVRFKSGRLMPEYRPAASPTFVLTQHSNSHRKVMELRRQKELILIRGSHSHRDAAAAAAAAAAAAAGSAAGPRPELIFRDYGVC

SEQ ID NO: 15284 - DNA, 285 bp, Sorghum bicolor
  misc_feature: Ceres ANNOT ID no. 8639787
  misc_feature: Encodes the peptide sequence at SEQ ID NO 15285
atggccaccggcgggcggctgatgctgctcgcggcctccctcggcactggagcaggcaaaatgttgcggggcgcggcaccgtggggaagtggcgccggaggtggcagcgggagagtcaagaagaaagggatgccgagcaagaacctcatggccgagcgctgctgtcacaagaagctgaatgaccgcctctacatgctgcgctcggtggtgccaaagatcagcaaggtgaccaaccagactcgcccatccatctcatatttgtcttgcttccccatctatgcttag

SEQ ID NO: 15285 - protein, 94 aa, Sorghum bicolor
  misc_feature: Useful for making plants with altered lignin content
  misc_feature: Functional homolog of the protein sequence given in SEQ ID NO 12905
  misc_feature: The sequence is a functional homolog of SEQ ID NO 1378 in the 10/374,780 US patent application
  misc_feature: The sequence is a functional homolog of SEQ ID NO 1499 in the 10/412,699 US patent application
  misc_feature: The sequence is a functional homolog of SEQ ID NO 148 in the 10/225,068 US patent application
  misc_feature: The sequence is a functional homolog of SEQ ID NO 216 in the 10/374,780 US patent application
  misc_feature: The sequence is a functional homolog of SEQ ID NO 228 in the 10/225,066 US patent application
  misc_feature: The sequence is a functional homolog of SEQ ID NO 56 in the 10/286,264 US patent application
  misc_feature: The sequence is a functional homolog of SEQ ID NO 714 in the 10/412,699 US patent application
  misc_feature: The sequence is a functional homolog of SEQ ID NO 862 in the 11/435,388 US patent application
  misc_feature: Useful for making plants with modulated cold sensitivity
  misc_feature: Ceres ANNOT ID no. 8639787
MATGGRLMLLAASLGTGAGKMLRGAAPWGSGAGGGSGRVKKKGMPSKNLMAERCCHKKLNDRLYMLRSVVPKISKVTNQTRPSISYLSCFPIYA

SEQ ID NO: 15286 - DNA, 285 bp, Sorghum bicolor; identical to SEQ ID NO: 15284
  misc_feature: Ceres ANNOT ID no. 8639781
  misc_feature: Encodes the peptide sequence at SEQ ID NO 15287

SEQ ID NO: 15287 - protein, 94 aa, Sorghum bicolor; identical to SEQ ID NO: 15285
  misc_feature: Useful for making plants with altered lignin content
  misc_feature: Functional homolog of the protein sequence given in SEQ ID NO 12905
  misc_feature: The sequence is a functional homolog of SEQ ID NO 1378 in the 10/374,780 US patent application
  misc_feature: The sequence is a functional homolog of SEQ ID NO 1499 in the 10/412,699 US patent application
  misc_feature: The sequence is a functional homolog of SEQ ID NO 148 in the 10/225,068 US patent application
  misc_feature: The sequence is a functional homolog of SEQ ID NO 216 in the 10/374,780 US patent application
  misc_feature: The sequence is a functional homolog of SEQ ID NO 228 in the 10/225,066 US patent application
  misc_feature: The sequence is a functional homolog of SEQ ID NO 56 in the 10/286,264 US patent application
  misc_feature: The sequence is a functional homolog of SEQ ID NO 714 in the 10/412,699 US patent application
  misc_feature: The sequence is a functional homolog of SEQ ID NO 862 in the 11/435,388 US patent application
  misc_feature: Useful for making plants with modulated cold sensitivity
  misc_feature: Ceres ANNOT ID no. 8639781

SEQ ID NO: 15288 - DNA, 873 bp, Sorghum bicolor
  misc_feature: Ceres ANNOT ID no. 8639800
  misc_feature: Encodes the peptide sequence at SEQ ID NO 15289
atgggcttcccttcttcctccctccccgccgccgccgcggcggcggcgctcgtgctcctggccctgctcgccggaggaggcgagtgccgggaggcccagttcgacgcgacggacgcggccggcgccggcgcggagaacttcaacaccagcgacgccgccgtgtactggggcccctggcagaaggcccgggccacctggtacggccagcccaacggcgccggccccgacgacaacggtggcgcgtgcggcttcaagcacaccaaccagtacccattcatgtccatggggtcctgcggcaaccagccattgttcaaggacggcaagggctgcggctcctgctacaagattcggtgcaccaaggacagatcctgctccgggcgggcggagacggtgatcatcacggacatgaactactacccggtgtccaagtaccacttcgacctcagcggcacggcgttcggcaggctggccaagcccggcctcaacgacaagctccgccactccggcatcatcgacatcgagttcaccagggtgccgtgcgagttccctgggctgaagatcggtttccacgtggaggagtactcgaaccccgtctacttcgcggtgctggtggagtacgaggacggcgacggcgacgtggtgcaggtggacctgatggagtccaagacggcgcacgggcccccgacggggcggtggacgcccatgcgcgagtcctggggatccatctggcggatggacaccaaccaccgcatgcagccgcccttctccatccgcatccgcaacgagtccggcaagacgctcgtcgccagaaacgtcatcccggccaactggaggcccaacactttctaccgctccttcgtccagtaccagtag

SEQ ID NO: 15289 - protein, 290 aa, Sorghum bicolor
  misc_feature: Useful for making plants with altered carbohydrate content
  misc_feature: Functional homolog of the protein sequence given in SEQ ID NO 14064
  misc_feature: Ceres ANNOT ID no. 8639800
  misc_feature (187)..(274): Pfam ID: Pollen_allerg_1 Pfam Description: Pollen allergen
  misc_feature (96)..(175): Pfam ID: DPBB_1 Pfam Description: Rare lipoprotein A (RlpA)-like double-psi beta-barrel
MGFPSSSLPAAAAAAALVLLALLAGGGECREAQFDATDAAGAGAENFNTSDAAVYWGPWQKARATWYGQPNGAGPDDNGGACGFKHTNQYPFMSMGSCGNQPLFKDGKGCGSCYKIRCTKDRSCSGRAETVIITDMNYYPVSKYHFDLSGTAFGRLAKPGLNDKLRHSGIIDIEFTRVPCEFPGLKIGFHVEEYSNPVYFAVLVEYEDGDGDVVQVDLMESKTAHGPPTGRWTPMRESWGSIWRMDTNHRMQPPFSIRIRNESGKTLVARNVIPANWRPNTFYRSFVQYQ

SEQ ID NO: 15290 - DNA, 849 bp, Sorghum bicolor
  misc_feature: Ceres ANNOT ID no. 8639823
  misc_feature: Encodes the peptide sequence at SEQ ID NO 15291
atggccaccgcgctctccttcaaggccgcctttgcagtggccgcgctcctctccgtggtcgccgtcacctatggcgctcgcgcccagcagcagcccgacctgcacaacgccaccgactcgcagtcgcaggacagatccttgttgtcctacagcagtggctggctgccggccaaggccacctggtacggcgcgcccaccggcgccggccccgacgacaacggtggtgcgtgcgggttcaagggcacgaaccagtacccgttctcgtccatgacgtcgtgtggcaacgagcccatcttcaaggacggcaagggctgcggctcatgctatcagatacggtgccttaagagcaaccacccggcctgctccggcgtgccgcagacggtgatcatcacggacatgaactactacccggttgccaagtaccacttcgacctgagcggcacggcgttcggcgccatggcgagctggggcctcaacgacaagctccggcacgccgggatcatcgacatgcagttcaggagggtgccgtgcaacttcccgggcctgaccatcaccttccgcgtgcagcacgggtccaaccccatgtacctcgccgtgctcatcgagcacgagaaccaggacggcgacgtggtgcaggcggacatcatgcagaacaactccggctactgggagcccatgcacgagtcctggggatccatctggaggatcgaccccaaccgcccgctcaggggccccttctccatccgcatcaccaacgagtccggcaagcagctggtggccaagaacattatcccggccaactatgtcgccgacgtcgattaccgctcctacgtccagtatactagctaa

SEQ ID NO: 15291 - protein, 282 aa, Sorghum bicolor
  misc_feature: Useful for making plants with altered carbohydrate content
  misc_feature: Functional homolog of the protein sequence given in SEQ ID NO 13733
  misc_feature: Ceres ANNOT ID no. 8639823
  misc_feature (184)..(265): Pfam ID: Pollen_allerg_1 Pfam Description: Pollen allergen
  misc_feature (91)..(172): Pfam ID: DPBB_1 Pfam Description: Rare lipoprotein A (RlpA)-like double-psi beta-barrel
MATALSFKAAFAVAALLSVVAVTYGARAQQQPDLHNATDSQSQDRSLLSYSSGWLPAKATWYGAPTGAGPDDNGGACGFKGTNQYPFSSMTSCGNEPIFKDGKGCGSCYQIRCLKSNHPACSGVPQTVIITDMNYYPVAKYHFDLSGTAFGAMASWGLNDKLRHAGIIDMQFRRVPCNFPGLTITFRVQHGSNPMYLAVLIEHENQDGDVVQADIMQNNSGYWEPMHESWGSIWRIDPNRPLRGPFSIRITNESGKQLVAKNIIPANYVADVDYRSYVQYTS

SEQ ID NO: 15292 - DNA, 939 bp, Sorghum bicolor
  misc_feature: Ceres ANNOT ID no. 8639812
  misc_feature: Encodes the peptide sequence at SEQ ID NO 15293
atggccaccttgtcctccacagtagttgcacttgcacttggtgcacttctcttcttgctccttgcaacgtgtggctcatgcgcgataccggcgagctttaacgtctctgacttcaccgccgatcccaactgggaggctgccagggccacctggtacggtgcacccaccggtgccggccctgatgacaacggtggtgcctgtggattcaagaacgtgaacctgccgccgttctcggcaatgacatcgtgcggcaacgagcccctgttcaaggacggcaagggctgcggctcctgctaccagatacgatgccaacagcaccctgcctgctcgggcaacccagagacggtgatcatcactgacatgaactactaccccgtggccaagtaccacttcgacctcagcggcacggcgttcggcgccatggccaagcccggccgcaacgacgagctccgccacgctggcatcatcgacatccagttcaagagggtgccctgctactaccccgggcagaaggtgactttccacgtcgaggtgggctccaaccccgtctacttcgccgtgctcgtcgagttcgaggacggcgacggcgacgtggtgcaggtggacctcatggaggcgaactctgggtcgtggacaccgatgcgcgagtcctggggatccatctggaggctggactctgaccaccgcctcaccgcgccgttctccctgcgcattaccaacgagtccggcaagacgctggtggctaaccaagtcatcccggccaactggacgcccaacacctactaccgttccatggtccagtataattggctctctgctgctgcgcaccacaataattctgtgtcatcgcaccacaataattctgtgtcattgtggttgattagtttggcggcatggttatgcagccgacttaaatcaactttttttgtgacatattaa

SEQ ID NO: 15293 - protein, 312 aa, Sorghum bicolor
  misc_feature: Useful for making plants with altered carbohydrate content
  misc_feature: Functional homolog of the protein sequence given in SEQ ID NO 14064
  misc_feature: Useful for making plants with altered cell wall content and/or composition
  misc_feature: Functional homolog of the protein sequence given in SEQ ID NO 13995
  misc_feature: Ceres ANNOT ID no. 8639812
  misc_feature (172)..(253): Pfam ID: Pollen_allerg_1 Pfam Description: Pollen allergen
  misc_feature (81)..(160): Pfam ID: DPBB_1 Pfam Description: Rare lipoprotein A (RlpA)-like double-psi beta-barrel
MATLSSTVVALALGALLFLLLATCGSCAIPASFNVSDFTADPNWEAARATWYGAPTGAGPDDNGGACGFKNVNLPPFSAMTSCGNEPLFKDGKGCGSCYQIRCQQHPACSGNPETVIITDMNYYPVAKYHFDLSGTAFGAMAKPGRNDELRHAGIIDIQFKRVPCYYPGQKVTFHVEVGSNPVYFAVLVEFEDGDGDVVQVDLMEANSGSWTPMRESWGSIWRLDSDHRLTAPFSLRITNESGKTLVANQVIPANWTPNTYYRSMVQYNWLSAAAHHNNSVSSHHNNSVSLWLISLAAWLCSRLKSTFFVTY

SEQ ID NO: 15294 - DNA, 1071 bp, Sorghum bicolor
  misc_feature: Ceres ANNOT ID no. 8639813
  misc_feature: Encodes the peptide sequence at SEQ ID NO 15295
atggccgccgccggagcagctgcacttcttgccctcctcgccgcgcttgttgtcgtcgtcacgcattccggcgcaagcgcactgccggcggtggtgaacaaccacacctccgccgcccgccaactccgcggtcgttccggcggctggcagatggccaaggccacctggtacggcgcgccctacggcgccggccccgacgacaacggcggcgcgtgcgggttcaagaacaccaaccagtacccgttcatgtccatgacgtcgtgcggcaaccagcccttgttccaggacggccagggctgcggcgcatgctaccagatcaggtgcaccgctaaaaacaacccagcctgctccggcgaggtgaagacggtgatgatcacggacatgaactactacccggtggcgaggtaccacttcgacctgagcggcacggcgttcgggtccatggcgaggccggggctcaacgacaagctccggcacgcgggcatcatcgacatccagttcaggagggtggcctgcaacaaccgggggctcaccgtcaacttccacgtgcaggccggctccaaccccaactacctggcggtgctggtggagtacgccaacaaggccggcaccgtggtgcagatggacgccatggaggccaactccggccactggatgcccatgcgccgctcctgggggtccgggccccttctccatgcgcatccgcagcgagaacggcaggacgctggtggccaacaatgtcatcccggcaaactggagggccaacaccgactaccgctcctacgtccagttcacttaagcgaccacataattattaacccatcatcatcactggtatatatgattaatcatatacaaggtggtgctaaggttggttatttatttgggagtagtagagtgtattgtgtgattattgcaaattctttttggtttttgcaatgggttcggcgagtttttccgtgttgtcattgtgtgtatctgaggcgcgtcggaaatggaggaggcaaagtgttatacatacatgttgtctcccgcctaccgtccaaactccaatgtttgtacaacaagtag

SEQ ID NO: 15295 - protein, 356 aa, Sorghum bicolor
  misc_feature: Useful for making plants with altered carbohydrate content
  misc_feature: Functional homolog of the protein sequence given in SEQ ID NO 14064
  misc_feature: Ceres ANNOT ID no. 8639813
  misc_feature (86)..(167): Pfam ID: DPBB_1 Pfam Description: Rare lipoprotein A (RlpA)-like double-psi beta-barrel
  misc_feature (179)..(249): Pfam ID: Pollen_allerg_1 Pfam Description: Pollen allergen
MAAAGAAALLALLAALVVVVTHSGASALPAVVNNHTSAARQLRGRSGGWQMAKATWYGAPYGAGPDDNGGACGFKNTNQYPFMSMTSCGNQPLFQDGQGCGACYQIRCTAKNNPACSGEVKTVMITDMNYYPVARYHFDLSGTAFGSMARPGLNDKLRHAGIIDIQFRRVACNNRGLTVNFHVQAGSNPNYLAVLVEYANKAGTVVQMDAMEANSGHWMPMRRSWGSGPLLHAHPQRERQDAGGQQCHPGKLEGQHRLPLLRPVHLSDHIIINPSSSLVYMINHIQGGAKVGYLFGSSRVYCVIIANSFWFLQWVRRVFPCCHCVYLRRVGNGGGKVLYIHVVSRLPSKLQCLYNK

SEQ ID NO: 15296 - DNA, 810 bp, Sorghum bicolor
  misc_feature: Ceres ANNOT ID no. 8639816
  misc_feature: Encodes the peptide sequence at SEQ ID NO 15297
atggccgccgccgtgatctccatctcctcaaaggtggctgcactcgctgcactgttcgtggtgctcgccatgtccgccgaggcggcgagccccaacggcggctggctggcagccaaggccacatggtacggcgcgcccaacggcgcaggccctgacgacaacggtggcgcgtgtgggttcaagaacaccaaccagtacccgtacatgtccatgacgtcgtgcggcaacgagccgctgttcaaggacggcaagggctgcggcgcatgctaccagatacggtgcctgaatagcacccacgacgcttgctccggcagagcgaagcgtgtgatcatcacggacatgaactactacccggtgtccaagtaccacttcgacctgagcggcacggcgttcggcgccatggccaagaccgggctgaacgacaagctccggcacgcgggcatcatcgacatccagttcaggcgggtgccctgcaactacaagggcctgagcgtcaacttccgcgtccaggtgggttccaaccccaactacttcgcggtgctggtgcagtacgcgggcaaggacggcgccgtggtgcagctggacctgatggagaccagcaaggccaccggcaagccgacgggggtgtggacgccgatgcgcgtgtcgtggggcgccgtctggcgcctcgacaccaagcggcccctgcagccgcccttctcgctgcgcgttcggaacggctccggcaagacgctggtggccagcaacgtcatcccggccaactggaagccgatgaccgactacccctccaacgtccagttccctaattag

SEQ ID NO: 15297 - protein, 269 aa, Sorghum bicolor
  misc_feature: Useful for making plants with altered carbohydrate content
  misc_feature: Functional homolog of the protein sequence given in SEQ ID NO 14064
  misc_feature: Ceres ANNOT ID no. 8639816
  misc_feature (72)..(153): Pfam ID: DPBB_1 Pfam Description: Rare lipoprotein A (RlpA)-like double-psi beta-barrel
  misc_feature (165)..(252): Pfam ID: Pollen_allerg_1 Pfam Description: Pollen allergen
MAAAVISISSKVAALAALFVVLAMSAEAASPNGGWLAAKATWYGAPNGAGPDDNGGACGFKNTNQYPYMSMTSCGNEPLFKDGKGCGACYQIRCLNSTHDACSGRAKRVIITDMNYYPVSKYHFDLSGTAFGAMAKTGLNDKLRHAGIIDIQFRRVPCNYKGLSVNFRVQVGSNPNYFAVLVQYAGKDGAVVQLDLMETSKATGKPTGVWTPMRVSWGAVWRLDTKRPLQPPFSLRVRNGSGKTLVASNVIPANWKPMTDYPSNVQFPN

SEQ ID NO: 15298 - DNA, 837 bp, Sorghum bicolor
  misc_feature: Ceres ANNOT ID no. 8639818
  misc_feature: Encodes the peptide sequence at SEQ ID NO 15299
atggccgtcgcgatctccatcaaggtggctgcactcgtcatctccgtgttcgccacgcatggcgctcgcgcgcagccgagctacaacaacgcctcctcctcctccgcccgcagagagttgtactactccagcaccaccggcggcagctggctccctgccaaggccacctggtacggccggcccaacggcgccggccctgacaacaacggtggcgggtgtgggtacagcggcaccaacctgtaccctttcaattccatgacgtcctgtggcgacaggaacgtgttcagggacggcaagggctgcggctcatgctaccagataaaatgcgtgagcagcaacaaccctgcctgctccggcgtgccccagacgattatcatcaccgacgtgaactacgacaccagcctcggccccaaccgtttcgacctcagcggcacggcgttcggcgccatggctaagcctggcctcaacggcaagctccgcaatgccggcgccctcagcatccagtacaggagggtgccctgcaactacaagggcttgaacgtgaggttccacgtgatgggaggctgcaacccattctacttcgcggtgatcgtgtactacgcgggcagcgatggcgccgtggtgcaggtggagctcaaggaggccaactcgcggacatggaggccgctgtacgagtcgtggggcgccgtctggaggatagacccgggccacccgctgagggcgcccctctcgctgcgcgtccgcagcgacggcggcaagactctggtggcctacgacgtcatcccgatcaactggaggggcaatgccgattaccgtaccatcgctcagttccgctga

SEQ ID NO: 15299 - protein, 278 aa, Sorghum bicolor
  misc_feature: Useful for making plants with altered carbohydrate content
  misc_feature: Functional homolog of the protein sequence given in SEQ ID NO 13733
  misc_feature: Ceres ANNOT ID no. 8639818
  misc_feature (181)..(262): Pfam ID: Pollen_allerg_1 Pfam Description: Pollen allergen
  misc_feature (87)..(169): Pfam ID: DPBB_1 Pfam Description: Rare lipoprotein A (RlpA)-like double-psi beta-barrel
MAVAISIKVAALVISVFATHGARAQPSYNNASSSSARRELYYSSTTGGSWLPAKATWYGRPNGAGPDNNGGGCGYSGTNLYPFNSMTSCGDRNVFRDGKGCGSCYQIKCVSSNNPACSGVPQTIIITDVNYDTSLGPNRFDLSGTAFGAMAKPGLNGKLRNAGALSIQYRRVPCNYKGLNVRFHVMGGCNPFYFAVIVYYAGSDGAVVQVELKEANSRTWRPLYESWGAVWRIDPGHPLRAPLSLRVRSDGGKTLVAYDVIPINWRGNADYRTIAQFR

SEQ ID NO: 15300 - DNA, 849 bp, Sorghum bicolor
  misc_feature: Ceres ANNOT ID no. 8639824
  misc_feature: Encodes the peptide sequence at SEQ ID NO 15301
atggccaccgcgctctccttcaaggccgcctttgcagtggccgcgctcctctccgtggtcgccgtcacctatggcgctcccgcccagcagcagcccgacctgcacaacgccaccgactcgcagtcgcaggacagatccttgttgtcctacagcagtggctggctgccggccaaggccacctggtacggagcgcccaccggcgccggccccgacgacaacggtggtgcgtgcgggttcaagggcacgaaccagtacccgttctcgtccatgacgtcgtgtggcaacgagcccatcttcaaggacggcaagggctgcggctcatgctatcagatacggtgccttaagagcaaccacccggcctgctccggcgtgccgcagacggtgatcatcaccgacatgaactactacccggttgccaagtaccacttcgacctgagcggcacggcgttcggcgccatggcgagctggggcctcaacgacaagctccggcacgccgggatcatcgacatgcagttcaggagggtgccgtgcaacttcccgggcctgaccatcacgttccgcgtgcagcacgggtccaaccccatgtacctcgccgtgctcatcgagcacgagaaccaggacggcgacgtggtgcaggcggacatcatgcagaacaactccggctactgggagcccatgcacgagtcctggggatccatctggaggatcgaccccaaccgcccgctcaggggccccttctccatccgcatcaccaacgagtccggcaagcagctggtggccaagaacattatcccggccaactatgtcgccgacgtcgattaccgctcctacgtccagtatactaattaa

SEQ ID NO: 15301 - protein, 282 aa, Sorghum bicolor
  misc_feature: Useful for making plants with altered carbohydrate content
  misc_feature: Functional homolog of the protein sequence given in SEQ ID NO 13733
  misc_feature: Ceres ANNOT ID no. 8639824
  misc_feature (184)..(265): Pfam ID: Pollen_allerg_1 Pfam Description: Pollen allergen
  misc_feature (91)..(172): Pfam ID: DPBB_1 Pfam Description: Rare lipoprotein A (RlpA)-like double-psi beta-barrel
MATALSFKAAFAVAALLSVVAVTYGAPAQQQPDLHNATDSQSQDRSLLSYSSGWLPAKATWYGAPTGAGPDDNGGACGFKGTNQYPFSSMTSCGNEPIFKDGKGCGSCYQIRCLKSNHPACSGVPQTVIITDMNYYPVAKYHFDLSGTAFGAMASWGLNDKLRHAGIIDMQFRRVPCNFPGLTITFRVQHGSNPMYLAVLIEHENQDGDVVQADIMQNNSGYWEPMHESWGSIWRIDPNRPLRGPFSIRITNESGKQLVAKNIIPANYVADVDYRSYVQYTN

SEQ ID NO: 15302 - DNA, 1353 bp, Sorghum bicolor
  misc_feature: Ceres ANNOT ID no. 8639878
  misc_feature: Encodes the peptide sequence at SEQ ID NO 15303
atggttaatcccctcttcatcttcctccccctcctcagcgtcgccgccggcaccgacgggccggacccatgcgtaggccggcggatccacatccgcagcctgcctccgcgcttcaacaccgacctcctccgccactgcggggccgacgccttcccgctcgccgacccgtccgcggcggccacctcgaccccgccctgcgagtcgctcgccaaccacgggctcgggcctcgcactcacccacgcagccggtcttggtaccgcaccgacgcgcggcttctggaggccttcttccaccgccgcatcctggagcgggactgcctcgccgacgacccggccgacgccgacgccgtgttcctgccctactacgcggctctcgacgccctgccgtacgtgctcgatccgggcctgctcgacgaatccgcgcggcacggcgtggcgctggcggagttcctgtcgcgggaccaggcacggatcctgtctcgccggcacgggcatgaccatttcctggtggtcgcggggtccgcgtgggactacgcgcagtcgccgagcgtggagccgaggctatggggctcgacgtcgctgctgcggctgccggagctggccaacttcacgttcctgaccctggagtcccgcacgtggccgtggcaggagcacgcgatcccgcacccgacgtccttccacccgtcctccctcggccacctccgcgcctggctcgcccgcgcgcgccgttcgcgtcgcgccacgctgatgctcttcgcgggcggcgcctcccgcccgtcccggcccaacatccggggctccatcctctccgagtgcgccaaccgcaccgacgcgtgcgtcgtcgtcgactgctccggcggcaaatgcgcgcacgacccggtccggtacatgcgccccatgctgcggtccaagttctgcctgcagccgccgggggacacgccgacgcggcgctccacgttcgacgccatcctcgccgggtgcgtgcccgtgttcttcgaggacctcgcggcgcggaggcagtacgggtggcacctgcccccagtgcggtacgacgagttctcggtgcacatacccaaggaggccgtggtgttcggcggcgtccgaatcgtcgaggcgctggaggccgtgccggaggaagaggtgcggaggatgcggcggcgcgtgctggagatggcgccgagggtggtgtaccggcggcacgggagcacgcctgagctgagggaggccgtgaaggacgccgtcgacctcgccgtggatggcgtgctgcagaggatccggaggcggacgcgtgcactggaggacggactgccggagaggatttacgcgcaagaggaggatagcgtcgacatatag

SEQ ID NO: 15303 - protein, 450 aa, Sorghum bicolor
  misc_feature: Useful for making plants with altered cell wall content and/or composition
  misc_feature: Functional homolog of the protein sequence given in SEQ ID NO 14163
  misc_feature: Ceres ANNOT ID no. 8639878
  misc_feature (29)..(388): Pfam ID: Exostosin Pfam Description: Exostosin family
MVNPLFIFLPLLSVAAGTDGPDPCVGRRIHIRSLPPRFNTDLLRHCGADAFPLADPSAAATSTPPCESLANHGLGPRTHPRSRSWYRTDARLLEAFFHRRILERDCLADDPADADAVFLPYYAALDALPYVLDPGLLDESARHGVALAEFLSRDQARILSRRHGHDHFLVVAGSAWDYAQSPSVEPRLWGSTSLLRLPELANFTFLTLESRTWPWQEHAIPHPTSFHPSSLGHLRAWLARARRSRRATLMLFAGGASRPSRPNIRGSILSECANRTDACVVVDCSGGKCAHDPVRYMRPMLRSKFCLQPPGDTPTRRSTFDAILAGCVPVFFEDLAARRQYGWHLPPVRYDEFSVHIPKEAVVFGGVRIVEALEAVPEEEVRRMRRRVLEMAPRVVYRRHGSTPELREAVKDAVDLAVDGVLQRIRRRTRALEDGLPERIYAQEEDSVDI

SEQ ID NO: 15304 - DNA, 870 bp, Sorghum bicolor
  misc_feature: Ceres ANNOT ID no. 8639886
  misc_feature: Encodes the peptide sequence at SEQ ID NO 15305
atgccgtcgacggctcccctccgattcgccgtcgtcggggcgggcgcggcgggcctggcggcctcccgcgagctacgccgcgagggccacacgcccgtcgtcttcgagcgcgccgccgccgttggaggtacctggctctacacgccccccgccccgctcggcgccgcggcgactcataagaacagcggctccagcagcctctacgcatcgctccgcaccaacgtgccacgcgaggccatggggttcctcgacttccccttcgccgccgcgggctgtcgctgtcaggacccccgcaggttccccggacacgaggaggtcctccggtacctggaggcgttcgcgcggcggttcgatctgctccgcctcgtccgcttcgagacggaggtggtcagggtgcggagggggagcgacgacgggaggtgggcggtgacgtctaggaagcttggagagaaggggagcggcgccggcgaagacgaccaggaggagttctacgacgccgtcgtggtttgcaatggccactacacggcgccacgcatcgccgatattctcggagtagatgcttggccaggtaagcagatgcatagctacagttaccgtgtgccggagccatttctcgaccaagtagtgatcatagtcggagcctcggcaagtgcatttgacatttcaagagacatcgcatgcgtagcgaaagaggtccatgtcgccgatagatcagcaccacctcccacatgtgagaagcagcctggctacgataatctgtggcttcattccatggttgaccacgcacgggaggatggaagtgtggtgttccgagatggcagctcaatcagagctgatgtcatcatgcactgcactgggtacagtgattag

SEQ ID NO: 15305 - protein, 289 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 13561
  misc_feature: Ceres ANNOT ID no. 8639886
  misc_feature (57)..(259): SWISSPROT Homolog: EC 1.14.13.8 Flavin-containing monooxygenase
  misc_feature (8)..(285): Pfam ID: FMO-like Pfam Description: Flavin-binding monooxygenase-like
MPSTAPLRFAVVGAGAAGLAASRELRREGHTPVVFERAAAVGGTWLYTPPAPLGAAATHKNSGSSSLYASLRTNVPREAMGFLDFPFAAAGCRCQDPRRFPGHEEVLRYLEAFARRFDLLRLVRFETEVVRVRRGSDDGRWAVTSRKLGEKGSGAGEDDQEEFYDAVVVCNGHYTAPRIADILGVDAWPGKQMHSYSYRVPEPFLDQVVIIVGASASAFDISRDIACVAKEVHVADRSAPPPTCEKQPGYDNLWLHSMVDHAREDGSVVFRDGSSIRADVIMHCTGYSD

SEQ ID NO: 15306 - DNA, 375 bp, Sorghum bicolor
  misc_feature: Ceres ANNOT ID no. 8639903
  misc_feature: Encodes the peptide sequence at SEQ ID NO 15307
atggctgcaagagcggcgctcatcctggctgtcagcctggtccttgctgcagtggcgagcgcgacctactgcccgccgccaccggccccaaagccgccgacgcccacgcccagcgggcaccactgccccagggactctctgaagctgggcgtgtgcgccaacgtgctgggcctggtgaaggccaagatcggctcgccgccgtaccagccgtgctgctcgctgctggatgggctcgtcgacctggaggccgccgtctgcctctgcaccgctatcaaggccaacatcctcggcatcaacctgaacctccccatcgacctcagcctcatcctcaacaactgtggcaagaactgccccaacgatttccactgcgcatag

SEQ ID NO: 15307 - protein, 124 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
  misc_feature: Ceres ANNOT ID no. 8639903
  misc_feature (42)..(123): Pfam ID: Tryp_alpha_amyl Pfam Description: Protease inhibitor/seed storage/LTP family
MAARAALILAVSLVLAAVASATYCPPPPAPKPPTPTPSGHHCPRDSLKLGVCANVLGLVKAKIGSPPYQPCCSLLDGLVDLEAAVCLCTAIKANILGINLNLPIDLSLILNNCGKNCPNDFHCA

SEQ ID NO: 15308 - DNA, 801 bp, Sorghum bicolor
  misc_feature: Ceres ANNOT ID no. 8639942
  misc_feature: Encodes the peptide sequence at SEQ ID NO 15309
atgggatccctcgccaacaaaatcgtggtcgtggcggctgtcctttcagcgctcgtcggtggcggctcgtgcgcgcccaagaagttcccacctggccccaacatcacaaccaactacaacggccagtggctcgtcgccagggccacctggtatggccagcccaacggcgctggccctgacgacaacggcggtgcgtgcgggatcaagaacgtgaacctgccaccctacagcggcttcacagcctgcggtaacgtccccatcttcaaggacggcaaaggctgcggctcatgctacgaggtgagatgcaaggaaatgccggagtgttcgggcaacccgatcacggtgttcatcaccgacatgaactacgagcccatcgcaccctaccacttcgacttcagcggcaaggcctttggctccctggcaaagcccgggctcaacgacaagctccgccactgcggcatcatgaacgtggagttcaggagggtgcggtgcaagcttgggggcaagatcatgttccacgttgagaaggggtccaaccccaactacctggccgtgctggtcaagaacgtggcggacgacggcaacattgtgctcatggaactcgaggacaaggcgtcgccggggttcaagccgatgaagctctcctggggcgctgtctggaggtttgacacacccaagccgatcaagggccccttctccatccgcctcaccagcgagtccggcaagaagctcgtcgccccaaacgtcatcccggcaacctggaagcccgacaccctctacaactccaacatccagttctaa

SEQ ID NO: 15309 - protein, 266 aa, Sorghum bicolor
  misc_feature: Useful for making plants with altered carbohydrate content
  misc_feature: Functional homolog of the protein sequence given in SEQ ID NO 13733
  misc_feature: Ceres ANNOT ID no. 8639942
  misc_feature (170)..(251): Pfam ID: Pollen_allerg_1 Pfam Description: Pollen allergen
  misc_feature (80)..(159): Pfam ID: DPBB_1 Pfam Description: Rare lipoprotein A (RlpA)-like double-psi beta-barrel
MGSLANKIVVVAAVLSALVGGGSCAPKKFPPGPNITTNYNGQWLVARATWYGQPNGAGPDDNGGACGIKNVNLPPYSGFTACGNVPIFKDGKGCGSCYEVRCKEMPECSGNPITVFITDMNYEPIAPYHFDFSGKAFGSLAKPGLNDKLRHCGIMNVEFRRVRCKLGGKIMFHVEKGSNPNYLAVLVKNVADDGNIVLMELEDKASPGFKPMKLSWGAVWRFDTPKPIKGPFSIRLTSESGKKLVAPNVIPATWKPDTLYNSNIQF

SEQ ID NO: 15310 - DNA, 1605 bp, Sorghum bicolor
  misc_feature: Ceres ANNOT ID no. 8640020
  misc_feature: Encodes the peptide sequence at SEQ ID NO 15311
atgcctgccaccgccttcgcctccgcctccgtcgccgcgtcgccgtctccgtggtcgccgcgtccgcctcctcgccgcggccacgtccgggtccgcgcgccgccgccgagaagcggaagcagcgcgggcgggggcgggggcgacgagccctccaccgccacaccgtgggcgagccccgactggctcacgtcactctcgcgcgcggtcggccggagcggcggcggcgacgactccgggatccccgtcgcgtccgccaagctcgacgacgtgcgggacctcctcggcggcgcgctcttcctgccgctcttcaagtggttccgcgaggaagggcccgtctaccgcctcgccgcggggccacaggacttcgtcatcgtcagcgaccccgccgtcgccaggcacgtgctgcgcggctacggctcgcgctacgccaagggactagtcgccgaagtctccgagttcctcttcggctccggattcgccatcgcggagggcgacctatggacggtgagacgcagagctgttgtgccttccctgcacaaaagatttctgtccattatcgtggaaaaagtgttttgtaaatgtgctgagagattaatagagaaacttgagccatatgcttcgagtggggaacctgtcaatatggaagcgaggttttctcagttgacattggatgtgattggtctgtcattgttcaactacaattttgattccctcacaacagatagtcctgtcattgatgctgtgtatactgcactcaaagaagcagagcttcgttctacagatcttttgccatactggaagattgatttcttgtgcaagataattccaagacagataaaagcagagaatgcagttaggattataagaaacactgtcgaagagctgattatgaagtgtaaagaaatagtggaagctgaaaatgaacagattgagggtgaggaatatgtaagcagtgtacagttacgtgatgatctcttgtcaatgttagttgctggtcatgaaacaacaggctctgtactgacatggacaatctatcttctcagtaaggatccgactgcactgaggagagctcaagatgaagtagatcgtgttctacaaggtagactccccaaatatgaggatgtaaaggagctgaagtacttgatgcgctgtataaatgagtctatgcggctgtatccacaccctcctgtgctgttacggcgtgcaatagtcgatgatgttcttcctggaaactataaggttaaggctggtcaagatattatgatatctgtgtacaatatacacaggtccccagaggtctgggatagagcagatgagttcattccagagaggtttgatttagagggacctgttccaaatgagtcaaacacagattacaggtttattccattcagtggaggtcctcggaaatgtgttggagatcaatttgctctcctagaagcaatagtggcacttgcagttgtgttgcagaagattgatattcagcttgtgccagatcaaaagattaacatgactactggagctacaattcatacaacaaatggactatatatgaatgtaagcctgcgtaaagttcagcaagaagctgagttagcactgaggtga

SEQ ID NO: 15311 - protein, 534 aa, Sorghum bicolor
  misc_feature: Useful for making plants with altered cell wall content and/or composition
  misc_feature: Functional homolog of the protein sequence given in SEQ ID NO 14164
  misc_feature: Ceres ANNOT ID no. 8640020
  misc_feature (91)..(510): SWISSPROT Homolog: EC 1.14.13.98 Cholesterol 24-hydroxylase
  misc_feature (90)..(520): Pfam ID: p450 Pfam Description: Cytochrome P450
MPATAFASASVAASPSPWSPRPPPRRGHVRVRAPPPRSGSSAGGGGGDEPSTATPWASPDWLTSLSRAVGRSGGGDDSGIPVASAKLDDVRDLLGGALFLPLFKWFREEGPVYRLAAGPQDFVIVSDPAVARHVLRGYGSRYAKGLVAEVSEFLFGSGFAIAEGDLWTVRRRAVVPSLHKRFLSIIVEKVFCKCAERLIEKLEPYASSGEPVNMEARFSQLTLDVIGLSLFNYNFDSLTTDSPVIDAVYTALKEAELRSTDLLPYWKIDFLCKIIPRQIKAENAVRIIRNTVEELIMKCKEIVEAENEQIEGEEYVSSVQLRDDLLSMLVAGHETTGSVLTWTIYLLSKDPTALRRAQDEVDRVLQGRLPKYEDVKELKYLMRCINESMRLYPHPPVLLRRAIVDDVLPGNYKVKAGQDIMISVYNIHRSPEVWDRADEFIPERFDLEGPVPNESNTDYRFIPFSGGPRKCVGDQFALLEAIVALAVVLQKIDIQLVPDQKINMTTGATIHTTNGLYMNVSLRKVQQEAELALR

SEQ ID NO: 15312 - DNA, 930 bp, Sorghum bicolor
  misc_feature: Ceres ANNOT ID no. 8640038
  misc_feature: Encodes the peptide sequence at SEQ ID NO 15313
atggcgaggccttgtgatcttcaggcacagcaggcagctgctcttctcctggcatgcacgcttgctctgctcgcgctgcagctgcggccgtgcagagcccagcagcagcagcctccgtcgccgggctactaccccagtggcatgttcaggccgctgggcttctccgaggcgtaccgcacgctgtggggctcgcagcaccagacggtgtcgccggatggcaagtccctgacgctctggatggacagcagctcaggcagcgggttcaagtcggcgcgcgcgtaccgggacggctacttcggcgcgtcggtcagggtgcagccggggtataccgccggcgtcaacaccgccttctacctgtcgaacagcgaggagtacccggggcaccacgacgagatcgacatggagctgctggggacggtgccgggggagccgtacacgctgcagaccaacgtgtacgtgcgcggcagcggcgacggcaccatcgtcggccgggagatgaggttccacctctggttcgaccccaccgccgacttccaccactacgccatcatctggaaccccgaccagatcctgttcctggtggacgacgtgcccatcaggcggtacgagaggaagacggaggccacgttccctgaccgggagatgtgggcgtacggctccatctgggacgcctccgactgggccaccgacggcggacggtaccgcgccgactacaggtaccagccgttcgtgtcgcggttcgccggcctcaagatcggcgggtgcgccgcggacgcgtccgcggactgccaacctgtgccggcgtcggggacgacggcggcgctcagcgcgcagcaggaggccgccatgcggtgggcgcagcggaactccatggtgtattactactgcctcgacgcctccagggaccacgccctctaccccgagtgctga

SEQ ID NO: 15313 - protein, 309 aa, Sorghum bicolor
  misc_feature: Useful for making plants with altered carbohydrate content
  misc_feature: Functional homolog of the protein sequence given in SEQ ID NO 13842
  misc_feature: Useful for making plants with altered cell wall content and/or composition
  misc_feature: Functional homolog of the protein sequence given in SEQ ID NO 14165
  misc_feature: Ceres ANNOT ID no. 8640038
  misc_feature (54)..(309): SWISSPROT Homolog: EC 2.4.1.207 Xyloglucan:xyloglucosyl transferase
  misc_feature (54)..(240): Pfam ID: Glyco_hydro_16 Pfam Description: Glycosyl hydrolases family 16
  misc_feature (263)..(309): Pfam ID: XET_C Pfam Description: Xyloglucan endo-transglycosylase (XET) C-terminus
MARPCDLQAQQAAALLLACTLALLALQLRPCRAQQQQPPSPGYYPSGMFRPLGFSEAYRTLWGSQHQTVSPDGKSLTLWMDSSSGSGFKSARAYRDGYFGASVRVQPGYTAGVNTAFYLSNSEEYPGHHDEIDMELLGTVPGEPYTLQTNVYVRGSGDGTIVGREMRFHLWFDPTADFHHYAIIWNPDQILFLVDDVPIRRYERKTEATFPDREMWAYGSIWDASDWATDGGRYRADYRYQPFVSRFAGLKIGGCAADASADCQPVPASGTTAALSAQQEAAMRWAQRNSMVYYYCLDASRDHALYPEC

SEQ ID NO: 15314 - DNA, 180 bp, Sorghum bicolor
  misc_feature: Ceres ANNOT ID no. 8640075
  misc_feature: Encodes the peptide sequence at SEQ ID NO 15315
atgattgtgatgactttgtttaccacaataaaaagaaccaaagctttgagctaccatctgcacagctactattggcttgacttgcagggatgcaaggacatatatcattacaagatcgaagagtactcgcagacagctctgaacaagtttaatgtgatgcctgaatcaatacctgactag

SEQ ID NO: 15315 - protein, 59 aa, Sorghum bicolor
  misc_feature: Useful for making plants with modulated oxidative stress sensitivity
  misc_feature: Functional homolog of the protein sequence given in SEQ ID NO 13231
  misc_feature: Ceres ANNOT ID no. 8640075
MIVMTLFTTIKRTKALSYHLHSYYWLDLQGCKDIYHYKIEEYSQTALNKFNVMPESIPD
